United States Patent
Chang et al.

(10) Patent No.: US 11,560,567 B2
(45) Date of Patent: Jan. 24, 2023

(54) GENETIC ELEMENTS DRIVING CIRCULAR RNA TRANSLATION AND METHODS OF USE

(71) Applicant: The Board of Trustees of the Leland Stanford Junior University, Stanford, CA (US)

(72) Inventors: Howard Y. Chang, Stanford, CA (US); Chun-Kan Chen, Stanford, CA (US)

(73) Assignee: The Board of Trustees of the Leland Stanford Junior University, Stanford, CA (US)

( * ) Notice: Subject to any disclaimer, the term of this patent is extended or adjusted under 35 U.S.C. 154(b) by 0 days.

(21) Appl. No.: 17/696,606

(22) Filed: Mar. 16, 2022

(65) Prior Publication Data

US 2022/0251578 A1     Aug. 11, 2022

Related U.S. Application Data

(63) Continuation of application No. PCT/US2021/039127, filed on Jun. 25, 2021.

(60) Provisional application No. 63/186,507, filed on May 10, 2021, provisional application No. 63/043,964, filed on Jun. 25, 2020.

(51) Int. Cl.
| | |
|---|---|
| *C07H 21/02* | (2006.01) |
| *C07H 21/04* | (2006.01) |
| *C12N 15/67* | (2006.01) |
| *C12N 15/113* | (2010.01) |
| *C12N 15/85* | (2006.01) |

(52) U.S. Cl.
CPC ............ *C12N 15/67* (2013.01); *C12N 15/113* (2013.01); *C12N 15/85* (2013.01); *C12N 2840/203* (2013.01)

(58) Field of Classification Search
CPC .................................................. C12N 15/113
See application file for complete search history.

(56) References Cited

U.S. PATENT DOCUMENTS

| | | | |
|---|---|---|---|
| 5,766,903 | A | 6/1998 | Sarnow et al. |
| 2016/0082092 | A1 | 3/2016 | Hoerr et al. |
| 2016/0083747 | A1 | 3/2016 | Kruse |
| 2018/0044739 | A1 | 2/2018 | Weinbaum et al. |
| 2019/0345503 | A1 | 11/2019 | Chang et al. |

FOREIGN PATENT DOCUMENTS

| | | |
|---|---|---|
| WO | WO2010084371 A1 | 7/2010 |
| WO | WO2014082644 A1 | 6/2014 |
| WO | WO2016011222 A2 | 1/2016 |
| WO | WO2017081082 A2 | 5/2017 |
| WO | WO2017222911 A1 | 12/2017 |
| WO | WO2020023655 A1 | 1/2020 |
| WO | WO2020219563 A1 | 10/2020 |

OTHER PUBLICATIONS

Ahmad et al., "Breaching Self-Tolerance to Alu Duplex RNA Underlies MDA5-Mediated Inflammation." Cell. Feb. 8, 2018;172(4):797-810.e13.
Baranick et al., "Splicing mediates the activity of four putative cellular internal ribosome entry sites." Proc Natl Acad Sci USA. Mar. 25, 2008;105(12):4733-8.
Batista et al., "m(6)A RNA modification controls cell fate transition in mammalian embryonic stem cells." Cell Stem Cell. Dec. 4, 2014;15(6):707-19.
Bert et al., "Assessing IRES activity in the HIF-1 alpha and other cellular 5' UTRs." RNA. Jun. 2006;12(6):1074-83.
Brito et al., "A cationic nanoemulsion for the delivery of next-generation RNA vaccines." Mol Ther. Dec. 2014;22(12):2118-29.
Chandry et al., "Activation of a cryptic 5' splice site in the upstream exon of the phage T4 td transcript: exon context, missplicing, and mRNA deletion in a fidelity mutant." Genes Dev. Nov. 1987;1(9):1028-37.
Chen et al., "N6-Methyladenosine Modification Controls Circular RNA Immunity". Mol Cell. Oct. 3, 2019;76(1):96-109.e9.
Chen et al., "Pervasive functional translation of noncanonical human open reading frames." Science. Mar. 6, 2020;367(6482):1140-1146.
Chen et al., "Sensing Self and Foreign Circular RNAs by Intron Identity." Mol Cell. Jul. 20, 2017;67(2):228-238.e5.
Chu et al., "Systematic discovery of Xist RNA binding proteins." Cell. Apr. 9, 2015;161(2):404-16.
Crooke et al., "RNA-Targeted Therapeutics." Cell Metab. Apr. 3, 2018;27(4):714-739.
Devarkar et al., "Structural basis for m7G recognition and 2'-O-methyl discrimination in capped RNAs by the innate immune receptor RIG-I." Proc Natl Acad Sci USA. Jan. 19, 2016;113(3):596-601.
Dobrikova et al., "Activity of a type 1 picornavirus internal ribosomal entry site is determined by sequences within the 3' nontranslated region." Proc Natl Acad Sci USA. Dec. 9, 2003;100(25):15125-30.
Dolinnaya et al., "Oligonucleotide circularization by template-directed chemical ligation." Nucleic Acids Res. Nov. 25, 1993;21(23):5403-7.
Dolinnaya et al., "The use of BrCN for assembling modified DNA duplexes and DNA-RNA hybrids; comparison with water-soluble carbodiimide." Nucleic Acids Res. Jun. 11, 1991;19(11):3067-72.
Dominissini et al., "Topology of the human and mouse m6A RNA methylomes revealed by m6A-seq." Nature. Apr. 9, 2012;485(7397):201-6.

(Continued)

*Primary Examiner* — Amy H Bowman
(74) *Attorney, Agent, or Firm* — Casimir Jones, S.C.; Tanya A. Arenson

(57) ABSTRACT

Provided herein are recombinant circular RNA (circRNA) molecules comprising an internal ribosome entry site (IRES) operably linked to a protein-coding nucleic acid sequence. The IRES includes at least one RNA secondary structure element; and a sequence region that is complementary to an 18S ribosomal RNA (rRNA). Methods of producing a protein in a cell using the recombinant circRNA molecules are also provided.

20 Claims, 53 Drawing Sheets

Specification includes a Sequence Listing.

(56) References Cited

OTHER PUBLICATIONS

Durbin et al., "RNAs Containing Modified Nucleotides Fail to Trigger RIG-I Conformational Changes for Innate Immune Signalingm." Bio. 2016. 7: e00833-00816. 11 pages.

Edupuganti et al., "N 6-methyladenosine (m 6 A) recruits and repels proteins to regulate mRNA homeostasis." Nat Struct Mol Biol. Oct. 2017;24(10):870-878.

European Search Report for related EP17815958.8, dated Dec. 5, 2019, 12 pages.

Fedorova et al. "Cyanogen bromide-induced chemical ligation: Mechanism and optimization of the reaction conditions." Nucleosides, Nucleotides & Nucleic Acids 15.6 (1996): 1137-1147.

Ford et al., "Synthesis of circular RNA in bacteria and yeast using RNA cyclase ribozymes derived from a group I intron of phage T4." Proc Natl Acad Sci USA. Apr. 12, 1994;91(8):3117-21.

Garlapati et al., "Identification of a novel internal ribosome entry site in giardiavirus that extends to both sides of the initiation codon." J Biol Chem. Jan. 30, 2004;279(5):3389-97.

Glazar et al., "circBase: a database for circular RNAs." RNA. Nov. 2014;20(11):1666-70.

Gurtu et al., "IRES bicistronic expression vectors for efficient creation of stable mammalian cell lines." Biochem Biophys Res Commun. Dec. 4, 1996;229(1):295-8.

Hansen et al., "Natural RNA circles function as efficient microRNA sponges." Nature. Mar. 21, 2013;495(7441):384-8.

Haussecker et al., "Capped small RNAs and MOV10 in human hepatitis delta virus replication." Nat Struct Mol Biol. Jul. 2008;15(7):714-21.

Holdt et al., "Circular RNAs as Therapeutic Agents and Targets." Front Physiol. Oct. 9, 2018;9:1262.

Hornung et al., "5'-Triphosphate RNA is the ligand for RIG-I." Science. Nov. 10, 2006;314(5801):994-7.

International Search Report and Written Opinion for PCT/US20/47995. dated Jan. 26, 2021. 9 pages.

International Search Report and Written Opinion for PCT/US2021/039127. dated Dec. 13, 2021. 17 pages.

International Search Report of related PCT/US2017/037702, dated Oct. 27, 2017, 12 pages.

Jang et al., "Initiation of protein synthesis by internal entry of ribosomes into the 5' nontranslated region of encephalomyocarditis virus RNA in vivo." J Virol. Apr. 1989;63(4):1651-60.

Jeck et al., "Circular RNAs are abundant, conserved, and associated with ALU repeats." RNA. Feb. 2013;19(2):141-57.

Jeck et al., "Detecting and characterizing circular RNAs." Nat Biotechnol. May 2014;32(5):453-61.

Jiang et al., "A Quantitative Proteome Map of the Human Body." Cell. Oct. 1, 2020;183(1):269-283.e19.

Jiang et al., "Ubiquitin-induced oligomerization of the RNA sensors RIG-I and MDA5 activates antiviral innate immune response." Immunity. Jun. 29, 2012;36(6):959-73.

Kato et al., "Cell type-specific involvement of RIG-I in antiviral response." Immunity. Jul. 2005;23(1):19-28.

Kato et al., "Length-dependent recognition of double-stranded ribonucleic acids by retinoic acid-inducible gene-I and melanoma differentiation-associated gene 5." J Exp Med. Jul. 7, 2008;205(7):1601-10.

Kaufman et al., "Improved vectors for stable expression of foreign genes in mammalian cells by use of the untranslated leader sequence from EMC virus." Nucleic Acids Res. Aug. 25, 1991;19(16):4485-90.

Ke et al., "A majority of m6A residues are in the last exons, allowing the potential for 3' UTR regulation." Genes Dev. Oct. 1, 2015;29(19):2037-53.

Kobayashi et al., "Improved dicistronic mRNA expression vectors for efficient selection of transfectants highly expressing foreign genes." Biotechniques. Sep. 1996;21(3):398-402.

Kos et al., "The hepatitis delta (delta) virus possesses a circular RNA." Nature. Oct. 9-15, 1986;323(6088):558-60.

Kramer et al., "Combinatorial control of Drosophila circular RNA expression by intronic repeats, hnRNPs, and SR proteins." Genes Dev. Oct. 15, 2015;29(20):2168-82.

Kramps et al., "Messenger RNA-based vaccines: progress, challenges, applications." Wiley Interdiscip Rev RNA. Nov.-Dec. 2013;4(6):737-49.

Krutzfeldt et al., "Silencing of microRNAs in vivo with 'antagomirs'." Nature. Dec. 1, 2005;438(7068):685-9.

Li et al., "Coordinated circRNA Biogenesis and Function with NF90/NF110 in Viral Infection." Mol Cell. Jul. 20, 2017;67(2):214-227.e7.

Liang et al., "Short intronic repeat sequences facilitate circular RNA production." Genes Dev. Oct. 15, 2014;28(20):2233-47.

Liu et al., "Structure and Degradation of Circular RNAs Regulate PKR Activation in Innate Immunity." Cell. May 2, 2019;177(4):865-880.e21.

Martin et al., "Translation of the human angiotensin II type 1 receptor mRNA is mediated by a highly efficient internal ribosome entry site." Mol Cell Endocrinol. Dec. 30, 2003;212(1-2):51-61.

Martineau et al., "Internal ribosome entry site structural motifs conserved among mammalian fibroblast growth factor 1 alternatively spliced mRNAs." Mol Cell Biol. Sep. 2004;24(17):7622-35.

Memczak et al., "Circular RNAs are a large class of animal RNAs with regulatory potency." Nature. Mar. 21, 2013;495(7441):333-8.

Meyer et al., "Comprehensive analysis of mRNA methylation reveals enrichment in 3' UTRs and near stop codons." Cell. Jun. 22, 2012;149(7):1635-46.

Mokrejš et al., "IRESite—a tool for the examination of viral and cellular internal ribosome entry sites." Nucleic Acids Res. Jan. 2010;38(Database issue):D131-6.

Molinie et al., "m(6)A-LAIC-seq reveals the census and complexity of the m(6)A epitranscriptome." Nat Methods. Aug. 2016;13(8):692-8.

Mosser et al., "Use of a dicistronic expression cassette encoding the green fluorescent protein for the screening and selection of cells expressing inducible gene products." Biotechniques. Jan. 1997;22(1):150-161.

Olexiouk et al., "An update on sORFs.org: a repository of small ORFs identified by ribosome profiling." Nucleic Acids Res. Jan. 4, 2018;46(D1):D497-D502.

Pedersen et al., "Human insulin-like growth factor II leader 2 mediates internal initiation of translation." Biochem J. Apr. 1, 2002;363(Pt 1):37-44.

Peisley et al., "RIG-I forms signaling-competent filaments in an ATP-dependent, ubiquitin-independent manner." Mol Cell. Sep. 12, 2013;51(5):573-83.

Peisley et al., "Structural basis for ubiquitin-mediated antiviral signal activation by RIG-I." Nature. May 1, 2014;509(7498):110-4.

Perriman et al., "Circular mRNA can direct translation of extremely long repeating-sequence proteins in vivo." RNA. Sep. 1998;4(9):1047-54.

Petkovic et al., "RNA circularization strategies in vivo and in vitro." Nucleic Acids Res. Feb. 27, 2015;43(4):2454-65.

Pisarev et al., "Ribosomal position and contacts of mRNA in eukaryotic translation initiation complexes." EMBO J. Jun. 4, 2008;27(11):1609-21.

Puttaraju et al., "Generation of nuclease resistant circular RNA decoys for HIV-Tat and HIV-Rev by autocatalytic splicing." Nucleic Acids Symp Ser. 1995;(33):49-51.

Qi et al., "Melting temperature highlights functionally important RNA structure and sequence elements in yeast mRNA coding regions." Nucleic Acids Res. Jun. 2, 2017;45(10):6109-6118.

Ramesh et al., "High-titer bicistronic retroviral vectors employing foot-and-mouth disease virus internal ribosome entry site." Nucleic Acids Res. Jul. 15, 1996;24(14):2697-700.

Rees et al., "Bicistronic vector for the creation of stable mammalian cell lines that predisposes all antibiotic-resistant cells to express recombinant protein." Biotechniques. Jan. 1996;20(1):102-4, 106, 108-10.

Roundtree et al., "Dynamic RNA Modifications in Gene Expression Regulation." Cell. Jun. 15, 2017;169(7):1187-1200.

Rybak-Wolf et al., "Circular RNAs in the Mammalian Brain Are Highly Abundant, Conserved, and Dynamically Expressed." Mol Cell. Jun. 4, 2015;58(5):870-85.

(56) References Cited

OTHER PUBLICATIONS

Salzman et al., "Circular RNAs are the predominant transcript isoform from hundreds of human genes in diverse cell types." PLoS One. 2012;7(2):e30733. 12 pages.
Sanger et al., "Viroids are single-stranded covalently closed circular RNA molecules existing as highly base-paired rod-like structures." Proc Natl Acad Sci USA. Nov. 1976;73(11):3852-6.
Savva et al. "Reprogramming, Circular Reasoning and Self versus Non-self: One-Stop Shopping with RNA Editing." Front Genet. Jun. 7, 2016;7:100., 8 pages.
Schlake et al. "Developing mRNA-vaccine technologies." RNA Biol. Nov. 2012;9(11):1319-30.
Schlee et al., "Recognition of 5' triphosphate by RIG-I helicase requires short blunt double-stranded RNA as contained in panhandle of negative-strand virus." Immunity. Jul. 17, 2009;31(1):25-34.
Sokolova et al., "Chemical reactions within DNA duplexes. Cyanogen bromide as an effective oligodeoxyribonucleotide coupling agent." FEBS Lett. May 9, 1988;232(1):153-5.
Spitale et al., "Structural imprints in vivo decode RNA regulatory mechanisms." Nature. Mar. 26, 2015;519(7544):486-90.
Stein et al., "Translation of vascular endothelial growth factor mRNA by internal ribosome entry: implications for translation under hypoxia." Mol Cell Biol. Jun. 1998;18(6):3112-9.
Tomari et al., "RISC assembly defects in the Drosophila RNAi mutant armitage." Cell. Mar. 19, 2004;116(6):831-41.
Vandivier et al., "The Conservation and Function of RNA Secondary Structure in Plants." Annu Rev Plant Biol. Apr. 29, 2016;67:463-88.
Wang et al., "N6-methyladenosine-dependent regulation of messenger RNA stability." Nature. Jan. 2, 2014;505(7481):117-20.
Warren et al., "Highly efficient reprogramming to pluripotency and directed differentiation of human cells with synthetic modified mRNA." Cell Stem Cell. Nov. 5, 2010;7(5):618-30.
Weingarten-Gabbay et al., "Comparative genetics. Systematic discovery of cap-independent translation sequences in human and viral genomes." Science. Jan. 15, 2016;351(6270):aad4939. 15 pages.
Wesselhoeft et al., "Engineering circular RNA for potent and stable translation in eukaryotic cells." Nat Commun. Jul. 6, 2018;9(1):2629. 10 pages.
Wesselhoeft et al., "RNA Circularization Diminishes Immunogenicity and Can Extend Translation Duration In Vivo." Mol Cell. May 2, 2019;74(3):508-520.e4.
Wu et al., "How RIG-I like receptors activate MAVS." Curr Opin Virol. Jun. 2015;12:91-8.
Xia et al., "CSCD: a database for cancer-specific circular RNAs." Nucleic Acids Res. Jan. 4, 2018;46(D1):D925-D929.
Yang et al., "Extensive translation of circular RNAs driven by N6-methyladenosine." Cell Res. May 2017;27(5):626-641.
Yao et al., "ZKSCAN1 gene and its related circular RNA (circZKSCAN1) both inhibit hepatocellular carcinoma cell growth, migration, and invasion but through different signaling pathways." Mol Oncol. Apr. 2017;11(4):422-437.
Ying et al., "Cancer therapy using a self-replicating RNA vaccine." Nat Med. Jul. 1999;5(7):823-7.
Zarnegar et al., "irCLIP platform for efficient characterization of protein-RNA interactions." Nat Methods. Jun. 2016;13(6):489-92.
Zeng et al., "Reconstitution of the RIG-I pathway reveals a signaling role of unanchored polyubiquitin chains in innate immunity." Cell. Apr. 16, 2010;141(2):315-30.
Zhou et al., "Genome-Wide Maps of m6A circRNAs Identify Widespread and Cell-Type-Specific Methylation Patterns that Are Distinct from mRNAs." Cell Rep. Aug. 29, 2017;20(9):2262-2276.

FIGURE 2B
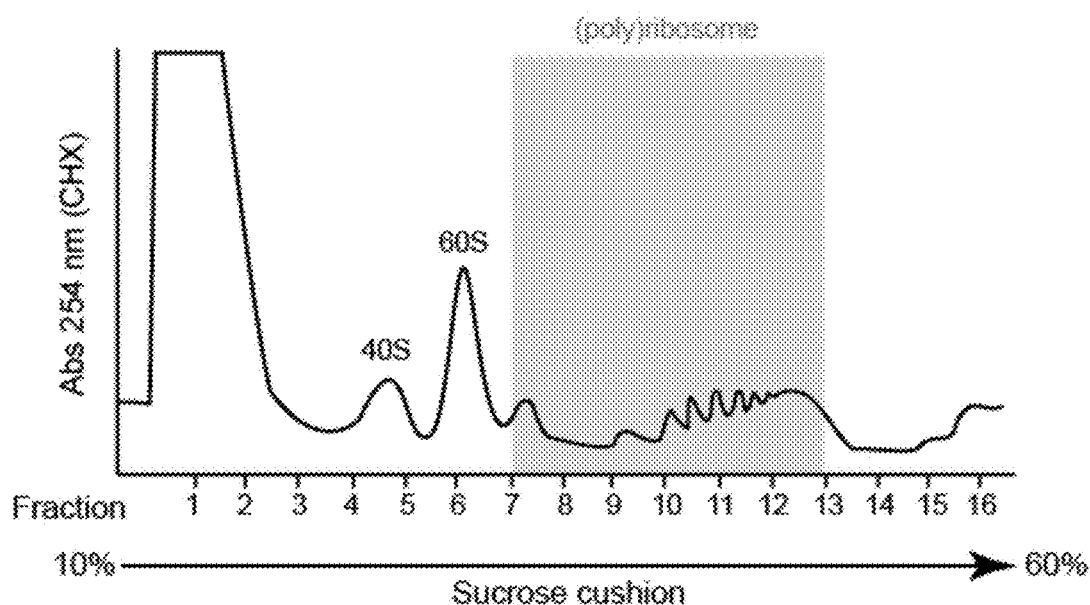
FIGURE 2C
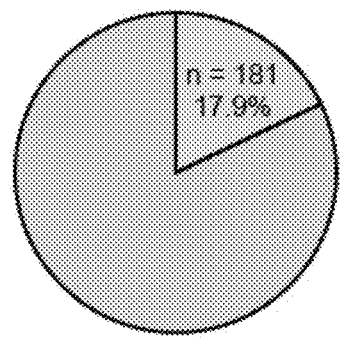
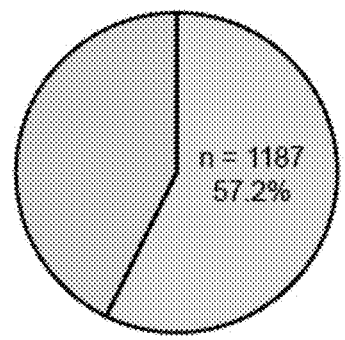
captured eGFP(-) oligos with
eGFP below the 20th percentile
(n=1,010)
captured eGFP(+) oligos with
eGFP above the 80th percentile
(n=2,074)

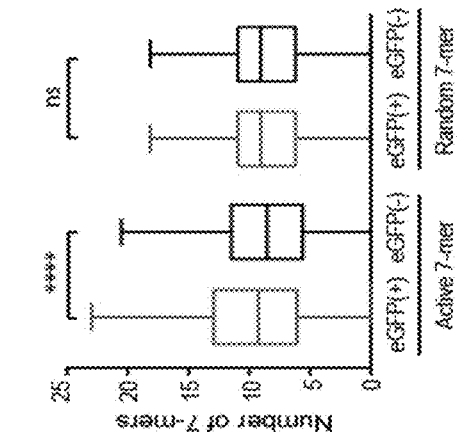
FIGURE 3A
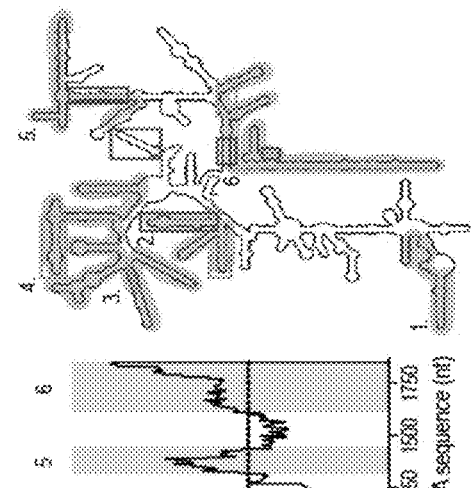
FIGURE 3B
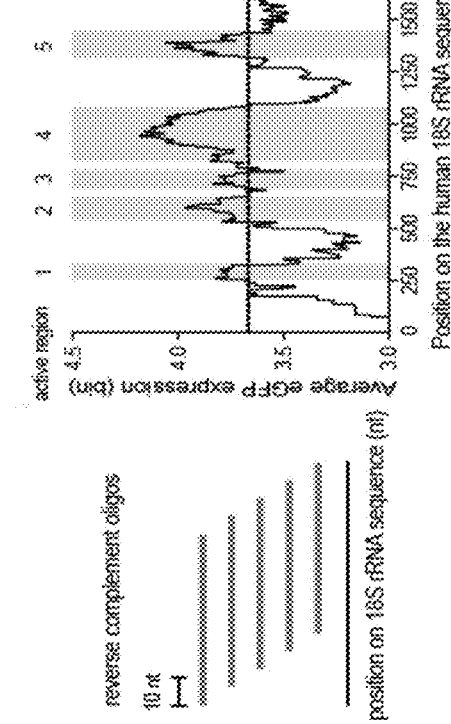
FIGURE 3E
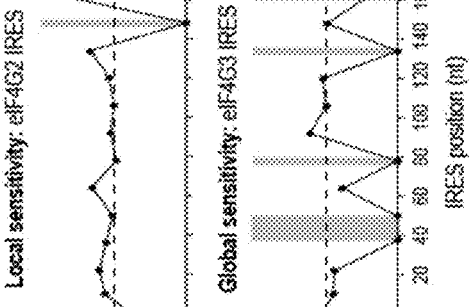
FIGURE 3C
FIGURE 3D
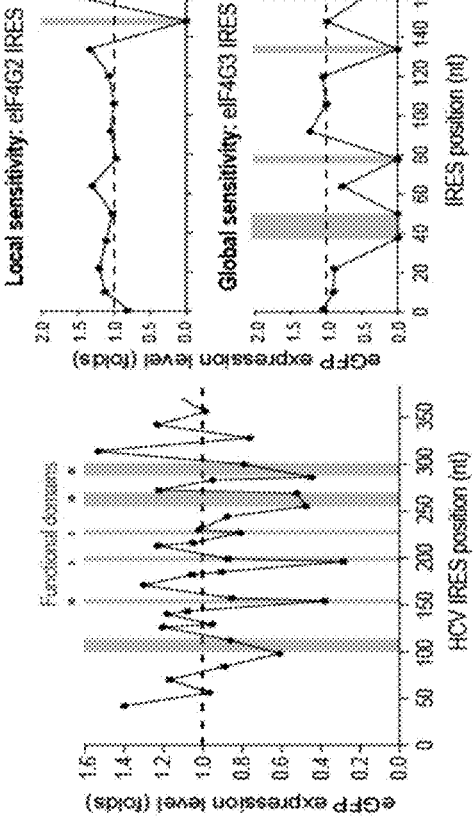
FIGURE 3F
FIGURE 3G
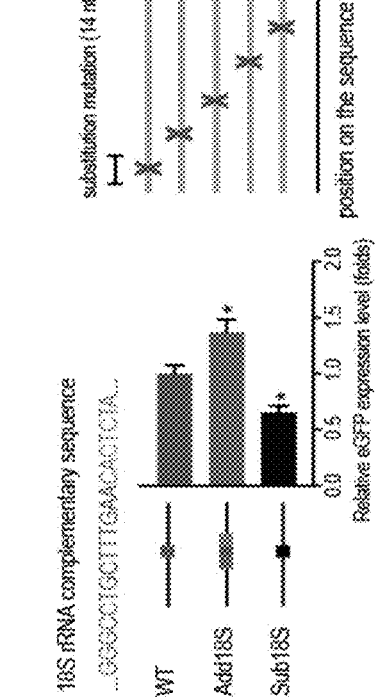
FIGURE 3H

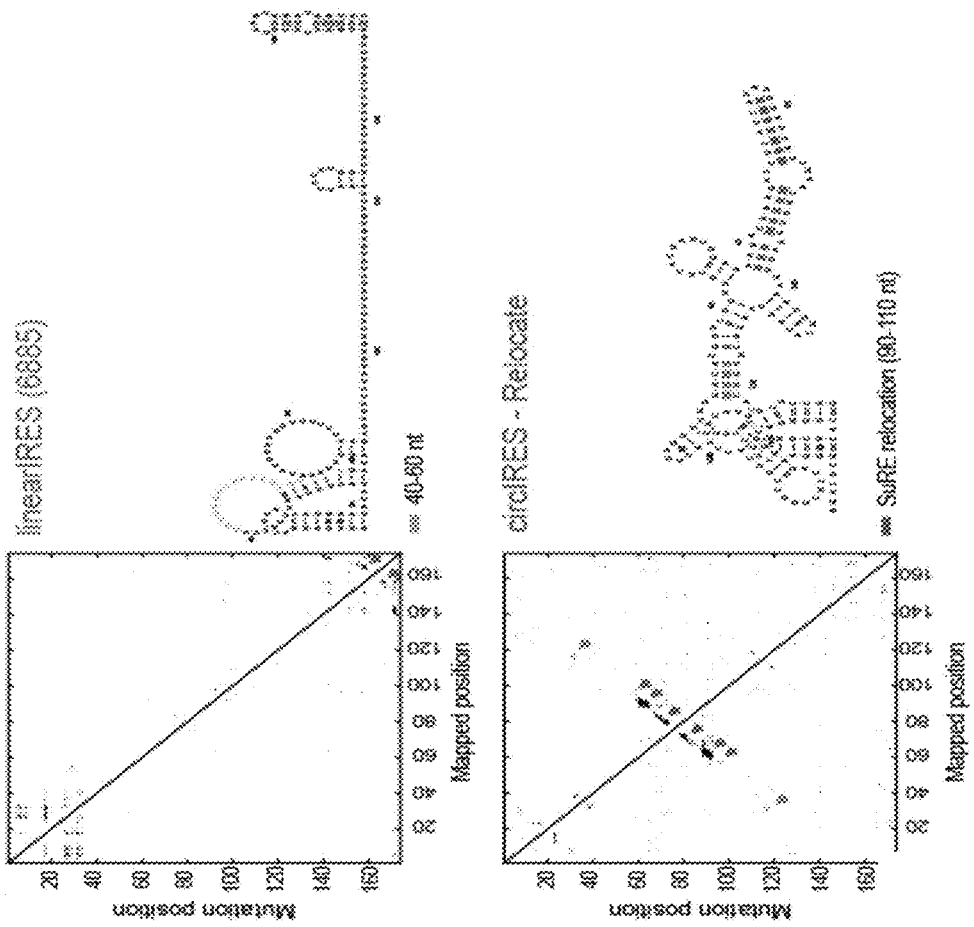
FIGURE 4B
FIGURE 4A
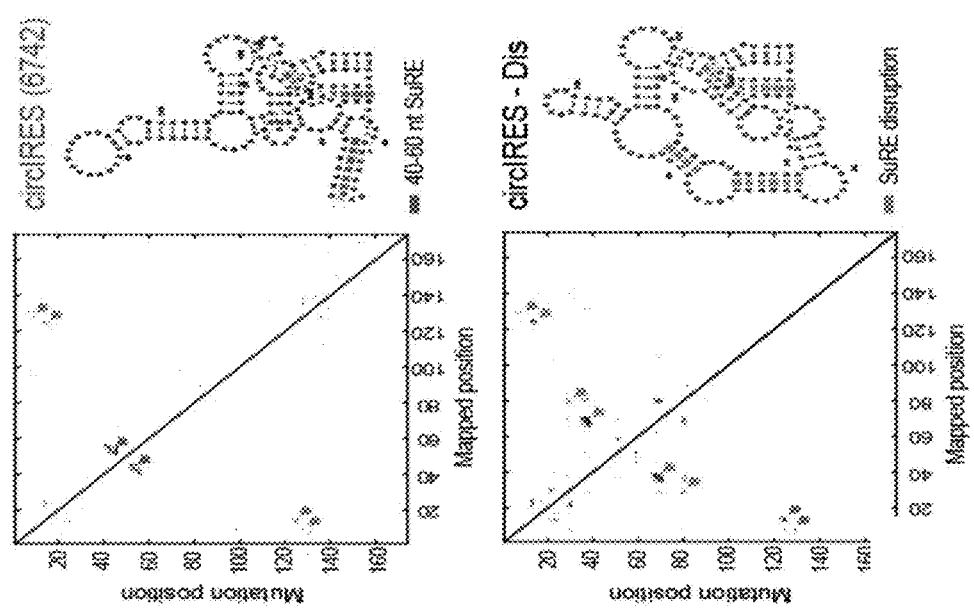
FIGURE 4D
FIGURE 4C

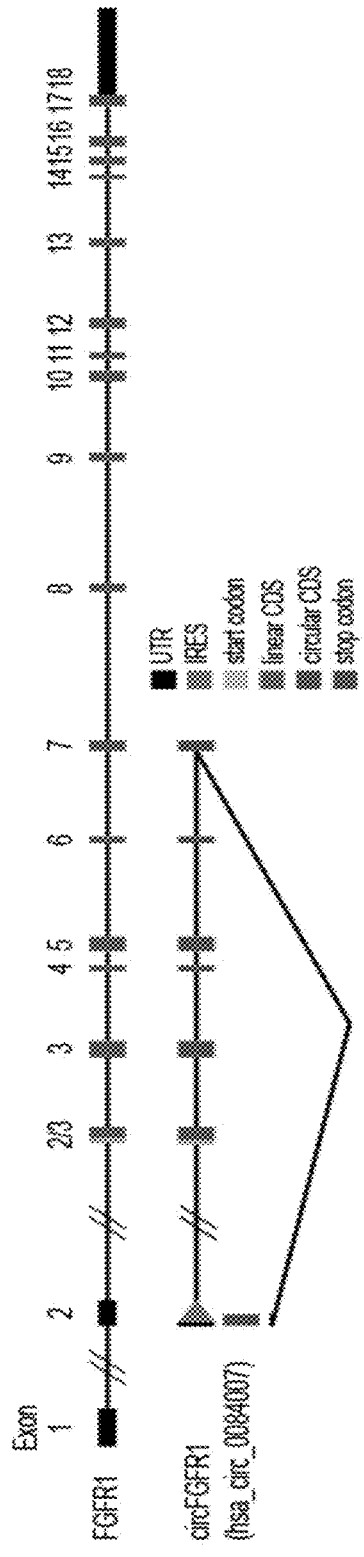
FIGURE 7A
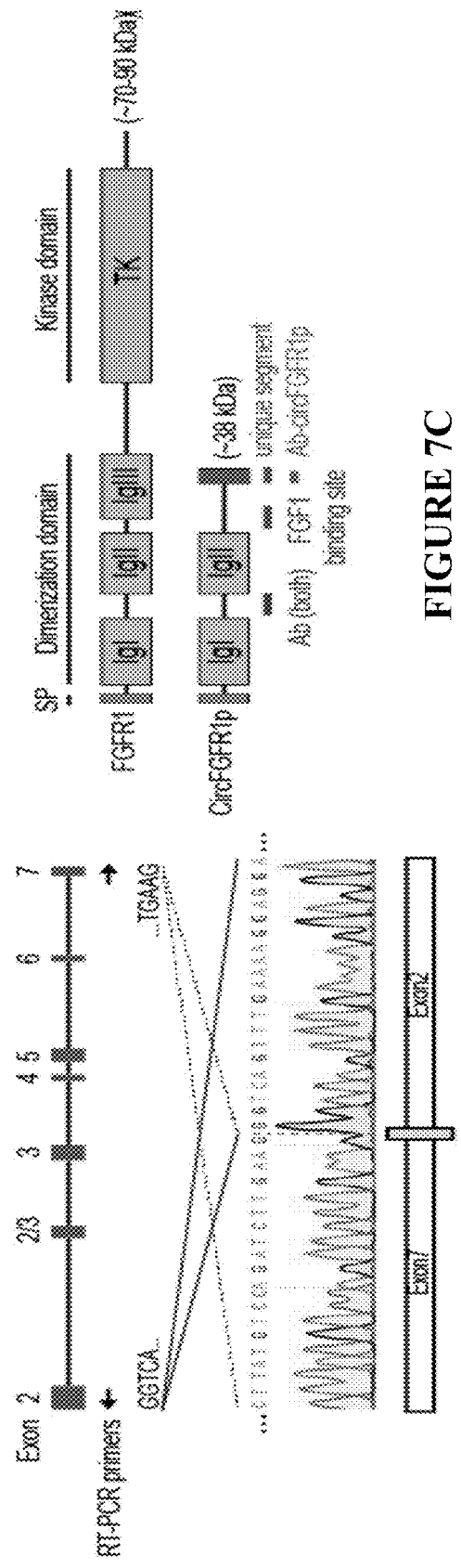
FIGURE 7B
FIGURE 7C

FIGURE 7G
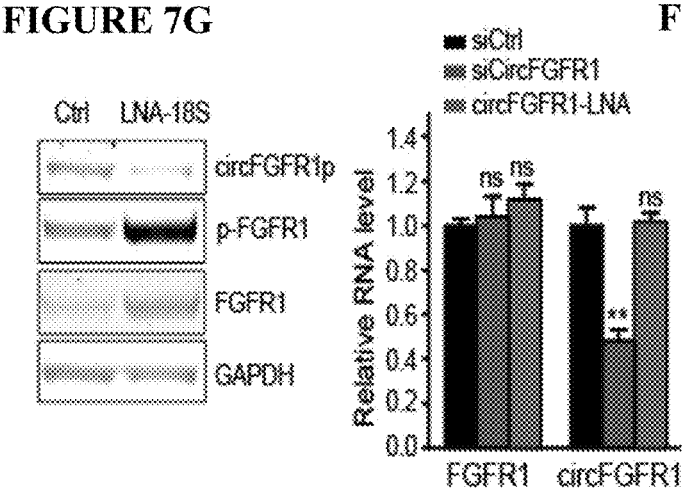
FIGURE 7H
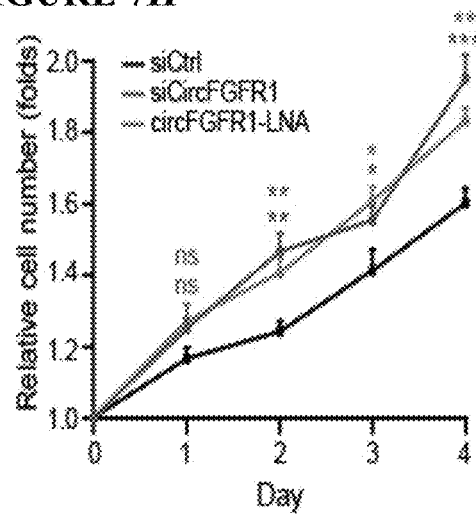
FIGURE 7I
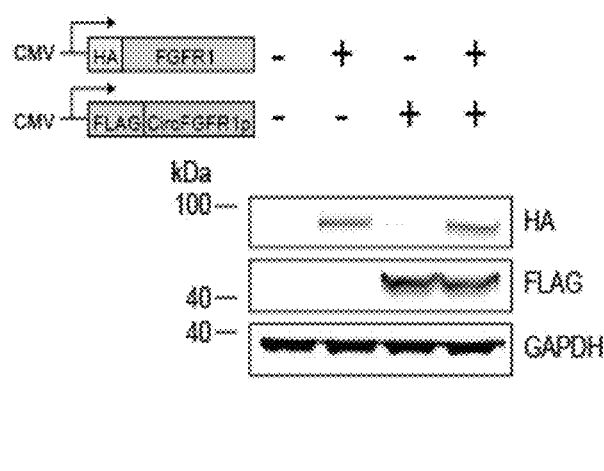
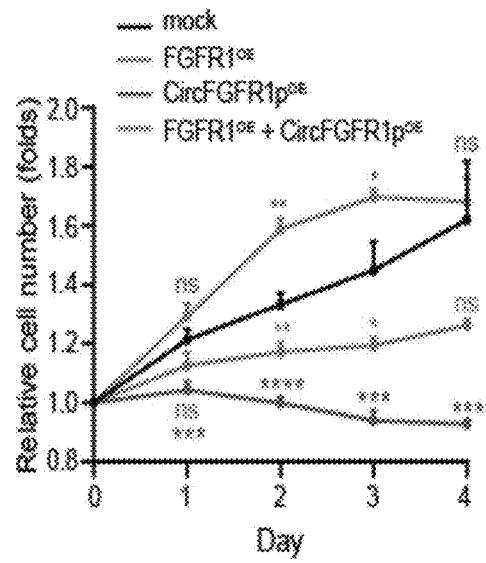

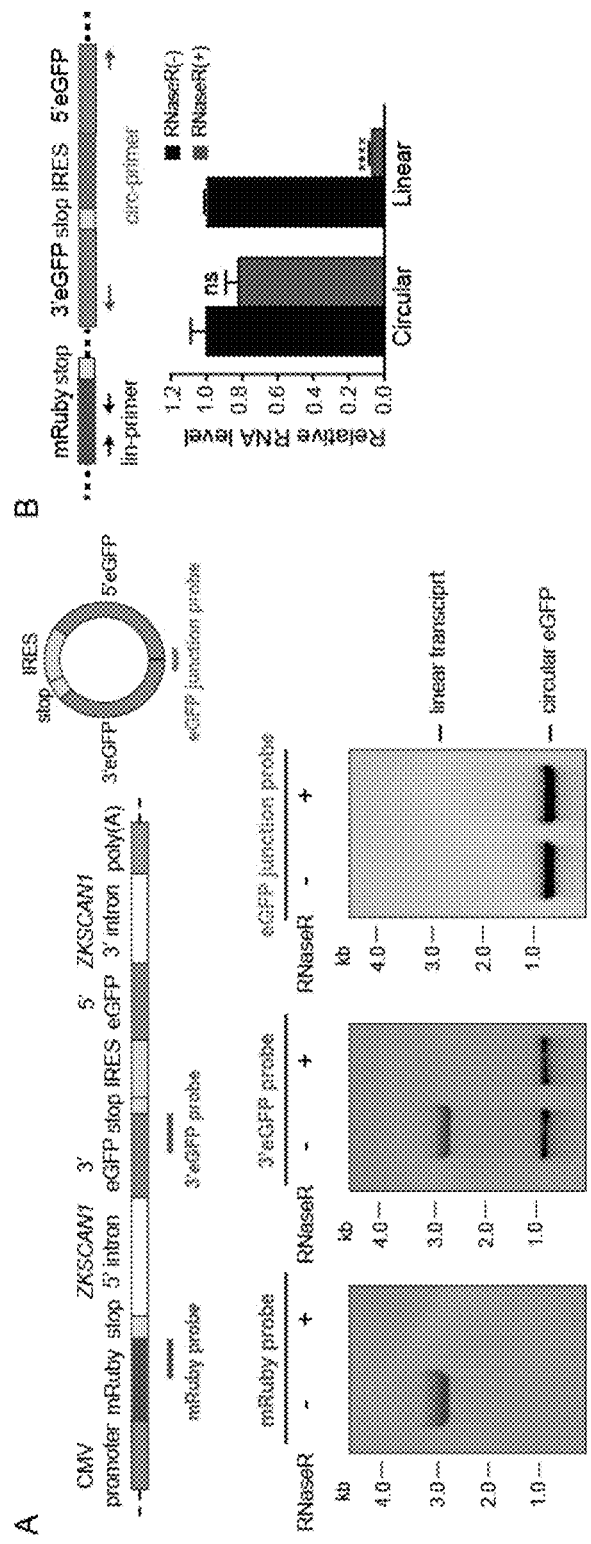

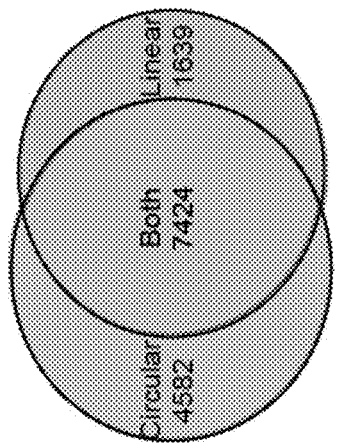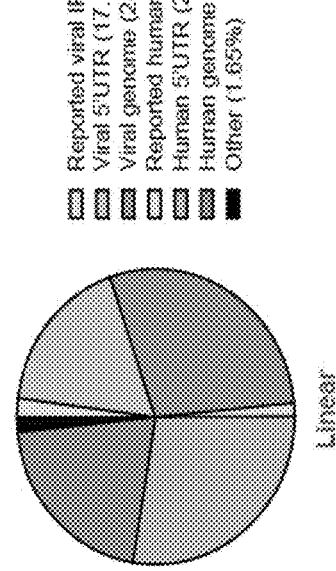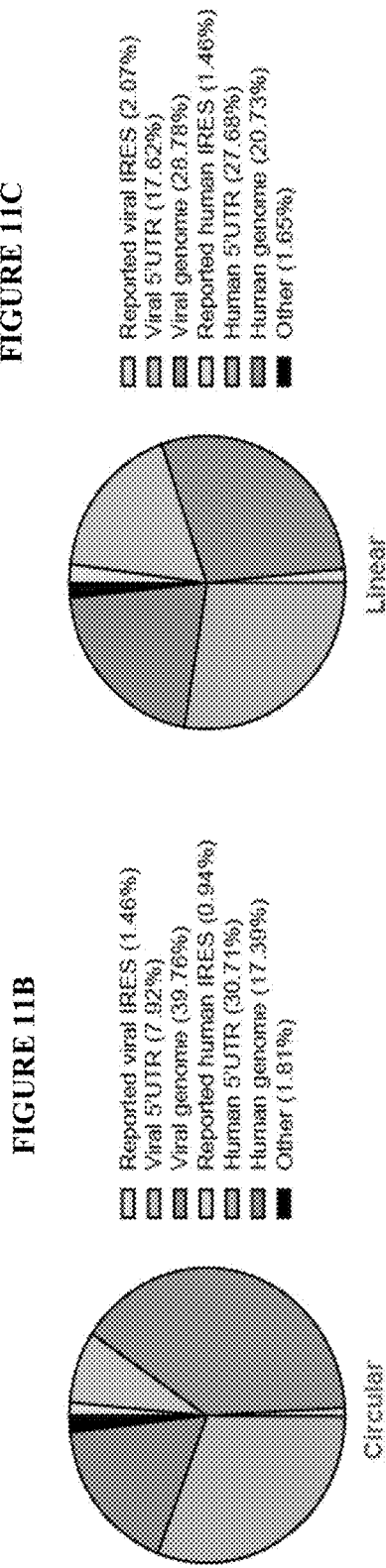

FIGURE 16E
FIGURE 16F
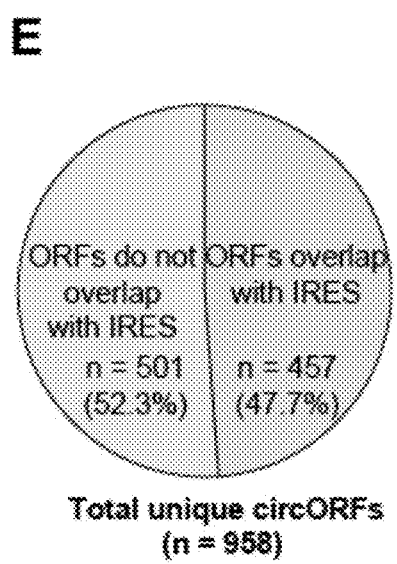
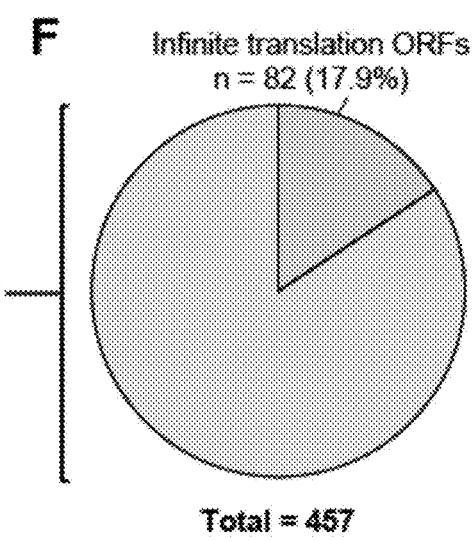

GENETIC ELEMENTS DRIVING CIRCULAR RNA TRANSLATION AND METHODS OF USE

CROSS-REFERENCE TO RELATED APPLICATIONS

This application is a continuation of International Application No. PCT/US2021/039127, filed Jun. 25, 2021, which claims priority to U.S. Provisional Application No. 63/186,507, filed May 10, 2021, and U.S. Provisional Application No. 63/043,964, filed Jun. 25, 2020, the contents of which are herein incorporated by reference in their entireties.

STATEMENT REGARDING FEDERALLY-SPONSORED RESEARCH

This invention was made with Government support under contract CA209919 awarded by the National Institutes of Health. The Government has certain rights in the invention.

SEQUENCE LISTING

The contents of the text file submitted electronically herewith are incorporated herein by reference in its entirety: A computer readable format copy of the Sequence Listing (filename: 38293-303_SeqList_ST25.txt, date created: Jun. 24, 2021, file size: about 12.8 megabytes).

FIELD

The present invention relates to recombinant circular RNA (circRNA) molecules comprising internal ribosome entry sites (IRESs) that contain an RNA secondary structure element and a nucleic acid sequence region complementary to 18S rRNA, as well as methods of use thereof.

BACKGROUND

Over the past decade, results from deep sequencing and computational analysis have suggested that circular RNAs (circRNAs) are a large class of RNAs in mammalian cells that play important roles in various biological processes. Disruption of circRNA expression has been found to be associated with human diseases, such as Alzheimer's disease, diabetes, and cancers. Furthermore, the exceptional stability and cell-specific expression patterns of circRNAs have led to the use of circRNAs as biomarkers for diseases such as cancers, and as indicators of the efficacy of certain treatments. While most of the studies demonstrate that circRNAs function as non-coding RNAs, such as sponges for miRNAs, regulators of mRNA splicing machinery, sequestration of RNA-binding proteins (RBPs), regulators of RBP interaction, and activators of immune responses, emerging evidence suggests that some circRNAs encode peptides and/or proteins and thereby function through these encoded polypeptides. Proteins known to be translated from circRNAs regulate cell proliferation, differentiation, migration, and myogenesis. Dysregulation of circRNA-encoded proteins has been associated with tumorigenesis in certain cancers. Accordingly, circRNA-encoded proteins may be an important link between the class of biologically relevant circRNA and cancer, and perhaps other diseases. Understanding the mechanism of circRNA translation, therefore, may aid in the development of therapeutic methods and/or modalities which exploit circRNA biology and their encoded proteins.

Because circRNA is generated by spliceosome-mediated head-to-tail joining of pre-mRNAs, it does not contain the 5'cap that is commonly known to be required for cap-dependent translation. Thus, circRNA translation utilizes alternate mechanisms to initiate cap-independent translation, such as the use of an internal ribosome entry site (IRES) sequence that is recognized by ribosomes. Introduction of an IRES on synthetically generated circRNAs is sufficient to initiate translation of encoded circRNA proteins, thereby suggesting that endogenous circRNAs harboring IRES sequence may have translation potential as they are exported to the cytoplasm.

Given the rapidly advancing yet nascent state of the art, there remains a need for the identification and characterization of the genetic elements, beyond the presence of an IRES, that can facilitate, initiate, direct or regulate circRNA translation. In particular, there is a need to identify novel IRES sequences that can operably facilitate expression of proteins encoded by circRNAs.

BRIEF SUMMARY OF THE INVENTION

The disclosure provides polynucleotides (e.g., DNA sequences) that encode one or more circular RNA (circRNA) molecules; wherein the circular RNA molecule comprises a payload sequence region (e.g., protein coding or non-coding sequence region) and an internal ribosome entry site (IRES) sequence region operably linked to the payload sequence region. In some embodiments, the IRES comprises: at least one sequence region having an RNA secondary structure element; and a sequence region that is complementary to an 18S ribosomal RNA (rRNA). In some embodiments, the IRES has a minimum free energy (MFE) of less than −18.9 kJ/mol and a melting temperature of at least 35.0° C. Some embodiments of the disclosure include those wherein the RNA secondary structure sequence region or element is formed from the nucleotides at about position 40 to about position 60 of the IRES, wherein the first nucleotide at the 5' end of the IRES is considered to be position 1.

The disclosure also provides polynucleotides (e.g., a DNA sequence) encoding a circular RNA molecule; wherein the circular RNA molecule comprises a protein-coding nucleic acid sequence and an internal ribosome entry site (IRES), wherein the IRES is encoded by any one of the nucleic acid sequences of SEQ ID NO: 1-228 or SEQ ID NO: 229-17201, or a nucleic acid sequence having at least 90% or at least 95% identity or homology thereto over at least 50% of the length of the nucleic acid sequence.

The disclosure also provides recombinant circular RNA molecules comprising a protein-coding nucleic acid sequence region and an internal ribosome entry site (IRES) sequence region operably linked to the protein-coding nucleic acid sequence region, wherein the IRES comprises: at least one sequence region having secondary structure element; and a sequence region that is complementary to an 18S ribosomal RNA (rRNA); wherein the IRES has a minimum free energy (MFE) of less than −18.9 kJ/mol and a melting temperature of at least 35.0° C. In some embodiments, the protein-coding nucleic acid sequence region is operably linked to the IRES in a non-native configuration.

The disclosure also provides recombinant circular RNA molecules comprising a protein-coding nucleic acid sequence region and an internal ribosome entry site (IRES) sequence region operably linked to the protein-coding nucleic acid sequence; wherein the IRES is encoded by any one of the nucleic acid sequences listed in of SEQ ID NO:

1-228 or SEQ ID NO: 229-17201, or a nucleic acid sequence having at least 90% or at least 95% homology or identity thereto. In some embodiments, the protein-coding nucleic acid sequence region is operably linked to the IRES in a non-native configuration.

Also provided are methods of producing a protein in a cell using the aforementioned recombinant circular RNA molecules, or polynucleotides (e.g., DNA molecules) encoding the same.

Also provided are as vectors comprising the aforementioned recombinant circular RNA molecules, or DNA molecules encoding the same.

Also provided are host cells comprising the aforementioned recombinant circular RNA molecules, or DNA molecules encoding the same.

Also provided are compositions comprising (i) a DNA sequence encoding a circular RNA, and (ii) a non-coding circular RNA or a DNA sequence encoding the same.

Also provided are methods for delivering a non-coding circular RNA to a cell, the methods comprising contacting the cell with a composition comprising a DNA sequence encoding a circular RNA, and (ii) a non-coding circular RNA or a DNA sequence encoding the same, thereby delivering the non-coding circular RNA to the cell.

The disclosure further provides an oligonucleotide comprising a nucleic acid sequence region that hybridizes to an internal ribosome entry site (IRES) sequence region present on a circular RNA molecule and upon hybridization inhibits translation of the coding sequence region of the circular RNA molecule. Also provided is a method of inhibiting translation of a protein-coding nucleic acid sequence region (e.g., payload) of a circular RNA molecule using the aforementioned oligonucleotide.

These and other embodiments will be explained in further detail below, and in the appended drawings.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1A provides a schematic overview of the high-throughput split-eGFP circRNA reporter screening assay for identifying circRNA IRES. A synthetic oligo library containing 55,000 oligos was cloned into a split-eGFP circRNA reporter. Since the full-length eGFP will only be reconstituted when back-spliced into the circRNA, the eGFP fluorescence signal can only come from the cap-independent translation activity driven by the inserted oligos on the circRNA. The eGFP(+) cells were sorted into seven expression bins by their eGFP fluorescence intensity with FACS. The number of reads for each synthetic oligo within each bin was determined by next-generation DNA sequencing. The final eGFP expression for each synthetic oligo was quantified by the mean weighted bin number according to the distribution of the number of reads across seven expression bins from two independent biological replicates. Shown in FIG. 1B is the eGFP expression distribution of 40,855 captured synthetic oligos. eGFP(+) oligos were defined as the oligos with eGFP expression higher than the background eGFP threshold (the eGFP expression of no-oligo-inserted eGFP circRNA reporter). The pie chart represents the composition of different oligo categories among eGFP(+) oligos. Shown in FIG. 1C is quantification of the percentage of captured eGFP(+) oligos among the oligos originated from the sequences of the reported IRES, viral 5' UTR, or human 5' UTR in the screening assay. Shown in FIG. 1D is identification of circular and linear RNA specific IRESs. Normalized eGFP expression (log 10) is shown for each captured oligo in the screening assay performed on the circular RNA (described herein) or the linear RNA (Weingarten-Gabbay et al., 2016)) screening system utilizing the same synthetic oligo library. Circular IRESs (green circles) or linear IRESs (blue circles) were identified by comparing the IRES activity of the oligos that were detected only in either circular or linear RNA screening system, respectively. Red dashed lines represent the normalized eGFP expression threshold.

FIG. 2A-2E show that circRNAs containing an eGFP(+) oligo have higher cap-independent translation activity. FIG. 2A shows a schematic overview of the circRNA polysome profiling method for capturing translated circRNAs. FIG. 2B shows (poly)ribosome fractionations of cells transfected with split-eGFP circRNA reporter containing the synthetic oligo library followed by cycloheximide (CHX) treatment. Fractions 7 to 12 (shaded in blue) were determined as (poly)ribosome fractions according to the Abs254 pattern. Shown in FIG. 2C is quantification of the percentage of (poly)ribosome-enriched oligos among the captured eGFP (−) oligos with eGFP expression below the 20th percentile or the eGFP(+) oligos with eGFP expression above the 80th percentile, respectively. FIG. 2D provides sequencing reads from Ribo-seq and QTI-seq plotted on the genes showing eGFP(+) oligos harboring aTIS (top), nTIS (middle), and dTIS (bottom) with overlapped annotated circRNAs (brown segments). FIG. 2E shows quantification of the percentage of eGFP(−) or eGFP(+) oligos harboring no TIS (TIS(−)) (left) or more than one TIS (TIS(+)) (right), and the percentage of aTIS, nTIS, or dTIS oligos among eGFP(+)/TIS (+) oligos.

FIG. 3A-3J shows that the 18S rRNA complementary sequence on the IRES facilitates circRNA cap-independent translation activity. Provided in FIG. 3A is a schematic of the sliding-window design of synthetic oligos for mapping the active regions on the human 18S rRNA. FIG. 3B shows quantification of the mean eGFP expression of the synthetic oligos overlapped with the corresponding position across the human 18S rRNA. The dashed line indicates the background eGFP expression. The identified active regions on the 18S rRNA are shaded in green. FIG. 3C provides an illustration of the secondary structure of human 18S rRNA showing the identified active regions and reported RNA contact regions on the 18S rRNA. The identified active regions 1 to 6 are shaded in green. Boxes outlined the regions on the 18S rRNA that have been reported to contact with mRNA (red) or IRES RNA (orange). FIG. 3D shows quantification of the number of the 18S rRNA active 7-mers or the random 7-mers harbored by eGFP(+) or eGFP(−) oligos plotted on a Tukey box-plot (outliers not shown). Ns: not significant; ****: p-value <0.001 by an unpaired two-sample t-test. Shown in FIG. 3E is quantification of the IRES activity for the oligo with higher or lower 18S rRNA complementarity determined by FACS (MFIeGFP/mRuby). *: p-value <0.05 relative to the wild-type (WT) oligo by an unpaired two-sample t-test (n=4-6 independent replicates). Error bar: SEM. FIG. 3F provides a schematic of the design of synthetic oligos for systematic scanning mutagenesis. FIG. 3G shows the eGFP expression of each oligo containing the random substitution mutation at the corresponding position on the HCV IRES. The black dot represents the start position of each mutation on the IRES. The identified essential elements are shaded in blue. The red lines represented the functional domains on the HCV IRES that have been reported. The eGFP expression for each oligo was normalized to the mean eGFP expression of all the oligos on the HCV IRES. In FIG. 3H, examples are provided of circRNA IRES with local and global sensitivity identified by scanning mutagenesis. The identified essential elements on the IRES are shaded in blue. In FIG. 3I, the mean eGFP expression of all the circRNA IRES oligos with global sensitivity is shown at each mutation position across the IRES. The regions harboring regulatory elements were shaded in different colors (blue: 5-15 nt and 135-165 nt; red: 40-60 nt). Shown in FIG. 3J is quantification of the local MFE in a 15 nucleotide (nt) sliding window on the IRES. The regions harboring regulatory elements were shaded in different colors (blue: 5-15 nt and 135-165 nt; red: 40-60 nt).

FIG. 4A-4K shows that a distinct SuRE at 40-60 nucleotide (nt) position on the IRES can facilitate circular IRES activity. FIG. 4A-4H show the secondary structure of the mutated IRESs (SEQ ID NOs: 33925-33932) determined by M2-seq. The arrowheads indicate the high-confidence secondary structure identified by M2-net; the corresponding positions are labeled with the same color on the RNA structure panel. Red arrowheads indicate the SuRE at the 40-60 nt position on the circular IRES. CircIRES-dis: circular IRES with the SuRE disrupted by sequence substitution. CircIRES-relocate: Circular IRES with the SuRE relocated to 90-110 nt region. CircIRES-single and circIRES-comp: circular IRES with single complementary mutations and compensatory double complementary mutations, respectively. circIRES-BoxB: circular IRES with the SuRE substituted by BoxB stem-loop. linearIRES-add: linear IRES with 40-60 nt region substituted by the SuRE at the 40-60 nt position on the circular IRES. Shown in FIG. 4I is quantification of the IRES activity for each mutated IRES determined by FACS (MFIeGFP/mRuby). The activity of each permuted IRES was normalized to the linear IRES. Ns: not significant; : p-value <0.01, **: p-value <0.001 relative to the linear IRES by an unpaired two-sample t-test (n=4-6 independent replicates). Error bar: SEM. Shown in FIG. 4J is quantification of the percentage of the eGFP(+) oligos (left) and endogenous translated circRNAs (right) harboring 18S rRNA complementarity or the SuRE element. FIG. 4K provides an illustration of two key regulatory elements, complementary 18S rRNA sequence and the SuRE at 40-60 nt position on the IRES, facilitating circRNA cap-independent translation.

FIG. 5A shows a schematic of disrupting the key regulatory elements on the IRES of the oligo-split-eGFP-circRNA reporter by co-transfecting the anti-sense LNAs targeting specific regions on the IRES. LNA-18S: the LNA targeting the 18S rRNA complementary sequence on the IRES; LNA-SuRE: the LNA targeting the SuRE at the 40-60 nt position on the IRES; LNA-Rnd: the LNA targeting the random position downstream of LNA-18S or LNA-SuRE on the IRES. Shown in FIG. 5B is quantification of the normalized eGFP fluorescence signal intensity of the cells co-transfected with the corresponding LNA and the oligo-split-eGFP-circRNA reporter carrying the corresponding IRES. The number represents the index number of the oligo. Ns: not significant; *: p-value <0.05; : p-value <0.01, *: p-value <0.005 relative to the mock transfection by an unpaired two-sample t-test (n=3-5 independent replicates). Error bar: SEM. Provided in FIG. 5C is a schematic of QTI-qRT-PCR quantification of the level of translation-initiating endogenous circRNAs. FIG. 5D shows quantification of the translation-initiating RNA level of the human endogenous circRNAs containing the corresponding IRES upon disrupting the IRES by the corresponding LNA transfection. The circRNA level was normalized to the GAPDH mRNA. Ns: not significant; *: p-value <0.05; : p-value <0.01, *: p-value <0.005 relative to the mock transfection by an unpaired two-sample t-test (n=4-6 independent replicates). Error bar: SEM. Shown in FIG. 5E are images of western blots showing the level of protein produced from the endogenous circRNAs upon IRES disruption by the transfection of the corresponding LNA.

FIG. 6A shows quantification of the percentage of IRES-mapped human endogenous circRNAs harboring one or more eGFP(+) oligo sequences (IRES(+) circRNA), or no eGFP(+) oligo sequences (IRES(−) circRNA). FIG. 6B shows quantification of the distribution of the parent genes among IRES(+) circRNAs. Each part of the pie chart represents a different gene. FIG. 6C shows quantification of the percentage of potential cancer-associated IRES(+) circRNAs from the CSCD. Provided in FIG. 6D is a histogram showing the distribution of the number of IRES harbored by each individual IRES(+) circRNA (capped at n=20). FIG. 6E is a histogram showing the distribution of the number of mapped circRNA for each individual eGFP(+) oligo (capped at n=20). FIG. 6F shows the top 12 represented biological processes from GO term analysis that are enriched in the parent genes of IRES(+) circRNAs. Provided in FIG. 6G is a schematic of generating the putative endogenous circORF list. FIG. 6H shows the top 15 represented conserved motifs from Pfam analysis that are enriched in the predicted circRNA-encoded polypeptides. FIG. 6I shows a schematic of peptidomic validation of the putative circORFs. Provided in FIG. 6J is a heat map showing the number of unique tryptic polypeptides detected in the peptidomic dataset of each MS captured circORF. Shown in FIG. 6K are the MS1 and MS2 spectra of a representative tryptic BSJ polypeptide (SEQ ID NO: 33933) captured from circORF_575. FIG. 6L shows the representative MS2 spectra and the top 3 rank PRM-MS transition ions spectra of the spike-in heavy isotope labeled polypeptide (top right (SEQ ID NO: 33934)) and the sample tryptic polypeptide (bottom right (SEQ ID NO: 33934)) from circORF_19. [V]: heavy isotope labeled valine (13C5, 15N; +6 Da).

FIG. 7A-7L show that circRNA-encoded circFGFR1p suppresses cell proliferation under stress conditions. FIG. 7A provides is a schematic of the CDS of FGFR1 and circFGFR1 transcript. Shown in FIG. 7B is a schematic of the design of junctional RT-PCR primers (black arrows) and the Sanger sequencing results detecting the back-splicing junction (yellow box) of circFGFR1 (SEQ ID NO: 33935). FIG. 7C provides is a schematic of the conserved motifs on FGFR1 and circFGFR1p. Ab (both): the antibody which can detect both FGFR1 and circFGFR1p. Ab-circFGFR1p: custom circFGFR1p antibody. The blue lines indicate the location of the antigen peptide for each antibody. FIG. 7D shows a schematic of the polypeptides captured by IP-LC-MS.MS (underline) that matched the circFGFR1p unique region (red) and the region overlapped with FGFR1 (black) using a custom antibody against the unique region of the circFGFR1p (in bold) (circFGFR1p (SEQ ID NO: 33902); circFGFR1p fragment (SEQ ID NO: 33936)). The extracted region (~30-45 kDa) on the coomassie blue stained SDS-PAGE gel is outlined in red box. Shown in FIG. 7E are the representative MS2 spectra and the top 3 rank PRM-MS transition ions spectra of the spike-in heavy isotope labeled polypeptide (top (SEQ ID NO: 33937)) and the BJ tryptic polypeptide (bottom (SEQ ID NO: 33937)) of circFGFR1p. [L]: heavy isotope labeled leucine (13C6, 15N; +7 Da). FIG. 7F provides are images of FGFR1(red), circFGFR1p (green) and DAPI (blue) in HEK-293T cells co-transfected with plasmids expressing HA-FGFR1 and FLAG-circFGFR1p without permeabilization. Scale bars: 10 micrometers. Shown in FIG. 7G are western blots showing circFGFR1p and FGFR1 protein level (Ab-both), and the quantification of FGFR1 and circFGFR1 RNA level by qRT-PCR of cells transfected with siRNA or LNA. siCtrl: non-targeting siR-NAs; siCircFGFR1: circFGFR1 specific siRNAs; circFGFR1-LNA: anti-sense LNA oligo targeting the 18S rRNA complementary sequence on the circFGFR1 IRES. P-FGFR1: phosphorylated FGFR1. Ns: not significant; ** p-value <0.01 relative to the siCtrl by an unpaired two-sample t-test (n=3 independent replicates). Error bar: SEM. (FIG. 7H) Shown is quantification of cell proliferation in cells with the knockdown of circFGFR1 RNA (si-CircFGFR1) or circFGFR1p (circFGFR1-LNA) from day 1 to 4 with FGF1 addition. * p-value <0.05;  p-value <0.01; * p-value <0.005 relative to the siCtrl by an unpaired two-sample t-test (n=3-5 independent replicates). Error bar: SEM. Provided in FIG. 7I are images of a western blot showing the cells with FGFR1, circFGFR1p, or FGFR1+ circFGFR1p overexpression (left panel) and their corresponding cell proliferation from day 1 to 4 with FGF1 addition (right panel). Ns: not significant; * p-value <0.05,  p-value <0.01, ** p-value <0.001 relative to the mock transfection by an unpaired two-sample t-test (n=4-6 independent replicates). Error bar: SEM.

FIG. 7J provides images of western blots showing FGFR1 protein and circFGFR1p level with or without the heat-shock. FIG. 7K shows quantification of the Western blot of circFGFR1p protein level relative to FGFR1 (all isoforms) under normal (WT) and the heat-shock (HS) condition. Error bar: SEM from three independent blots. * p-value <0.05 relative to the WT by an unpaired two-sample t-test (n=3 independent blots). Shown in FIG. 7L is quantification of the Western blot showing the change of the protein level of FGFR1 and circFGFR1p under the heat-shock condition. Protein level is normalized to the GAPDH protein loading control of each condition. Error bar: SEM from three independent blots. Ns: not significant; * p-value <0.05 relative to 1 by a one-sample t-test (n=3 independent blots).

FIG. 8A-8C show that the oligo-split-eGFP-circRNA reporter construct does not generate eGFP signal from trans-splicing. FIG. 8A shows images of northern blots of IRES-split-eGFP circRNA reporter transfected and mRuby (+)/eGFP(+) sorted cells using probes against the mRuby, 3'eGFP, and the eGFP back-splicing junction region on the reporter transcript with or without RNase R treatment. Shown in FIG. 8B is quantification of the RNA level of the eGFP circRNA or the mRuby linear transcript in the IRES-split-eGFP circRNA reporter transfected and mRuby(+)/ eGFP(+) sorted cell total RNA with RNase R treatment relative to the RNaseR (−) samples. The level of RNA was normalized to the GAPDH mRNA level in each sample. Error bar: SEM. Ns: not significant; ****: p-value <0.001 relative to the RNase R(−) sample by an unpaired two-sample t-test (n=3 independent replicates). Error bar: SEM. FIG. 8C illustrates flow cytometry analysis of eGFP(+) cells upon transfected with corresponding reporter constructs. eGFP(+) cells were gated according to the cells with mock transfection.

FIG. 9A provides a reproducibility measurement of the eGFP expression for each captured oligo of two independent biological replicates from the screening assay. Only the oligos recovered in both replicates were included in the analysis. The R represents the Pearson's correlation coefficient. Provided in FIG. 9B is a schematic of the primers design to quantify the expression level of linear and circular transcripts of the reporter construct. The divergent circular primers spanning the back-splicing junction of circRNA should detect circular transcripts only. FIG. 9C shows quantification of circularization efficiency by qRT-PCR of seven randomly picked clones transfected oligo-split-eGFP reporter plasmid. The circularization efficiency was calculated by normalizing the expression level of the circular transcripts to the expression level of the linear transcripts. The number indicates the index of the oligo. No-IRES: no-IRES-inserted reporter plasmid. Ns: not significant relative to the empty circRNA by an unpaired two-sample t-test (n=3 independent replicates). Error bar: SEM. FIG. 9D illustrates the distribution of the fraction of reads across all 7 bins of cells transfected with IRES-split-eGFP circRNA reporter carrying no-IRES (background eGFP expression), or the oligo showing high (oligo #25674), moderate (oligo #26338) or no (oligo #26961) cap-independent translation activity. The black line represents the polynomial trend line of the distribution. FIG. 9E provides images of western blots showing the expression level of eGFP, Cre, and CD4 from the split-eGFP circRNA reporter containing no-IRES or the corresponding IRES. The number indicates the index of the oligo. Provided in FIG. 9F are images of a western blot showing eGFP expression level of the cap-dependent translated linear RNA (CMV promoter driven) and the cap-independent translated circRNA (IRES driven; oligo #8788).

FIG. 11A-11D show the IRES composition among the captured linear and circular IRES. FIG. 11A provides a Venn diagram representing the number of circular and linear specific IRES by comparing the results from the study (circular RNA system) with the results from the study described in Weingarten-Gabbay et al., Science 351, aad4939 (2016) (linear RNA system). Shown in FIG. 11B-11C is the composition of the captured viral and human IRES in the circular IRES (FIG. 11B), the linear IRES (FIG. 11C), and the IRES showing cap-independent translation activity in both the linear and circular RNA system (Both) (FIG. 11D).

FIG. 12A shows 40S and (poly)ribosome fractions of cells transfected with split-eGFP reporter containing the synthetic oligo library and treated with puromycin (PMY; left panel) or cycloheximide (CHX; right panel) followed by sucrose gradient fractionation. FIG. 12B shows quantification of the ratio of the eGFP circRNA level relative to the mRuby linear transcript level of the IRES-split-eGFP circRNA reporter transfected and mRuby(+)/eGFP(+) sorted cell total RNA with RNase R treatment in a time-course manner (20 U RNase R per 20 μg of RNA). Error bar: SEM. Shown in FIG. 12C is quantification of the fraction of the number of total reads of the captured oligos in 40S and (poly)ribosome fraction with PMY or CHX treatment. FIG. 12D provides the number of captured eGFP(−) and eGFP(+) oligos before and after the RNase R treatment. FIG. 12E shows the normalized number of reads of total captured oligos with RNase R treatment and captured oligos in the poly(ribosome) fraction.

FIG. 13C shows the percentage of the number of active 7-mers on each position on the oligo among all eGFP(+) oligos. FIG. 13D shows the cumulative frequency distribution of number of the RRACH motif on the eGFP(+) and eGFP(−) oligos. Ns: not significant by Kolmogorov-Smirnov cumulative distribution test.

FIG. 14B shows cumulative frequency distribution of number of canonical translation start codon (ATG) on the circular and linear IRESs. Ns: not significant by Kolmogorov-Smirnov cumulative distribution test. Shown in FIG. 14C is cumulative frequency distribution of number of m6A motif (RRACH, SEQ ID NO: 3394) on the circular and linear IRESs. Ns: not significant by Kolmogorov-Smirnov cumulative distribution test. Shown in FIG. 14D is quantification of number of Kozak sequence (ACCATGG, SEQ ID NO: 33945) on the circular and linear IRESs. Ns: not significant by an unpaired two sample t-test. Error bar: SEM. FIG. 14E shows quantification of the IRES activity of the oligo in the circular RNA reporter (left) and linear RNA reporter (right), respectively. The IRES activity was determined with FACS by normalizing the eGFP medium fluorescence intensity driven by the oligo (MFIeGFP) to the linear RNA expression level of the reporter construct determined by the mRuby medium fluorescence intensity (MFImRuby). The value was further normalized to the oligo-6472. Ns: not significant, *: p-value <0.05, ***: p-value <0.005, * ***: p-value <0.001 relative to oligo-6742 by an unpaired two-sample t-test (n=4-6 independent replicates). Error bar: SEM. FIG. 14F-14G show the secondary structure of example circular IRESs (SEQ ID NOs: 33938-33940) and linear IRESs (SEQ ID NOs: 33941-33943) (three IRESs for each) determined by M2-seq. The arrowheads indicate the high confident secondary structure identified by M2-net; the corresponding positions are labeled with the same color on the RNA structure panel. Red arrowheads indicate the SuRE at the 40-60 nt position on the circular IRESs.

FIG. 15A shows quantification of the eGFP circRNA level relative to the mRuby linear transcript level of the cells co-transfected with the corresponding LNA and the oligo-split-eGFP-circRNA reporter carrying the corresponding IRES. Ns: not significant; *: p-value <0.05 relative to the mock transfection by an unpaired two-sample t-test (n=4-6 independent replicates). Error bar: SEM. Shown in FIG. 15B is quantification of the human endogenous circRNA level harboring the corresponding IRES upon disrupting the IRES by the corresponding LNA transfection. The circRNA level was normalized to the GAPDH mRNA. Ns: not significant relative to the mock transfection by an unpaired two-sample t-test (n=4-6 independent replicates). Error bar: SEM.

FIG. 16A-16L show identification of putative endogenous circRNA-encoded polypeptides. FIG. 16A shows quantification of the percentage of all endogenous human circRNAs harboring no oligo sequences, no eGFP(+) oligo sequences, or one or more eGFP(+) oligo sequences. Provided in FIG. 16B is a histogram showing the distribution of the number of IRESs harbored by each individual IRES(+) circRNA (capped at n=20) among the circRNAs generated from the 159 transcripts for which oligos were designed tiling across the entire transcripts. Provided in FIG. 16C is a histogram showing the distribution of the number of mapped circRNAs for each individual eGFP(+) oligo (capped at n=20) among the circRNAs generated from the 159 transcripts for which oligos were designed tiling across the entire transcripts. Shown in FIG. 16D is the distribution of the distance from the back-splicing junction to the mapped IRES on each circRNA (capped at nt=2000). The distance is calculated from the back-splicing junction to the first mapped nucleotide of the IRES. GC matched oligo: the RNA sequence on the circRNA with the same length and GC-content as the mapped IRES. The distance of GC matched oligo was determined on each IRES-mapped circRNA by taking the average distance from the back-splicing junction to all the GC matched oligos on the circRNA. FIG. 16E illustrates quantification of the percentage of circRNA-encoded polypeptide with the ORF overlapping the IRES region on the circRNA. Shown in FIG. 16F is quantification of the percentage of circRNA-encoded polypeptide with infinite recursive ORF on circRNA among IRES-overlapping ORFs. FIG. 16G shows an image of a Western blot showing infinite recursive eGFP translation of cells transfected with the split-eGFP circRNA reporter containing an in-frame IRES (oligo-2007). FIG. 16H provides a histogram showing the size distribution of predicted circRNA-encoded polypeptides. Shown in FIG. 16I is quantification of the percentage of circORFs with matched sORFs using the mapped IRES ORF analysis method or traditional ORF analysis method. Shown in FIG. 16J is quantification of the percentage of the circRNAs identified by peptidomics that contain at least one RFP fragment uniquely overlapping with the back-splicing junction. Shown in FIG. 16K is the percentage of the coverage of MS-20 identified polypeptides on each protein with different expression level in human iPSCs. The MS profiling data was obtained and mapped as described in Chen et al. (2020). FIG. 16L shows is the MS-identified polypeptide coverage on a lowly expressed EGFR protein in human iPSCs. The red boxes represent the mapped position of the MS-identified polypeptides on the protein.

FIG. 17A shows the H3K4me3 level obtained from ENCODE on the genomic region of FGFR1 and circFGFR1 showing no enrichment of the promoter signature near circFGFR1 IRES. FIG. 17B provides are images of FGFR1(red), circFGFR1p (green) and DAPI (blue) in HEK-293T cells co-transfected with plasmids expressing FGFR1 and FLAG-circFGFR1p with permeabilization. Scale bars: 10 micrometers. Shown in FIG. 17C is quantification of the expression level of circFGFR1 in tumor samples and normal adjacent samples plotted as Tukey box-plot (outliers not shown). The data was extracted from the TCGA analysis without filtering (Nair et al., Oncotarget 7, 80967, (2016)). ERBC: estrogen receptor positive breast cancer; TNBC: triple-negative breast cancer. Shown in FIG. 17D is quantification of the expression level of circFGFR1 in non-transformed cell lines and cancer cell lines plotted as Tukey box-plot. The data was extracted from the CSCD database (Xia et al., 2018). FIG. 17E shows quantification of circFGFR1 IRES activity with or without heat-shock. Ns: not significant relative to the normal condition (WT) by an unpaired two-sample t-test (n=3 independent replicates). Error bar: SEM. Shown in FIG. 17F is quantification of the relative circularization efficiency of circFGFR1 RNA under normal or the heat-shock (HS) condition with qRT-PCR by normalizing the circFGFR1 RNA level to the linear FGFR1 RNA level using linear and circular RNA specific primers respectively. Ns: not significant relative to the normal condition by an unpaired two-sample t-test (n=3 independent replicates). Shown in FIG. 17G is quantification of the circFGFR1 RNA level by qRT-PCR with or without heat-shock (normalized to GAPDH mRNA level). Ns: not significant relative to the normal condition by an unpaired two-sample t-test (n=3 independent replicates). Provided in FIG. 17H is a schematic showing that, under normal conditions, upon FGF addition, FGFR1 undergoes dimerization and autophosphorylation, activating the downstream cell signaling pathway and facilitating cell proliferation. FIG. 17I provides is a schematic showing that, under stress conditions, the translation of FGFR1 RNA is downregulated, resulting in low FGFR1 protein level, where the cap-independent translation activity of circFGFR1 IRES remains steady. Upon FGF addition, circFGFR1p dimerizes with FGFR1. However, since circFGFR1p lacks the autophosphorylation domain, the circFGFR1p-FGFR1 dimer cannot activate the downstream cell signaling pathway, resulting in the suppression of cell proliferation.

FIG. 18A shows MFEs for all viral IRES positive oligos in DNA format and all human IRES positive oligos in DNA format. Provided in FIG. 18B is a histogram showing eGFP expression levels driven by representative viral IRESs from DNA-based IRES screen.

DETAILED DESCRIPTION OF THE INVENTION

Figure 1A:
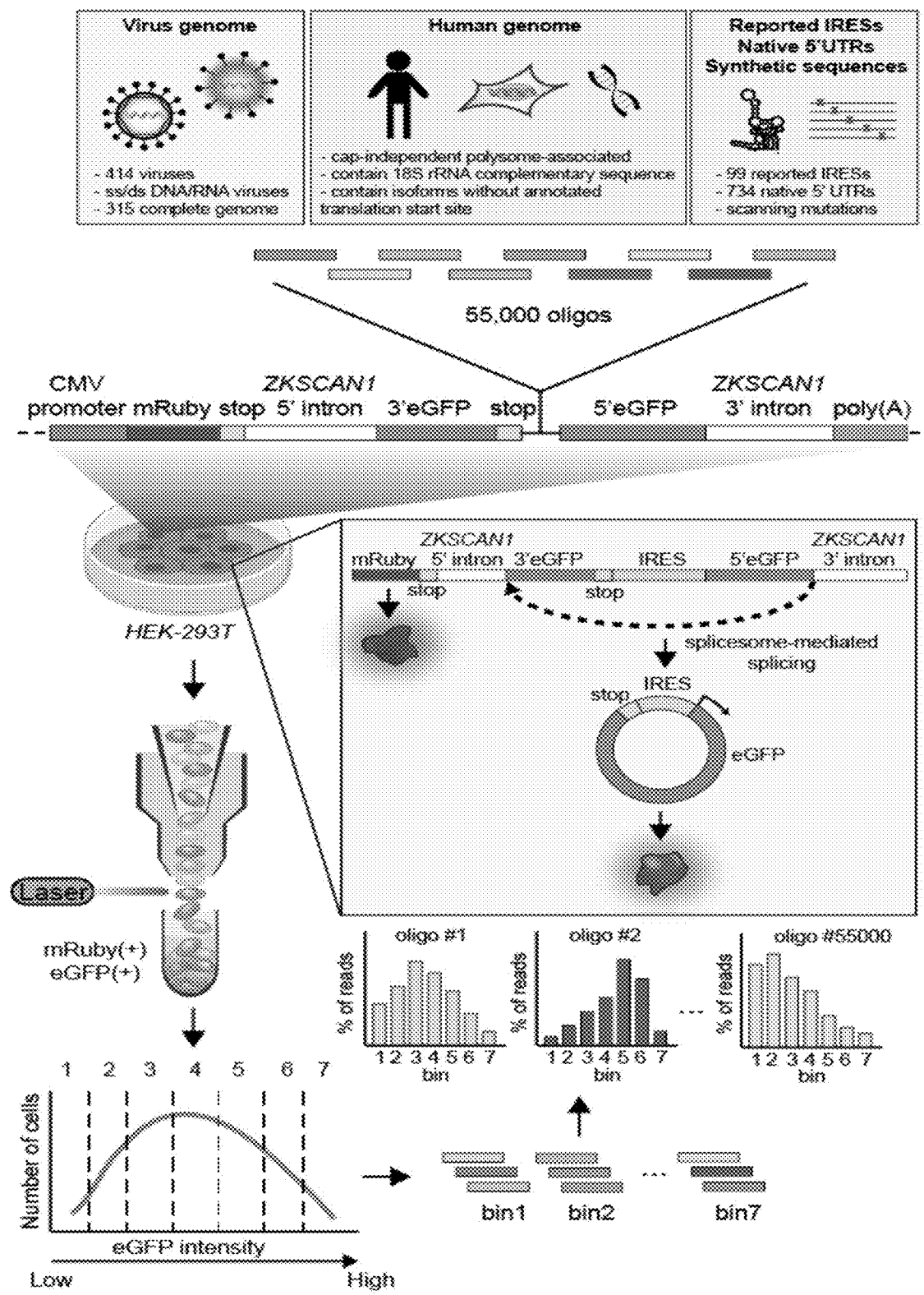
FIG. 1A-1D show high-throughput identification of RNA sequences that can facilitate cap-independent translation activity on circRNA.

The present disclosure is predicated, at least in part, on the development of a high-throughput reporter assay that can systematically screen and quantify the IRES activity of RNA sequences that can facilitate circRNA translation. This assay can identify elements in the primary and secondary structure of a circRNA IRES that are important for facilitating circRNA translation. This assay also enables the identification of potential endogenous protein-coding circRNAs, further expanding the currently-understood proteome. For example, the disclosure demonstrates the identification of a circRNA-encoded protein, circFGFR1p, that functions as a negative regulator of FGFR1 through a dominant negative mechanism to suppress cell growth under stress conditions. The embodiments described herein provide a resource to recognize and manipulate circRNA translation and reveal a new scope of the endogenous circRNA proteome, which provides insights into circRNA-associated diseases and the development of new therapeutic methods targeting circRNA-encoded proteins.

The disclosure is further based on the discovery that circFGFR1p is an endogenous circRNA-encoded protein that is a negative regulator of FGFR1 signaling and suppresses cell growth under stress conditions. While cells decrease global translation under stress conditions, many IRES can drive higher cap-independent translation activity under stress conditions, including the IRES of circZNF-609. Embodiments described herein highlight an important regulatory mechanism for how cells utilize different translation machinery to respond to stress conditions, and illustrate how circRNAs may be used to maintain protein translation under such conditions. While cells predominantly utilize cap-dependent linear mRNA translation to produce proteins, they can shift the RNA source of translation toward circRNA by upregulating the cap-independent translation activity of circRNA IRES under stress conditions. The depletion of circFGFR1 in human cancers may occur to down-regulate circFGFR1p and increase the proliferative signaling through FGF signaling. circRNA-encoded proteins may be useful for expressing individual subunits or "modules" of multi-domain proteins, allowing cells the ability to independently control translation thereof. The disclosure provides a new model of how circRNA translation is regulated by a mechanism which differs from linear mRNA translation and how cells utilize circRNA-encoded proteins to respond to a dynamic environment. The disclosure also provides recombinant circular RNAs comprising a protein-coding nucleic acid sequence and an IRES operably linked to the protein-coding nucleic acid sequence, which can be used to express one or more proteins of interest in a cell.

Definitions

To facilitate an understanding of the present technology, a number of terms and phrases are defined below. Additional definitions are set forth throughout the detailed description.

The use of the terms "a" and "an" and "the" and "at least one" and similar referents in the context of describing the invention (especially in the context of the following claims) are to be construed to cover both the singular and the plural, unless otherwise indicated herein or clearly contradicted by context. The use of the term "at least one" followed by a list of one or more items (for example, "at least one of A and B") is to be construed to mean one item selected from the listed items (A or B) or any combination of two or more of the listed items (A and B), unless otherwise indicated herein or clearly contradicted by context. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

The terms "nucleic acid sequence," "polynucleotide," and "oligonucleotide" are used interchangeably herein and refer to a polymer or oligomer of pyrimidine and/or purine bases, such as cytosine, thymine, and uracil, and adenine and guanine, respectively (See Albert L. Lehninger, *Principles of Biochemistry*, at 793-800 (Worth Pub. 1982)). The terms encompass any deoxyribonucleotide, ribonucleotide, or peptide nucleic acid component, and any chemical variants thereof, such as methylated, hydroxymethylated, or glycosylated forms of these bases. The polymers or oligomers may be heterogenous or homogenous in composition, may be isolated from naturally occurring sources, or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states. A nucleic acid or nucleic acid sequence may comprise other kinds of nucleic acid structures such as, for instance, a DNA/RNA helix, peptide nucleic acid (PNA), morpholino nucleic acid (see, e.g., Braasch and Corey, *Biochemistry*, 41(14): 4503-4510 (2002) and U.S. Pat. No. 5,034,506), locked nucleic acid (LNA; see Wahlestedt et al., *Proc. Natl. Acad. Sci. U.S.A.*, 97: 5633-5638 (2000)), cyclohexenyl nucleic acids (see Wang, *J. Am. Chem. Soc.*, 122: 8595-8602 (2000)), and/or a ribozyme. The terms "nucleic acid" and "nucleic acid sequence" may also encompass a chain comprising non-natural nucleotides, modified nucleotides, and/or non-nucleotide building blocks that can exhibit the same function as natural nucleotides (e.g., "nucleotide analogs"). The term "DNA sequence" is used herein to refer to a nucleic acid comprising a series of DNA bases.

The terms "polypeptide," and "protein" are used interchangeably herein, and refer to a polymeric form of amino acids comprising at least two or more contiguous amino acids chemically or biochemically modified or derivatized amino acids, and polypeptides having modified peptide backbones. The term "peptide" as used herein refers to a class of short polypeptides. The term peptide may refer to a polymer of amino acids (natural or non-naturally occurring) having a length of up to about 100 amino acids. For example, peptides may have a length of about 1 to about 10, about 10 to about 25, about 25 to about 50, about 50 to about 75, about 75 to about 100 amino acids. In some embodiments, the peptides are 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 amino acids in length.

Nomenclature for nucleotides, nucleic acids, nucleosides, and amino acids used herein is consistent with International Union of Pure and Applied Chemistry (IUPAC) standards (see, e.g., bioinformatics.org/sms/iupac.html).

When referring to a nucleic acid sequence or protein sequence, the term "identity" is used to denote similarity between two sequences. Sequence similarity or identity may be determined using standard techniques known in the art, including, but not limited to, the local sequence identity algorithm of Smith & Waterman, Adv. Appl. Math. 2, 482 (1981), by the sequence identity alignment algorithm of Needleman & Wunsch, J Mol. Biol. 48,443 (1970), by the search for similarity method of Pearson & Lipman, Proc. Natl. Acad. Sci. USA 85, 2444 (1988), by computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., Nucl. Acid Res. 12, 387-395 (1984), or by inspection. Another algorithm is the BLAST algorithm, described in Altschul et al., J Mol. Biol. 215, 403-410, (1990) and Karlin et al., Proc. Natl. Acad. Sci. USA 90, 5873-5787 (1993). A particularly useful BLAST program is the WU-BLAST-2 program which was obtained from Altschul et al., Methods in Enzymology, 266, 460-480 (1996); blast.wustl/edu/blast/README.html. WU-BLAST-2 uses several search parameters, which are optionally set to the default values. The parameters are dynamic values and are established by the program itself depending upon the composition of the particular sequence and composition of the particular database against which the sequence of interest is being searched; however, the values may be adjusted to increase sensitivity. Further, an additional useful algorithm is gapped BLAST as reported by Altschul et al, (1997) Nucleic Acids Res. 25, 3389-3402. Unless otherwise indicated, percent identity is determined herein using the algorithm available at the internet address: blast.ncbi.nlm.nih-.gov/Blast.cgi.

The terms "internal ribosome entry site," "internal ribosome entry sequence," "IRES" and "IRES sequence region" are used interchangeably herein and refer to cis elements of viral or human cellular RNAs (e.g., messenger RNA (mRNA) and/or circRNAs) that bypass the steps of canonical eukaryotic cap-dependent translation initiation. The canonical cap-dependent mechanism used by the vast majority of eukaryotic mRNAs requires an $m^7G$ cap at the 5' end of the mRNA, initiator Met-tRNAmet, more than a dozen initiation factor proteins, directional scanning, and GTP hydrolysis to place a translationally competent ribosome at the start codon. IRESs typically are comprised of a long and highly structured 5'-UTR which mediates the translation initiation complex binding and catalyzes the formation of a functional ribosome.

The terms "coding sequence," "coding sequence region," "coding region," and "CDS" when referring to nucleic acid sequences may be used interchangeably herein to refer to the portion of a DNA or RNA sequence, for example, that is or may be translated to protein. The terms "reading frame," "open reading frame," and "ORF," may be used interchangeably herein to refer to a nucleotide sequence that begins with an initiation codon (e.g., ATG) and, in some embodiments, ends with a termination codon (e.g., TAA, TAG, or TGA). Open reading frames may contain introns and exons, and as such, all CDSs are ORFs, but not all ORF are CDSs.

The terms "complementary" and "complementarity" refers to the relationship between two nucleic acid sequences or nucleic acid monomers having the capacity to form hydrogen bond(s) with one another by either traditional Watson-Crick base-paring or other non-traditional types of pairing. The degree of complementarity between two nucleic acid sequences can be indicated by the percentage of nucleotides in a nucleic acid sequence which can form hydrogen bonds (e.g., Watson-Crick base pairing) with a second nucleic acid sequence (e.g., about 50%, about 60%, about 70%, about 80%, about 90%, and 100% complementary). Two nucleic acid sequences are "perfectly complementary" if all the contiguous nucleotides of a nucleic acid sequence will hydrogen bond with the same number of contiguous nucleotides in a second nucleic acid sequence. Two nucleic acid sequences are "substantially complementary" if the degree of complementarity between the two nucleic acid sequences is at least 60% (e.g., at least 65%, at least 70%, at least 75%, at least 80%, at least 85%, at least 90%, at least 95%, at least 97%, at least 98%, at least 99%, or 100%) over a region of at least 8 nucleotides (e.g., at least 9, at least 10, at least 11, at least 12, at least 13, at least 14, at least 15, at least 16, at least 17, at least 18, at least 19, at least 20, at least 21, at least 22, at least 23, at least 24, at least 25, at least 30, at least 35, at least 40, at least 45, at least 50, or more nucleotides), or if the two nucleic acid sequences hybridize under at least moderate, or, in some embodiments high, stringency conditions. Exemplary moderate stringency conditions include overnight incubation at 37° C. in a solution comprising 20% formamide, 5×SSC (150 mM NaCl, 15 mM trisodium citrate), 50 mM sodium phosphate (pH 7.6), 5×Denhardt's solution, 10% dextran sulfate, and 20 mg/ml denatured sheared salmon sperm DNA, followed by washing the filters in 1×SSC at about 37-50° C., or substantially similar conditions, e.g., the moderately stringent conditions described in Sambrook, J., *Molecular Cloning: A Laboratory Manual*, Cold Spring Harbor Laboratory Press; 4th edition (Jun. 15, 2012). High stringency conditions are conditions that use, for example (1) low ionic strength and high temperature for washing, such as 0.015 M sodium chloride/0.0015 M sodium citrate/0.1% sodium dodecyl sulfate (SDS) at 50° C., (2) employ a denaturing agent during hybridization, such as formamide, for example, 50% (v/v) formamide with 0.1% bovine serum albumin (BSA)/0.1% Ficoll/0.1% polyvinylpyrrolidone (PVP)/50 mM sodium phosphate buffer at pH 6.5 with 750 mM sodium chloride and 75 mM sodium citrate at 42° C., or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at (i) 42° C. in 0.2×SSC, (ii) 55° C. in 50% formamide, and (iii) 55° C. in 0.1×SSC (optionally in combination with EDTA). Additional details and an explanation of stringency of hybridization reactions are provided in, e.g., Sambrook, supra; and Ausubel et al., eds., *Short Protocols in Molecular Biology*, 5th ed., John Wiley & Sons, Inc., Hoboken, N.J. (2002). The term "hybridization" or "hybridized" when referring to nucleic acid sequences is the association formed between and/or among sequences having complementarity.

The term "secondary structure," or "secondary structure element" or "secondary structure sequence region" as used herein in reference to nucleic acid sequences (e.g., RNA, DNA, etc), refers to any non-linear conformation of nucleotide or ribonucleotide units. Such non-linear conformations may include base-pairing interactions within a single nucleic acid polymer or between two polymers. Single-stranded RNA typically forms complex and intricate base-pairing interactions due to its increased ability to form hydrogen bonds stemming from the extra hydroxyl group in the ribose sugar. Examples of secondary structures or secondary structure elements include but are not limited to, for example, stem-loops, hairpin structures, bulges, internal loops, multiloops, coils, random coils, helices, partial helices and pseudoknots. In some embodiments, the term "secondary structure" may refer to a SuRE element. The term "SuRE" stands for stem-loop structured RNA element (SuRE).

The term "free energy," as used herein, refers to the energy released by folding an unfolded polynucleotide (e.g., RNA or DNA, etc.) molecule, or, conversely, the amount of energy that must be added in order to unfold a folded polynucleotide (e.g., RNA or DNA, etc.) The "minimum free energy (MFE)" of a polynucleotide (e.g., DNA, RNA, etc.) describes the lowest value of free energy observed for the polynucleotide when assessed for various secondary structures thereof. The MFE of an RNA molecule may be used to predict RNA or DNA secondary structure and is affected by the number, composition, and arrangement of the RNA or RNA nucleotides. The more negative free energy a structure has, the more likely is its formation since more stored energy is released by formation of the structure.

The term "melting temperature (Tm)" refers to the temperature at which about 50% of double-stranded nucleic acid structures (e.g., DNA/DNA, DNA/RNA, or RNA/RNA duplexes) denature and dissociate to single-stranded structures.

The term "recombinant," as used herein, means that a particular nucleic acid (DNA or RNA) is the product of various combinations of cloning, restriction, polymerase chain reaction (PCR) and/or ligation steps resulting in a construct having a structural coding or non-coding sequence distinguishable from endogenous nucleic acids found in natural systems. DNA sequences encoding polypeptides can be assembled from cDNA fragments or from a series of synthetic oligonucleotides to provide a synthetic nucleic acid which is capable of being expressed from a recombinant transcriptional unit contained in a cell or in a cell-free transcription and translation system. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions and may act to modulate production of a desired product by various mechanisms. Alternatively, DNA sequences encoding RNA that is not translated may also be considered recombinant. Thus, the term "recombinant" nucleic acid also refers to a nucleic acid which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a codon encoding the same amino acid, a conservative amino acid, or a non-conservative amino acid. Alternatively, the artificial combination may be performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques. When a recombinant polynucleotide encodes a polypeptide, the sequence of the encoded polypeptide can be naturally occurring ("wild type") or can be a variant (e.g., a mutant) of the naturally occurring sequence. Thus, the term "recombinant" polypeptide does not necessarily refer to a polypeptide whose sequence does not naturally occur. Instead, a "recombinant" polypeptide is encoded by a recombinant DNA sequence, but the sequence of the polypeptide can be naturally occurring ("wild type") or non-naturally occurring (e.g., a variant, a mutant, etc.). Thus, a "recombinant" polypeptide is the result of human intervention, but may comprise a naturally occurring amino acid sequence.

The terms "operably linked" and "operatively linked," as used herein, refer to an arrangement of elements that are configured so as to perform, function or be structured in such a manner as to be suitable for an intended purpose. For example, a given promoter operably linked to a coding sequence is capable of effecting the expression of the coding sequence when the proper enzymes are present. Expression is meant to include the transcription of any one or more of a recombinant nucleic acid encoding a circular RNA, or mRNA from a DNA or RNA template and can further include translation of a protein from a recombinant circular RNA comprising an IRES sequence (e.g., a non-native IRES). Thus, for example, intervening untranslated yet transcribed sequences can be present between a promoter sequence and a coding sequence and the promoter sequence can still be considered to be "operably linked" to the coding sequence.

As used herein, the term "nonviral-like particle" may refer any protein-based particle that is not a virus or viral-like particle. For example, in some embodiments, a nonviral-like particle is a protein nanogel or protein spheres that allow encapsulation.

As used herein in reference to a lipid nanoparticle, the term "decorated" refers to a lipid nanoparticle that is coupled to one or more targeting agents (e.g., small molecules, peptides, polypeptides, carbohydrates, etc.) The targeting agent binds to one or more peptides, polypeptides, carbohydrates, cells, etc., and allows for targeting of the lipid nanoparticle specifically thereto.

Circular RNAs

Circular RNAs (circRNAs) are single-stranded RNAs that are joined head to tail and were initially discovered in pathogenic genomes such as hepatitis D virus (HDV) and plant viroids (Kos et al., *Nature,* 323: 558-560 (1986); Sanger et al., *PNAS USA,* 73: 3852-3856 (1976)). circRNAs have been recognized as a pervasive class of noncoding RNAs in eukaryotic cells (Salzman et al., *PLoS One,* 7: e30733, (2012); Memczak et al., *Nature,* 495: 333-338 (2013); Hansen et al., *Nature,* 495: 384-388, (2013)). Typically generated through back splicing, circRNAs have been postulated to function in cell-to-cell information transfer or memory due to their extraordinary stability (Jeck, W. R. & Sharpless, N. E., *Nat Biotech,* 32: 453-461, (2014)).

Although the functions of endogenous circRNAs are not known, their large number and the presence of viral circRNA genomes necessitate a system of circRNA immunity, as evidenced by the recent discoveries of human circRNA modulation of viral resistance through regulation of NF90/NF110 and autoimmunity through PKR regulation. Circular RNAs can act as potent adjuvants to induce specific T and B cell responses. In addition, circRNA can induce both innate and adaptive immune responses and have the ability to inhibit the establishment and growth of tumors.

The instant inventors have previously shown that intron identity dictates circRNA immunity. See., e.g., Chen, Y G, et. al, Mol. Cell (2019) 76(1):96-109.e9; Chen, Y G, et. al, Mol. Cell (2017) 67(2):228-238.e5. Because introns are not part of the final circRNA product, it has been hypothesized that introns may direct the deposition of one or more covalent chemical marks onto circRNA. Among the over 100 known RNA chemical modifications, $m^6A$ is the most abundant modification on linear mRNAs and long noncoding RNAs, present on 0.2% to 0.6% of all adenosines in mammalian polyA-tailed transcripts (Roundtree et al., *Cell,* 169: 1187-1200 (2017)). $m^6A$ has recently been detected on mammalian circRNAs (Zhou et al., *Cell Reports,* 20: 2262-2276 (2017)). Human endogenous circRNAs appear to be marked at birth by one or more covalent $m^6A$ modifications, based on the introns that program their back splicing.

The instant disclosure provides a recombinant circular RNA molecule comprising a protein-coding nucleic acid sequence and a non-native an internal ribosome entry site (IRES) operably linked to the protein-coding nucleic acid sequence, and DNA sequences encoding the same. Recombinant circRNA molecules may be generated or engineered according to several methods. For example, recombinant circRNA molecules may be generated by back-splicing of linear RNAs. For example, in some embodiments, a recombinant circular RNA is produced by back-splicing of a downstream 5' splice site (splice donor) to an upstream 3' splice site (splice acceptor). The splice donor and/or splice acceptor may be found, for example, in a human intron or portion thereof that is typically used for circRNA production at endogenous loci as shown in FIG. 1A. In some embodiments, a recombinant circular RNA is produced by contacting a cell with a DNA plasmid, wherein the DNA plasmid encodes a linear RNA, and the linear RNA is back-spliced to produce a recombinant circular RNA. In some embodiments, the DNA plasmid comprises introns from the mammalian ZKSCAN1 gene.

Circular RNAs can be generated by any non-mammalian splicing method. For example, linear RNAs containing various types of introns, including self-splicing group I introns, self-splicing group II introns, spliceosomal introns, and tRNA introns can be circularized. In particular, group I and group II introns have the advantage that they can be readily used for production of circular RNAs in vitro as well as in vivo because of their ability to undergo self-splicing due to their autocatalytic ribozyme activity.

Alternatively, circular RNAs can be produced in vitro from a linear RNA by chemical or enzymatic ligation of the 5' and 3' ends of the RNA. Chemical ligation can be performed, for example, using cyanogen bromide (BrCN) or ethyl-3-(3'-dimethylaminopropyl) carbodiimide (EDC) for activation of a nucleotide phosphomonoester group to allow phosphodiester bond formation (Sokolova, *FEBS Lett,* 232: 153-155 (1988); Dolinnaya et al., *Nucleic Acids Res.,* 19: 3067-3072 (1991); Fedorova, *Nucleosides Nucleotides Nucleic Acids,* 15: 1137-1147 (1996)). Alternatively, enzymatic ligation can be used to circularize RNA. Exemplary ligases that can be used include T4 DNA ligase (T4 Dnl), T4 RNA ligase 1 (T4 Rnl 1), and T4 RNA ligase 2 (T4 Rnl 2).

In other embodiments, splint ligation may be used to generate circular RNA. Splint ligation involves the use of an oligonucleotide splint that hybridizes with the two ends of a linear RNA to bring the ends of the linear RNA together for ligation. Hybridization of the splint, which can be either a deoxyribo-oligonucleotide or a ribooligonucleotide, orients the 5'-phosphate and 3'-OH of the RNA ends for ligation. Subsequent ligation can be performed using either chemical or enzymatic techniques, as described above. Enzymatic ligation can be performed, for example, with T4 DNA ligase (DNA splint required), T4 RNA ligase 1 (RNA splint required) or T4 RNA ligase 2 (DNA or RNA splint). Chemical ligation, such as with BrCN or EDC, is more efficient in some cases than enzymatic ligation if the structure of the hybridized splint-RNA complex interferes with enzymatic activity (see, e.g., Dolinnaya et al. *Nucleic Acids Res,* 21(23): 5403-5407 (1993); Petkovic et al., *Nucleic Acids Res,* 43(4): 2454-2465 (2015)).

While circular RNAs generally are more stable than their linear counterparts, primarily due to the absence of free ends necessary for exonuclease-mediated degradation, additional modifications may be made to the recombinant circRNA described herein to further improve stability. Still other kinds of modifications may improve circularization efficiency, purification of circRNA, and/or protein expression from circRNA. For example, the recombinant circRNA may be engineered to include "homology arms" (i.e., 9-19 nucleotides in length placed at the 5' and 3' ends of a precursor RNA with the aim of bringing the 5' and 3' splice sites into proximity of one another), spacer sequences, and/or a phosphorothioate (PS) cap (Wesselhoeft et al., *Nat. Commun.,* 9: 2629 (2018)). The recombinant circRNA also may be engineered to include 2'-O-methyl-, -fluoro- or —O-methoxyethyl conjugates, phosphorothioate backbones, or 2',4'-cyclic 2'-O-ethyl modifications to increase the stability thereof (Holdt et al., *Front Physiol.*, 9: 1262 (2018); Krutzfeldt et al., *Nature*, 438(7068): 685-9 (2005); and Crooke et al., *CellMetab.*, 27(4): 714-739 (2018)). The recombinant circRNA molecule also may comprise one or more modifications that reduce the innate immunogenicity of the circRNA molecule in a host, such as at least one N6-methyladenosine ($m^6A$).

In some embodiments, the recombinant circular RNA molecule is encoded by a nucleic acid that comprises at least two introns and at least one exon. In some embodiments, a DNA sequence encoding a circular RNA molecule comprises sequences that encode at least two introns and at least one exon. The term "exon," as used herein, refers to a nucleic acid sequence present in a gene which is represented in the mature form of an RNA molecule after excision of introns during transcription. Exons may be translated into protein (e.g., in the case of messenger RNA (mRNA)). The term "intron," as used herein, refers to a nucleic acid sequence present in a given gene which is removed by RNA splicing during maturation of the final RNA product. Introns are generally found between exons. During transcription, introns are removed from precursor messenger RNA (premRNA), and exons are joined via RNA splicing. In some embodiments, the recombinant circular RNA molecule comprises a nucleic acid sequence which includes one or more exons and one or more introns.

Accordingly, circular RNAs can be generated by splicing of either an endogenous or exogenous intron, as described in WO 2017/222911. As used herein, the term "endogenous intron" means an intron sequence that is native to the host cell in which the circRNA is produced. For example, a human intron is an endogenous intron when the circRNA is expressed in a human cell. An "exogenous intron" means an intron that is heterologous to the host cell in which the circRNA is generated. For example, a bacterial intron would be an exogenous intron when the circRNA is expressed in a human cell. Numerous intron sequences from a wide variety of organisms and viruses are known and include sequences derived from genes encoding proteins, ribosomal RNA (rRNA), or transfer RNA (tRNA). Representative intron sequences are available in various databases, including the Group I Intron Sequence and Structure Database (rna.whu.edu.cn/gissd/), the Database for Bacterial Group II Introns (webapps2.ucalgary.ca/~groupii/index.html), the Database for Mobile Group II Introns (fp.ucalgary.ca/group2introns), the Yeast Intron DataBase (emblS16 heidelberg.de/ExternalInfo/seraphin/yidb.html), the Ares Lab Yeast Intron Database (compbio.soe.ucsc.edu/yeast_introns.html), the U12 Intron Database (genome.crg.es/cgibin/u12db/u12db.cgi), and the Exon-Intron Database (bpg.utoledo.edu/~afedorov/lab/eid.html).

In some embodiments, a DNA molecule encoding a recombinant circular RNA molecule comprises a self-splicing group I intron. Group I introns are a distinct class of RNA self-splicing introns which catalyze their own excision from mRNA, tRNA, and rRNA precursors in a wide range of organisms. All known group I introns present in eukaryote nuclei interrupt functional ribosomal RNA genes located in ribosomal DNA loci. Nuclear group I introns appear widespread among eukaryotic microorganisms, and the plasmodial slime molds (myxomycetes) contain an abundance of self-splicing introns. The self-splicing group I intron included in the circular RNA molecule may be obtained or derived from any organism, such as, for example, bacteria, bacteriophages, and eukaryotic viruses. Self-splicing group I introns also may be found in certain cellular organelles, such as mitochondria and chloroplasts, and such self-splicing introns may be incorporated into the circular RNA molecule.

In some embodiments, the recombinant circular RNA molecule is generated from a DNA molecule that comprises a self-splicing group I intron of the phage T4 thymidylate synthase (td) gene. The group I intron of phage T4 thymidylate synthase (td) gene is well characterized to circularize while the exons linearly splice together (Chandry and Belfort, *Genes Dev.*, 1: 1028-1037 (1987); Ford and Ares, *Proc. Natl. Acad. Sci. USA,* 91: 3117-3121 (1994); and Perriman and Ares, *RNA,* 4: 1047-1054 (1998)). When the td intron order is permuted (i.e., 5' half placed at the 3' position and vice versa) flanking any exon sequence, the exon is circularized via two autocatalytic transesterification reactions (Ford and Ares, supra; Puttaraju and Been, *Nucleic Acids Symp. Ser.*, 33: 49-51 (1995)).

In some embodiments, the recombinant circular RNA molecule is encoded by a DNA molecule that comprises a ZKSCAN1 intron. The ZKSCAN1 intron is described in, for example, Yao, Z., et al., Mol. Oncol. (2017) 11(4):422-437. In some embodiments, the recombinant circular RNA molecule is encoded by a DNA molecule that comprises a miniZKSCAN1 intron.

The recombinant circular RNA molecule may be of any length or size. For example, the recombinant circular RNA molecule may comprise between about 200 nucleotides and about 10,000 nucleotides (e.g., about 300, about 400, about 500, about 600, about 700, about 800, about 900, about 1,000, about 2,000, about 3,000, about 4,000, about 5,000, about 6,000, about 7,000, about 8,000, or about 9,000 nucleotides, or a range defined by any two of the foregoing values). In some embodiments, the recombinant circular RNA molecule comprises between about 500 and about 6,000 nucleotides (about 550, about 650, about 750, about 850, about 950, about 1,100, about 1,200, about 1,300, about 1,400, about 1,500, about 1,600, about 1,700, about 1,800, about 1,900, about 2,100, about 2,200, about 2,300, about 2,400, about 2,500, about 2,600, about 2,700, about 2,800, about 2,900, about 3,100, about 3,300, about 3,500, about 3,700, about 3,800, about 3,900, about 4,100, about 4,300, about 4,500, about 4,700, about 4,900, about 5,100, about 5,300, about 5,500, about 5,700, or about 5,900 nucleotides, or a range defined by any two of the foregoing values). In one embodiment, the recombinant circular RNA molecule comprises about 1,500 nucleotides.

In some embodiments, a recombinant circular RNA molecule comprises a protein-coding nucleic acid sequence region and an internal ribosome entry site (IRES) sequence region operably linked to the protein-coding nucleic acid sequence region, wherein the IRES comprises: at least one sequence region having secondary structure element; and a sequence region that is complementary to an 18S ribosomal RNA (rRNA); wherein the IRES has a minimum free energy (MFEL) of less than −18.9 kJ/mol and a melting temperature of at least 35.0° C. In some embodiments, the IRES sequence is linked to the protein-coding nucleic acid sequence region in a non-native configuration.

The disclosure also provides a recombinant circular RNA molecule comprising a protein-coding nucleic acid sequence region and an internal ribosome entry site (IRES) sequence region operably linked to the protein-coding nucleic acid sequence; wherein the IRES is encoded by any one of the nucleic acid sequences listed in of SEQ ID NO: 1-228 or SEQ ID NO: 229-17201, or a nucleic acid sequence that has at least 90% or at least 95% identity or homology thereto. In some embodiments, the IRES sequence is linked to the protein-coding nucleic acid sequence region in a non-native configuration.

circRNA Internal Ribosome Entry Sites

The recombinant circular RNAs described herein comprise an internal ribosome entry site (IRES) operably linked to a protein-coding sequence of the circRNA in a non-native configuration. Inclusion of an IRES permits the translation of one or more open reading frames from a circular RNA. The IRES element attracts a eukaryotic ribosomal translation initiation complex and promotes translation initiation. It will be appreciated that there are two known mechanisms by which translation is initiated in eukaryotes. The first is the canonical cap-dependent mechanism that is used by the vast majority of eukaryotic mRNAs, which requires an $m^7G$ cap at the 5'end of the mRNA, initiator Met-tRNAmet, more than a dozen initiation factor proteins, directional scanning, and GTP hydrolysis to place a translationally competent ribosome at the start codon. The second mechanism is cap-independent initiation that is used by some mRNAs as well as many eukaryote-infecting viruses. This mechanism bypasses the need for the cap and often many of the protein factors, using cis-acting IRES RNA elements to recruit the ribosome and initiate protein synthesis. There is great diversity among viral IRES RNAs in terms of their sequences, proposed secondary structures, and functional requirements for protein factors, but all drive a mode of translation initiation that depends on specific RNA sequences and likely specific RNA structures in the IRES.

Accordingly, provided herein are various IRES sequences which, when present in a circRNA, may drive translation of a protein. In some embodiments, the IRES of a circRNA may be operably linked to a protein-coding nucleic acid sequence. In some embodiments, the IRES of a circRNA is operably linked to a protein-coding nucleic acid sequence in a non-native configuration. In some embodiments, the IRES is a human IRES. In some embodiments, the IRES is a viral IRES.

As used herein, the term "non-native configuration" refers to a linkage between an IRES and a protein-coding nucleic acid that does not occur in a naturally occurring circRNA molecule. For example, a viral IRES may be operably linked to a protein-coding nucleic acid sequence in a circular RNA, or an IRES that is not found in naturally occurring circRNA molecules may be operably linked to a protein-coding nucleic acid sequence in a circRNA. In some embodiments, an IRES that is found in naturally occurring circRNA molecules operably linked to a certain protein-coding nucleic acid is operably linked to a different protein-coding nucleic acid (i.e., a nucleic acid to which the IRES is not operably linked in any naturally-occurring circRNA). In some embodiments, an IRES that is found in naturally occurring linear mRNAs is operably linked to a protein coding sequence in a circular RNA.

A number of linear IRES sequences are known and may be included in a recombinant circular RNA molecule as described herein. For example, linear IRES sequences may be derived from a wide variety of viruses, such as from leader sequences of picornaviruses (e.g., encephalomyocarditis virus (EMCV) UTR) (Jang et al., *J. Virol.*, 63: 1651-1660 (1989)), the polio leader sequence, the hepatitis A virus leader, the hepatitis C virus IRES, human rhinovirus type 2 IRES (Dobrikova et al., *Proc. Natl. Acad. Sci.*, 100(25): 15125-15130 (2003)), an IRES element from the foot and mouth disease virus (Ramesh et al., *Nucl. Acid Res.*, 24: 2697-2700 (1996)), and a giardiavirus IRES (Garlapati et al., *J. Biol. Chem.*, 279(5): 3389-3397 (2004)). A variety of nonviral IRES sequences also can be included in a circular RNA molecule, including but not limited to, IRES sequences from yeast, the human angiotensin II type 1 receptor IRES (Martin et al., *Mol. Cell Endocrinol.*, 212: 51-61 (2003)), fibroblast growth factor IRESs (e.g., FGF-1 IRES and FGF-2 IRES, Martineau et al., *Mol. Cell. Biol.*, 24(17): 7622-7635 (2004)), vascular endothelial growth factor IRES (Baranick et al., *Proc. Natl. Acad. Sci. U.S.A.*, 105(12): 4733-4738 (2008); Stein et al., *Mol. Cell. Biol.*, 18(6): 3112-3119 (1998); Bert et al., *RNA*, 12(6): 1074-1083 (2006)), and insulin-like growth factor 2 IRES (Pedersen et al., *Biochem. J.*, 363(Pt 1): 37-44 (2002)).

IRES sequences and vectors encoding IRES elements are commercially available from a variety of sources, such as, for example, Clontech (Mountain View, Calif.), Invivogen (San Diego, Calif.), Addgene (Cambridge, Mass.) and GeneCopoeia (Rockville, Md.), and IRESite: The database of experimentally verified IRES structures (iresite.org). Notably, these databases focus on activity of IRES sequences in mRNA (i.e., linear RNAs), and do not focus on circRNA IRES activity profiles.

Figure 19A:
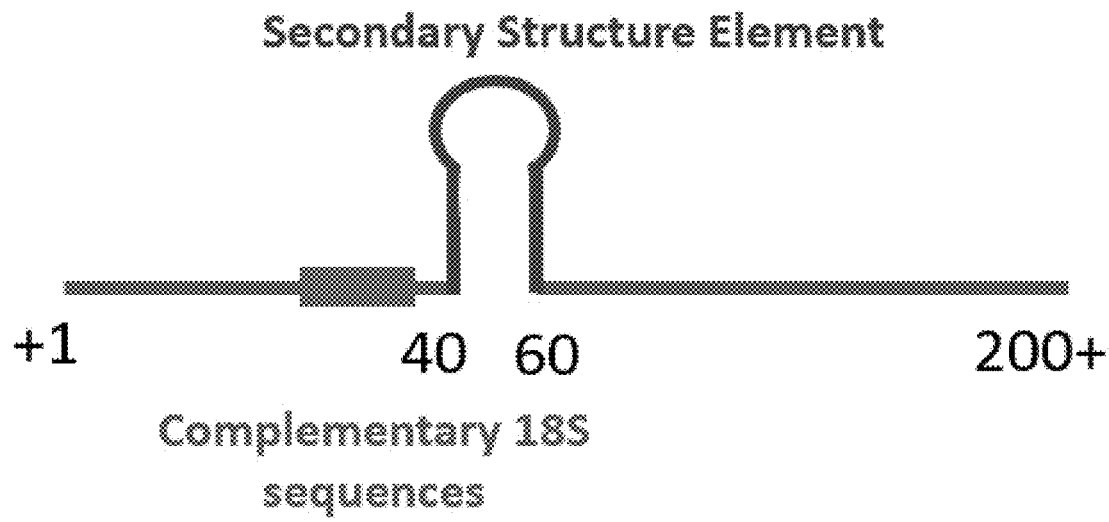
FIGS. 19A and 19B provide schematics of fixed positions of secondary structure elements as part of an IRES, wherein the secondary structure element spans from approximately nucleotide positions 40-60 bp from +1 start site of IRES sequence. The 18S complementary sequences may be positioned either 5' (FIG. 19A) or 3' (FIG. 19B) to the secondary structure element. In these figures, the secondary structure element is a hairpin; however the secondary structure element may have one or more alternative structures as described herein.
Figure 19B:
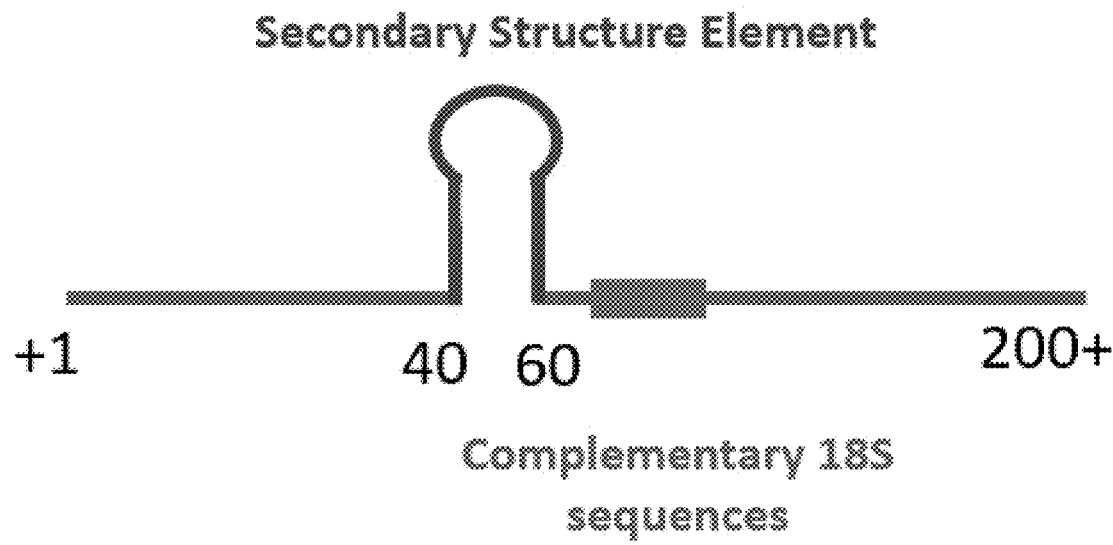

In some embodiments, the IRES comprises at least one RNA secondary structure element. Intramolecular RNA base pairing is often the basis of RNA secondary structure and in some circumstances be a critical determinant of overall macromolecular folding. In conjunction with cofactors and RNA binding proteins (RBPs), secondary structure elements can form higher order tertiary structures and thereby confer catalytic, regulatory, and scaffolding functions to RNA. Thus, the IRES may comprise any RNA secondary structure element that imparts such structural or functional determinants. In some embodiments, the RNA secondary structure may be formed from the nucleotides at about position 40 to about position 60 of the IRES, relative to the 5' end thereof. The most common RNA secondary structures are helices, loops, bulges, and junctions, with stem-loops or hairpin loops being the most common element of RNA secondary structure. A stem-loop is formed when the RNA chains fold back on themselves to form a double helical tract called the stem, with the unpaired nucleotides forming a single-stranded region called the loop. Bulges and internal loops are formed by separation of the double helical tract on either one strand (bulge) or on both strands (internal loops) by unpaired nucleotides. A tetraloop is a four-base pairs hairpin RNA structure. There are three common families of tetraloop in ribosomal RNA: UNCG, GNRA, and CUUG (N is one of the four nucleotides and R is a purine). Pseudoknots are formed when nucleotides from the hairpin loop pair with a single stranded region outside of the hairpin to form a helical segment. RNA secondary structure is further described in, e.g., Vandivier et al., Annu Rev Plant Biol., 67: 463-488 (2016); and Tinoco and Bustamante, supra). In some embodiments, the IRES of the recombinant circRNA molecule comprises at least one stem-loop structure. The at least one RNA secondary structure element may be located at any position of the IRES, so long as translation is efficiently initiated from the IRES. In some embodiments, the stem portion of the stem-loop may comprise from 3-7 base pairs, 4, 5, 6, 7, 8, 9, 10, 11 or 12 base pairs or more. The loop portion of the stem-loop may comprise from 3-12 nucleotides, including 4, 5, 6, 7, 8, 9, 10, 11, 12 or more nucleotides. The stem-loop structure may also have on either side of the stem one or more bulges (mismatches). In some embodiments, the RNA secondary structure element is formed from the nucleotides at about position 40 to about position 60 of the IRES, wherein the first nucleic acid at the 5' end of the IRES is considered to be position 1. In some embodiments, the sequence that is complementary to an 18S rRNA is located 5' to the at least one RNA secondary structure element (i.e., in the range of about position 1 to about position 40 of the IRES, See FIG. 19A). In some embodiments, the sequence that is complementary to an 18S rRNA is located 3' to the a least one RNA secondary structure element (i.e., in the range of about position 61 to the end of the IRES, See FIG. 19B). Sequences encoding exemplary secondary structure-forming RNA sequences that may be included in the IRES described herein are provided in SEQ ID NO: 17202-28976.

In some embodiments, the at least one RNA secondary structure element of the IRES is a stem-loop. In some embodiments, the at least one RNA secondary structure element is encoded by any one of the nucleic acid sequences of SEQ ID NO: 17202-28976. In some embodiments, the at least one RNA secondary structure element is encoded by a nucleic acid sequence having at least 80%, at least 85%, at least 90%, at least 91%, at least 92%, at least 93%, at least 94%, at least 95%, at least 96%, at least 97%, at least 98%, or at least 99% sequence identity relative to any one of SEQ ID NO: 17202-28976. In some embodiments, the at least one RNA secondary structure element is encoded by a nucleic acid sequence having at least 1, at least 2, at least 3, at least 4, at least 5, at least 6, at least 7, at least 8, at least 9 at least 10, or more nucleotide substitutions relative to any one of SEQ ID NO: 17202-28976.

RNA secondary structure typically can be predicted from experimental thermodynamic data coupled with chemical mapping, nuclear magnetic resonance (NMR) spectroscopy, and/or sequence comparison. In some embodiments, the RNA secondary structure is predicted by a machine-learning/deep-learning algorithm (e.g., CNN) (See, Zhao, Q., et al., "Review of Machine-Learning Methods for RNA Secondary Structure Prediction," Sep. 1, 2020 (available on the world wide web at: arxiv.org/abs/2009.08868). A variety of algorithms and software packages for RNA secondary structure prediction and analysis are known in the art and can be used in the context of the present disclosure (see, e.g., Hofacker I. L. (2014) Energy-Directed RNA Structure Prediction. In: Gorodkin J., Ruzzo W. (eds) RNA Sequence, Structure, and Function: Computational and Bioinformatic Methods. Methods in Molecular Biology (Methods and Protocols), vol 1097. Humana Press, Totowa, N.J.; Mathews et al., supra; Mathews, et al. "RNA secondary structure prediction," Current Protocols in Nucleic Acid Chemistry, Chapter 11 (2007): Unit 11.2. doi:10.1002/0471142700.nc1102s28; Lorenz et al., Methods, 103: 86-98 (2016); Mathews et al., Cold Spring Harb Perspect Biol., 2(12): a003665 (2010)).

In some embodiments, the IRES of the recombinant circRNA may comprise a nucleic acid sequence that is complementary to 18S ribosomal RNA (rRNA). Eukaryotic ribosomes, also known as "80S" ribosomes, have two unequal subunits, designated small subunit (40S) (also referred to as "SSU") and large subunit (60S) (also referred to as "LSU") according to their sedimentation coefficients. Both subunits contain dozens of ribosomal proteins arranged on a scaffold composed of ribosomal RNA (rRNA). In eukaryotes, eukaryotic 80S ribosomes contain greater than 5500 nucleotides of rRNA: 18S rRNA in the small subunit, and 5S, 5.8S, and 25S rRNA in the large subunit. The small subunit monitors the complementarity between tRNA anticodon and mRNA, while the large subunit catalyzes peptide bond formation. Ribosomes typically contain about 60% rRNA and about 40% protein. Although the primary structure of rRNA sequences can vary across organisms, base-pairing within these sequences commonly forms stem-loop configurations.

In some embodiments, the IRES of the recombinant circRNA may comprise any nucleic acid sequence that is complementary to any eukaryotic 18S rRNA sequence. In some embodiments, the nucleic acid sequence that is complementary to 18S rRNA is encoded by any one of the nucleic acid sequences set forth in Table 1. In some embodiments, the nucleic acid sequence that is complementary to 18S rRNA is encoded by a nucleic acid sequence that has at least 80%, at least 85%, at least 90%, at least 91%, at least 92%, at least 93%, at least 94%, at least 95%, at least 96%, at least 97%, at least 98%, or at least 99% identity or homology to a sequence set forth in Table 1. In some embodiments, the nucleic acid sequence that is complementary to 18S rRNA is encoded by a nucleic acid sequence that has at least 1, at least 2, at least 3, at least 4, at least 5, at least 6, at least 7, at least 8, at least 9, at least 10, or more nucleotide substitutions relative to a nucleic acid sequence set forth in Table 1.

TABLE 1

Illustrative DNA sequences that encode RNA sequences that are complementary to 18S RNA

| SEQ ID NO: | Nucleic Acid Sequence |
|---|---|
| 28977 | CACCTACGGAAACCTTGTTACGACTTTTACTTCCTCTAGATAGTCAAGTTCGACCGTCTTCT CAGCGCTCCGCCAGGGCCGTGGGCCGACCCCGGCGGGGCCGATCCGAGGGCCTCACTAAA CCATCCAATCGGTAGTAGCGACGGGCGGTGTGTACAAAGGGCAGGGACTTAATCAACGCA AGCTTATGACCCGCACTTACTGGGAATTCCTCGTTCATGGGGAATAATTGCAATCCCC |
| 28978 | GGGACGCCGACCGCTCGGGGGTCGCGTAACTAGTTAGCATGCCAGAGTCTCGTTCGTTATC GGAATTAACCAGACAAATCGCTCCACCAACTAAGAACGGCCATGCACCACCACCC |
| 28979 | GTTTATGGTCGGAACTACGACGGTATCTGATCGTCTTCGAACCTCCGACTTTCGTTCTTGAT TAATGAAAACATTCTTGGCAAATGCTTTCGCTCTGGTCCGTCTTGCGCCGGTCCAAGAATT TCACCTCTAGCGGCGCAATACGAATGCCCCCGGCCGTCCCTCTTAATCATGGCCTCAGTTC CGAAAACCAACAAAATAGAACCGCGGTCCTATTCCATTATTCCTAGCTGCGGTATCCAGGC GGCTCGGGCCTGCTTTGAACACTCTAATTTTTTCAAAGTAAACGCTTCGGG |
| 28980 | AGAGCATCGAGGGGGCGCCGAGAGGCAAGGGGCGGGGACGGGCGGTGGCTCGCCTCGCG GCGGACCGCCCGCCCGCTCCC |

TABLE 1-continued

Illustrative DNA sequences that encode RNA sequences that are complementary to 18S RNA

| SEQ ID NO: | Nucleic Acid Sequence |
|---|---|
| 28981 | TACGAGCTTT |
| 28982 | ATACGCTATTGGAGCTGGAATTACCGCGGCTGCTGGCACCAGACTTGCCCTCCAATGGATC CTCGTTAAAGGATTTAAAGTGGACTCATTCCAATTACAGGGCCTCGAAAGAGTCCTGTA |
| 28983 | GGGGGCGTGCGATCGGCCCGAGGTTATCTAGAGTCACCAAAGCCGCCGGCGCCCGCCCCC CGGCCGGGGCCGGAGAGGGG |

The most commonly used criterion for RNA secondary structure prediction is the minimum free energy (MFE), since, according to thermodynamics, the MFE structure is not only the most stable, but also the most probable one in thermodynamic equilibrium. The MFE of an RNA or DNA molecule is affected by three properties of nucleotides in the RNA/DNA sequence: number, composition, and arrangement. For example, longer sequences are on average more stable because they can form more stacking and hydrogen bond interactions, guanine-cytosine (GC)-rich RNAs are typically more stable than adenine-uracil (AU)-rich sequences, and nucleotide order influences the folding structure stability because it determines the number and the extension of loops and double-helix conformations. It has been found that mRNAs and microRNA precursors, unlike other non-coding RNAs, have greater negative MFE than expected given their nucleotide numbers and compositions. Thus, free energy also can be employed as a criterion for the identification of functional RNAs.

The IRES of the recombinant circRNA molecule may comprise a minimum free energy (MFE) of less than about −15 kJ/mol (e.g., less than about −16 kJ/mol, less than about −17 kJ/mol, less than about −18.5 kJ/mol, less than about −19 kJ/mol, less than about −18.9 kJ/mol, less than about −20 kJ/mol, less than about −30 kJ/mol). In some embodiments, the MFE is greater than about −90 kJ/mol (e.g., greater than about −85 kJ/mol, greater than about −80 kJ/mol, greater than about −70 kJ/mol, greater than about −60 kJ/mol, greater than about −50 kJ/mol, greater than about −40 kJ/mol). In some embodiments, the IRES has a has a minimum free energy (MFE) of about −18.9 kJ/mol or less. In some embodiments, the IRES has a MFE in the range of about −15.9 kJ/mol to about −79.9 kJ/mol. In some embodiments, the IRES may comprise a MFE in the range of about −12.55 kJ/mol to about −100.15 kJ/mol. In some embodiments, the IRES is a viral IRES and has a MFE in the range of about −15.9 kJ/mol to about −79.9 kJ/mol. In some embodiments, the IRES is a human IRES and has a MFE in the range of about −12.55 kJ/mol to about −100.15 kJ/mol.

In some embodiments, the at least one secondary structure element of an IRES of may comprise a minimum free energy (MFE) of less than about −0.4 kJ/mol, less than about −0.5 kJ/mol, less than about −0.6 kJ/mol, less than about −0.7 kJ/mol, less than about −0.8 kJ/mol, less than about −0.9 kJ/mol, or less than about −1.0 kJ/mol. In some embodiments, the at least one secondary structure element of the IRES may comprise a MFE of less than about −0.7 kJ/mol.

In some embodiments, the RNA sequence comprising the nucleotides at about position 40 to about position 60 of an IRES of a circRNA described herein may comprise a minimum free energy (MFE) of less than about −0.4 kJ/mol, less than about −0.5 kJ/mol, less than about −0.6 kJ/mol, less than about −0.7 kJ/mol, less than about −0.8 kJ/mol, less than about −0.9 kJ/mol, or less than about −1.0 kJ/mol. In some embodiments, the RNA sequence comprising the nucleotides at about position 40 to about position 60 of the IRES may comprise a MFE of less than about −0.7 kJ/mol.

As discussed, above, the minimum free energy of a particular RNA (e.g., an RNA produced from a DNA sequence) may be determined using a variety of computational methods and algorithms. The most commonly used software programs, employed to predict the secondary RNA or DNA structures by MFE algorithms, make use of the so-called nearest-neighbor energy model. This model uses free energy rules based on empirical thermodynamic parameters (Mathews et al., *JMol Biol*, 288: 911-940 (1999); and Mathews et al., *Proc NatlAcad Sci USA*, 101: 7287-7292 (2004)) and computes the overall stability of an RNA or DNA structure by adding independent contributions of local free energy interactions due to adjacent base pairs and loop regions. In sequences with homogeneous nucleotide arrangements and compositions, the additive and independent nature of the local free energy contributions suggests a linear relationship between computed MFE and sequence length (Trotta, E., *PLoS One*, 9(11): e1 13380 (2014)). Algorithms for determining MFE are further described in, e.g., Hajiaghayi et al., *BMC Bioinformatics*, 13: 22 (2012); Mathews, D. H., *Bioinformatics*, Volume 21, Issue 10: 2246-2253 (2005); and Doshi et al., *BMC Bioinformatics*, 5: 105 (2004) doi 10.1186/1471-2105-5-105).

One of ordinary skill in the art will appreciate that the melting temperature ($T_m$) of a particular circRNA molecule may also be indicative of stability. Indeed, RNA sequences with high $T_m$ generally contain thermo-stable functionally important RNA structures (see, e.g., *Nucleic Acids Res.*, 45(10): 6109-6118 (2017)). Thus, in some embodiments, the IRES of the recombinant circRNA molecule has a melting temperature of at least 35.0° C. In some embodiments, the IRES of the recombinant circRNA molecule has a melting temperature of at least 35.0° C., but not more than about 85° C. In some embodiments, in some embodiments, the RNA secondary structure has a melting temperature of at least 35° C., at least 36° C., at least 37° C., at least 38° C., at least 39° C., at least 40° C., at least 41° C., at least 42° C., at least 43° C., at least 44° C., at least 45° C., at least 46° C., at least 47° C., at least 48° C., at least 49° C. or greater. In some embodiments, the melting temperature is not more than about 85° C., not more than about 75° C., not more than about 70° C., not more than about 65° C., not more than about 60° C., not more than about 55° C., not more than about 50° C. or less.

The melting temperature of a particular nucleic acid molecule can be determined using thermodynamic analyses and algorithms described herein and known in the art (see, e.g., Kibbe W. A., *Nucleic Acids Res.,* 35(Web Server issue): W43-W46 (2007). doi:10.1093/nar/gkm234; and Dumousseau et al., *BMC Bioinformatics,* 13: 101 (2012). doi.org/10.1186/1471-2105-13-101).

In some embodiments, the IRES comprises at least one RNA secondary structure element; and a nucleic acid sequence that is complementary to an 18S ribosomal RNA (rRNA); wherein the IRES has a minimum free energy (MFE) of −18.9 kJ/mol or less and a melting temperature of at least 35.0° C. In some embodiments, the RNA secondary structure element of the IRES has a has a minimum free energy (MFE) of less than −18.9 kJ/mol, and is formed from the nucleotides at about position 40 to about position 60 of the IRES, wherein the first nucleic acid at the 5' end of the IRES is considered to be position 1. In some embodiments, the RNA secondary structure element has a melting temperature of at least 35.0° C., and is formed from the nucleotides at about position 40 to about position 60 of the IRES, wherein the first nucleic acid at the 5' end of the IRES is considered to be position 1.

Because circRNA molecules are often generated from linear RNAs by back-splicing of a downstream 5' splice site (splice donor) to an upstream 3' splice site (splice acceptor), the recombinant circular RNA molecule may further comprise a back-splice junction. In some embodiments, the IRES may be located within about 100 to about 200 nucleotides of the back-splice junction. In addition, it has been observed that regions of RNA with higher G-C content have more stable secondary structures than RNA strands with lower G-C content. Thus, in some embodiments, the IRES of the recombinant circRNA molecule may further comprise a minimum level of G-C base pairs. For example, the non-native IRES of the recombinant circRNA molecule may comprise a G-C content of at least 25% (e.g., at least 30%, at least 35%, at least 40%, at least 45% or more), but not more than about 75% (e.g., about 70%, about 65%, about 60%, about 55%, about 50% or less). In some embodiments, the IRES has a G-C content of at least 25%.

G-C content of a given nucleic acid sequence may be measured using any method known in the art, such as, for example chemical mapping methods (see, e.g., Cheng et al., *PNAS,* 114 (37): 9876-9881 (2017); and Tian, S. and Das, R., *Quarterly Reviews of Biophysics,* 49: e7 doi:10.1017/S0033583516000020 (2016)).

Exemplary sequences encoding IRESs for use in the circRNA molecules of the present disclosure are set forth in of SEQ ID NO: 1-228 or SEQ ID NO: 229-17201. Thus, the disclosure further provides a recombinant circular RNA molecule comprising a protein-coding nucleic acid sequence and an IRES operably linked to the protein-coding nucleic acid sequence in a non-native configuration; wherein the IRES is encoded by any one of the nucleic acid sequences listed in of SEQ ID NO: 1-228 or SEQ ID NO: 229-17201.

In some embodiments, the IRES is encoded by any one of the nucleic acid sequences set forth in any one of SEQ ID NO: 1-228. In some embodiments, the IRES is encoded by a nucleic acid sequence that has at least 80%, at least 85%, at least 90%, at least 91%, at least 92%, at least 93%, at least 94%, at least 95%, at least 96%, at least 97%, at least 98, or at least 99% identity to any one of the nucleic acid sequences of SEQ ID NO: 1-228. In some embodiments, the IRES is encoded by a nucleic acid sequence that has at least 1, at least 2, at least 3, at least 4, at least 5, at least 6, at least 7, at least 8, at least 9, at least 10 or more nucleotide substitutions relative to any one of the sequences of SEQ ID NO: 1-228.

In some embodiments, the IRES is encoded by any one of the nucleic acid sequences set forth in any one of SEQ ID NO: 229-17201. In some embodiments, the IRES is encoded by a nucleic acid sequence that has at least 80%, at least 85%, at least 90%, at least 91%, at least 92%, at least 93%, at least 94%, at least 95%, at least 96%, at least 97%, at least 98, or at least 99% identity or homology to any one of the nucleic acid sequences of SEQ ID NO: 229-17201. In some embodiments, the IRES is encoded by a nucleic acid sequence that has at least 1, at least 2, at least 3, at least 4, at least 5, at least 6, at least 7, at least 8, at least 9, at least 10 or more nucleotide substitutions relative to any one of the sequences in any one of SEQ ID NO: 229-17201.

In some embodiments, the IRES is encoded by the nucleic acid sequences denoted Index 876 (SEQ ID NO: 531), 6063 (SEQ ID NO: 2270), 7005 (SEQ ID NO: 2602), 8228 (SEQ ID NO: 3042), or 8778 (SEQ ID NO: 3244). In some embodiments, the IRES is encoded by the nucleic acid sequence of SEQ ID NO: 33948.

In some embodiments, the IRES is encoded by any one of the nucleic acid sequences set forth in Table 2. In some embodiments, the IRES is encoded by a nucleic acid sequence that has at least 80%, at least 85%, at least 90%, at least 91%, at least 92%, at least 93%, at least 94%, at least 95%, at least 96%, at least 97%, at least 98, or at least 99% identity or homology to one or the nucleic acid sequences of Table 2. In some embodiments, the IRES is encoded by a nucleic acid sequence that has at least 1, at least 2, at least 3, at least 4, at least 5, at least 6, at least 7, at least 8, at least 9, at least 10 or more nucleotide substitutions relative to any one of the sequences in Table 2.

TABLE 2

Illustrative Sequences Encoding IRES sequences

| Oligo-nucleotide Identifier | Sequence | SEQ ID NO: |
|---|---|---|
| 4173 | CATCCTCCTGCTGAAGTGACAAGCCACGCTGCTTCTGGAGCCAAAGCTGACCAAGAAGAACAAATCCACCCCAGATCTAGACTCAGGTCACCTCCTGAAGCCCTCGTTCAGGGTCGATATCCCCACATCAAGGACGGTGAGGATCTTAAAGACCACTCAACAGAAAGTAAAAAA | 33946 |
| 2125 | GCAGAAGGGAAACGTGAAGAAGGTGAAGATGGCGGTGGCCAGGGCCGGGGTCTTGGGAGTCCAGTGGCTGCAAAGGGCATCCCGGAACGTGATGCCGCTGGGCGCACGGACAGCCTCCCACATGACCAAGGACATGTTCCCGGGGCCCTATCCTAGGACCCCAGAAGAACGGGC | 33947 |

TABLE 2-continued

Illustrative Sequences Encoding IRES sequences

| Oligo-nucleotide Identifier | Sequence | SEQ ID NO: |
|---|---|---|
| 6742 | AGACTCGGGAACTGCCTGAATGTGGTTTGGGACACGAGACCTCATC ATATTGATGAGCGAACAAACAAGAACATTTCCTCCCTCCCCTCCTTT GAATTGAAATGGCACATTAAGACTTGTCACGGCTTCTCACTGGGACT GGAGACCTCGTTCCTTCACCCCGCGTGTCGCCAG | 33948 |
| 8839 | AGGTGGGCGGTGGCGGTAGGTGGGTGGCCAGCGACTGGCAACGCGG TGGCTTAGACGCGCGAGATCCGGCCAGGGTCAGAGTACTGTAAGAT TGATGTTAAAGGCATGGTGTTCACCCCACTTCATCAGCGTACATAAG TTATCTCTTCTTTTGGACCCTTATTTTATGCCATA | 33949 |
| 8279 | GGAGGCAGGTTGATGTGTTTGTGCTTCCTTCTACAGCCAATATGAAA AGGCCTAGTAAGTGGGGTCGGGAGGCGGGCGTGGAGGGACCCACGT CTGGAAGTTGCTGCAGCCACCACGACGCTCTTCTACGGCTACGGCTT TGTCTCTGCTGAGTTAAAGAAAGCAAGTAAACGC | 33950 |
| 1637 | ATTTATAAGCAATAGTAGCTTATTTGGCTCACAGTTCTGGAGGCTGA GAAGATCGTGAGGCTGCATCTGGCAAGGGCCTTCTTGCTGCTTCATA ACATGGCAGAAGACATCATGCGGGTGTGTGTCTGGGGAAGAGACTT ACAGAAGTGGAGTTGCTGAGTCAAAGATCTAACC | 33951 |
| 27147 | TCTTTTGGTGCAGAAGGTGACGGGAAACAGGCCGCAGACCTGAACT TCCAACCGTATGTAGGCGAGAAGCCGGTGCCGATACTCCCACTATCC CACAATGTCCCACTGGGCCCCAGAGTGGAAGAGGGCGGAGGCTAAT CCAAGAGACCTTGGGGCCAGCTGGGATGTCAGGGG | 33952 |
| 7408 | ATCCACCATGAAGCAGAATCTAAAGAAAAAGGTCCAAGCATGAAGG AACCAAATCCAATTTCTCCACCAATTTTCCATGGTCTGGACACCCTA ACCGTGATGGGCATTGCGTTTGCAGCCTTTGTGATCGGAGCACTCCT GACGGGGCCTTGTGGTACATCTATTCTCACACA | 33953 |
| 29135 | CAGATTAGAGGACGGGCGCTTTGGAGCCGGCCCCAGGCAGCGTGTG TCGGTCGCCTAGTCTGGAGAACTAGTCCTCGACTCACGTGCAAGGAT GATGCTGAAAGGAATAACAAGGCTTATCTCTAGGATCCATAAGGCC AAGCATGGGGATCAGCACGAGGGTCAGCACTACAA | 33954 |
| 7806 | CTCTCGGGGGCCAGGGGTCATCGGTTTGACCCCTGACCTATAAGCCA AGATACCCCATAAACACACTCAGAAAGCAGAGAAAAAGGACAAGA GTCTGTGTTTGAGAGGGGGTCTGCCATTCCTGCTTGGGGACTGGTGG GGAAGAGGGCCAGGACATCTTCTGAGCCAGGACGT | 33955 |
| 661 | AGTCTGGCTGCGGCGGCAGAGCTGAAGTGAGCGGAGCCACCAGGAG GCCATGTCGGGTGAGGACGCTGAGGTCCGGGCAGTCTCTGAAGATG TCTCCAATGGAAGCAGTGGCTCGCCCAGCCCTGGGGACACACTGCCC TGGAACCTTGGGAAAACGCAGCGGAGCCGGCGCAG | 33956 |
| 1258 | ATCTGCCTCAGCCTCTTTGTCACTGCCTGGACCATTGTCCCTGCTGTT TCTCAGACAGCATAGAGGCTGAGGCTGGGGCCAGGACCCAGACAGA GACACACGGTCACTGCAGCTGAAGCCGCTGCCCCTGCTACAGGCAC CACCAGGACCAGCTGATCATTCCAGCCCACAGCA | 33957 |
| 6757 | CTCAGGCTGTGGCCCCACCTGCCCCCAAGCCCACCCAGGCTGGGGA AGGAACGCTGTCAGAGGCCCTGCTGCAGCTGCAGTTTGATGATGAA GACCTGGGGGCCTTGCTTGGCAACAGCACAGACCCAGCTGTGTTCAC AGACCTGGCATCCGTCGACAACTCCGAGTTTCAGC | 33958 |
| 5825 | CTCAAGGTTTTGAAGAGACAGGGGACACGCTCTATGCCCCCTATTCC ACACATTTTCAGCTGCAGAACCAGCCTCCCCAAAAGGAATTCTCCAT CCCACGGGCCCACGCTTGGCCGAGCCCTTACAAAGACTATGAAGTA AAGAAAGAGGGCAGCTAACTCTGTCCTGAAGAGT | 33959 |
| 27115 | GCTTCCGTAGAGGCCAGCTGGTTGCTACGCAGCAACAGGAAACATT CCGCGCTACCGAGTACTTTCTACTCCCGACCAGGCATTGCTCTCTCTG GAGACCCTCGGCGGTGGTTGCTGTATTTTGACTTGGAGTAAGGATGA CTTTTCGGGCCACAGATAGTGAATTTGACCTGA | 33960 |
| 3130 | CTGGAGGGCCGCACTCCCGTTCCAGCCAGGCTGAGCCTTCTGTCCCC TGCCTCTGGGGCCTGGGAACCCCCCTTCTTCTTTCTCCTGAATGGCAC CCCGCCCTAGAATCCAGACACCGAGTTTCCCACTGTGGCTGGTTCA AGGAGCTCCCTGGTGACAGTCTGTGGCTGAGC | 33961 |

TABLE 2-continued

Illustrative Sequences Encoding IRES sequences

| Oligo-nucleotide Identifier | Sequence | SEQ ID NO: |
|---|---|---|
| 5065 | TAGAGTGGGGGGTGGAAGATGATTCTCGCCTGTTGCTGGGGATTTAT GAACATGGCTATGGAAACTGGGAGTTAATTAAAACAGACCCAGAGC TTAAATTAACTGACAAAATTCTGCCGGTGGAGACAGATAAAAAGCC TCAGGGGAAGCAGCTACAGACCCGAGCGGATTACT | 33962 |
| 8066 | AGCGGCTGCAGCATCCAGCCAGCTTGGATGTCTGGCCTGTGAGCCTG GGGAAACTATTATTAATAATATTTACTGTTGATAATATTGGGGAAAA CAGCCCTTAACTCTGAGGTTTCTGCTGTGCTCCTTTCCAAAACAGACT TCCAGGACTCTGAAGAAACAGTTACAAGCAGG | 33963 |
| 1952 | AAGGGAGGAGGCGCCGAGCTGACCGGGCGACGCCGCGGGAGGTTCT GGAAACGCCGGGAGCTGCGAGTGTCCAGACACTTCCCTCTGTGACC ATGAAACTCTGGGTGTCTGCATTGCTGATGGCCTGGTTTGGTGTCCT GAGCTGTGTGCAGGCCGAATTCTTCACCTCTATTG | 33964 |
| 5020 | GCGAACTGAAGGTGGCCCAAGGGAAGGCTCTGCAAGAGAATTTGGC CCTCCTGACCCAGACCCTAGCTGAAAGAGAAGAGGAGGTGGAGACT CTGCGGGGACAAATCCAGGAACTGGAGAAGCAACGGGAAATGCAG AAGGCTGCTTTGGAATTGCTGTCTCTGGACCTGAAGA | 33965 |
| 8766 | AGGAAGCCGAGGAAGGCTGTGTTTCTGACTCACACGGGGGAGTCGG GGGAGTCGTAAACAACCCTGAAGAGAACAGCCAGGCCTGGCGCTCT GGGCTTGGTCCTGGGACACCCGTTTGACACTGTAAAGGTGAGGCTGC AGACCCAGACCACCTACCGGGGCATCGTTGATTGC | 33966 |
| 27433 | CTGCCTCCCCCCCGCTCCCGCTCCCCTGAGCCCAGCCAGACCCCGCG CCGCCCGCGCCCCGCTCGACTCCGGAGGCTCCCGCAGCCCGGCGTC CGCCCCGCTGCCCCCTCCCCCGGGGGCCATGGGGGCGCCCCCGGGCT ACCGGCCCTCAGCTTGGGTGCATCTCCTCCACC | 33967 |
| 27818 | CTCAGTGAAGCAACGAGGATGCCGGGGAGAGGGAAGGGGCTGGGC TCTGGGCGGTGCCAAGTCTGTGAGGGGGCGCGGTCACCGCCCAGGG TTCCCACGAACGCCAAGGCGGCCACGTCCTGCTCCCCCTGGTGAAGA AGCTGCCCTGGGCTTGTCGTCCTAGGGTCTCCAGAC | 33968 |
| 8861 | CTGATGTGAGCTAGTTTGTCTGGTTGAGTTGGATGTTTAAATAGAAG GCAGAACAACAACAGGTACTCCACATCAGCATTCTCAAGACTGGAG AAGTTAGGCCTCAGACATCCCAAGCCTTCTCCTTTCATTGGAAACTT GACATTTTTCCGCCAGGGTTTTTGGGAAAGCCAA | 33969 |
| 8040 | GCCACATTCCACACTAACGTGTTGGTGAATTCTTCTGGGCATTGCCA GTACCTGCCTCCAGGCATATTCAAGAGTTCCTGCTACATCGATGTAC GCTGGTTTCCCTTTGATGTGCAGCACTGCAAACTGAAGTTTGGGTCC TGGTCTTACGGAGGCTGGTCCTTGGATCTGCAG | 33970 |
| 27907 | TCCTGCCTCGGCAACCCCGGGCCCTGAGGGCAGGCCCCAACCGCGG AGGAGCAGGAGAGGGCGGAGGCCGGCGGGCCATGCCCTGGTCGTCC CGCGGCGCCCTCCTTCGGGACCTGGTCCTGGGCGTGCTGGGCACCGC CGCCTTCCTGCTCGACCTGGGCACCGACCTGTGGG | 33971 |
| 2392 | AAGTTTGAAACTGGTAACTTCGGGAGTTGAGCCACGAGCTGTTGTGC ATCCAGAGGTGGAATTGGGGCCCGGCATTCCCTCCTCGTCCCGGGCT GGCCCTTGCCCCCACCCTGCAACTCCTGGTTGAGATGGGCTCAGCCA AGAGCGTCCCAGTCACACCAGCGCGGCCTCCGC | 33972 |
| 7802 | AGCCTTCGCTGGATCTCCTTCCCGAACTCACAAATCCTGACGAGCTC CTGTCTTATCTGGACCCCCCCGACCTGCCGAGCAATAGTAACGATGA CCTCCTGTCTCTATTTGAGAACAACTGAGGGCCACCCGGTCGGGGCC ATCCCTCCACACTCTGCATCCTACCCCACCTAC | 33973 |
| 7655 | TTTTTAGAGGTTGGTTGTTGTGTTTTAGGATTCTGTCCATTTTCTTTTA AAGTTATAAACACGTACTTGTGCGAATTATTTTTTTAAAGTGATTTGC CATTTTTGAAAGCGTATTTAATGATAGAATACTATCGAGCCAACATG TACTGACATGGAAAGATGTCAAAGATATGT | 33974 |
| 981 | AGCCAGCGGACGTCCAGGAACCGGGATGCCTCCAGCAGTGAGGCGG TCAGCCTGCAGCATGGGATGGCTGTGGATCTTTGGGGCAGCCCTGGG GCAGTGTCTGGGCTACAGTTCACAGCAGCAAAGGGTGCCATTTCTTC AGCCTCCCGGTCAAAGTCAACTGCAAGCGAGTTA | 33975 |

TABLE 2-continued

Illustrative Sequences Encoding IRES sequences

| Oligo-nucleotide Identifier | Sequence | SEQ ID NO: |
|---|---|---|
| 5027 | GGGACCAGGAACTGGAGGCTCTGCAGCAAGAACAGCAGCAGGCCCAGGGACAGGAGGAGAGGGTGAAGGAAAAGGCAGACGCCCTCCAGGGAGCTCTGGAGCAAGCCCATATGACACTGAAGGAGCGTCATGGAGAGCTTCAGGACCACAAGGAACAGGCACGAAGGCTGGAGG | 33976 |
| 7683 | CTACTCCGGAGCCTGAGGTGGGAGGATCGCTTGAGTCTGGGAGGCAGAGGCTGCATTGAGCTATGATCATGGCACTGCATTCCAGCCTGGGTGACAGTGCAAGACCTTGTCTCAGAATAAATAAAGTATGTGATGAAGATGTGCATACATTATATGCAAATACTGTTTTTTTTT | 33977 |
| 8650 | CACCAATTCGGCTGGCGTCTCCGAGACCGCGGACTCCCGTAGGGTCCCCGTGGCCCCGAGTTGTAGTCGGGACACCCCGGCCGCGGGTGATCGTCGGGTCTCCACGCGCCCGGGTCGCTGACGCGGATCCGGCCTCGGCGCCTTCTCAGGGCGCCCTGCAAGGCCGCAGGCAGG | 33978 |
| 6898 | CCTCCTCTCTGGCTAATCAACAGCTGCCCCCAGCCTGTGGTGCCAGGCAACTCAGCAAGCTGAAAAGGTTCCTTACTACCCTGCAGCAGTTTGGCAATGACATTTCACCCGAGATAGGAGAAAGAGTTCGCACCCTCGTTCTGGGACTAGTGAACTCCACTTTGACAATTGAAG | 33979 |
| 2042 | TTTAGTGTCACAGGAGACACGAGGGCAAAGTGCTGAGGAAACTCTAGAGCAACATCGGAATGCATGGTGAAGCATCAGATGGTGAAGGAGAAGGAGACACAGAAGTGATGCAGCAGGAGACAGTTCCAGTTCCTGTACCTTCAGAGAAAACCAAACAGCCTAAAGAATGTTTTT | 33980 |
| 1686 | GCCACTTCTCTTCCCTTCATTCTTCGCCAGGCTCTCTGCTGACTCAAGTTCTTCAGTTCACGATCTTCTAGTTGCAGCGATGAGTGCACGAGTGAGATCAAGATCCAGAGGAAGAGGAGATGGTCAGGAGGCTCCCGATGTGGTTGCATTCGTGGCTCCCGGTGAATCTCAGCA | 33981 |
| 5902 | CTTCAACTTGGCAACAGTTGCCTGGGGTAGCTCTACACAACTCTGTCCAGCCCACAGCAATGATTCCAGAGGCCATGGGAGTGGACAGCAGCTAGCTGACTGGAGGAATGCCCACTCTCATGGCAACCAGTACAGCACTATCATGCAGCAGCCATCCTTGCTGACTAACCATG | 33982 |
| 3399 | CACCCTGACCCAAGCCGAGACAGGTTCCAAACCTCAACCTGCAGCCGGAAGGGGGAAGTGAAACTCGGCTGGGGGTGGGGGCTCAGAAGCCGCCCCAGAAAGCACTGAAAGCCACAGCACGTACACCCACTCCAGGGATCTGCCAGCACCCTGTGGGGCCCAGACTACAGGCTG | 33983 |
| 6560 | GGGACGCCATTGTGATTGGGGCGGGGATCCAGGGCTGCTTCACTGCATACCACCTGGCCAAACACAGGAAGAGGATCCTCCTGCTGGAGCAGTTCTTTCTACCACACTCCCGAGGAAGCTCCCATGGACAAAGCCGGATAATCCGAAAGGCGTACCTGGAAGACTTTTACACCC | 33984 |
| 2890 | CACCGTAGTGCTTAGAGGCCGAAAAAGTACAGCCCCTTCCGGGCTCCGCGGTACGGGAAGACAGCTTTGGGATGTCGGAAGATCCTAGAGGTCCCAAGGTACCACGAAAGGCAGTGGTAGAAAAGCCAGCTCGGGCAGCAGAGCGAGAGGCCCGGGCCCTGCTGGAGAAGAACC | 33985 |
| 4343 | ATTGGCTGAGCCCGGCTGTCAGTCCTTTCGCGCCTCGGCGGCGCGGCATAGCCCGGCTCGGCCTGTAAAGCAGTCTCAAGCCTGCCGCAGGGAGAAGATGGCGGTCGCCGTGAGAACTTTGCAGGAACAGCTGGAAAAGGCCAAAGAGAGTCTTAAGAACGTGGATGAGAACAT | 33986 |
| 6138 | ACAAGGAGACTGGGAGGTGTCTCAAGTGCCTGTACCACACGGAAGGGGAACACTGTCAGTTCTGCCGGTTTGGATACTATGGTGATGCCCTCCAGCAGGACTGTCGAAAGTGTGTCTGTAATTACCTGGGCACCGTGCAAGAGCACTGTAACGGCTCTGACTGCCAGTGCGACA | 33987 |
| 2241 | GAGGAAGGAGAGAGTGGAGGAGGAGGGCTTTGGGTTAGGGAGAGTGCTTTCGTTTGTTTTAAATGGGAGAAACTGGAGCATGTTGCCAAGGGCAGAGAGCCAGCAGAGAGGGGTGAATGAAGAAGGAGCGAGAAGGGGGTTACTGACGAAGCCTTATCCTGGAGGAGAGAAGG | 33988 |
| 5715 | CAAGTGGTCCTGTCGAAGTATTTATCACTGAGACTCCGAGTCAGCCCAACTCCCACCCCATCCAGTGGAATGCACCACAGCCATCTCACATTTCCAAGTACATTCTCAGGTGGAGACCTAAAAATTCTGTAGGCCGTTGGAAGGAAGCTACCATACCAGGCCACTTAAACTCCT | 33989 |

TABLE 2-continued

Illustrative Sequences Encoding IRES sequences

| Oligo-nucleotide Identifier | Sequence | SEQ ID NO: |
|---|---|---|
| 3456 | CTAGACCAAAGGGTGCGGCTGCTGCAGAGGTGGCTGATGCAGGTTT CCATCCTTGGGGAATGACCACGCAACTGGGCCCAGCCCTGGTGCTGG GGGTGGCCCTGTGCCTGGGTTGTGGCCAGCCCCTACCACAGGTCCCT GAACGCCCCTTCTCTGTGCTGTGGAATGTACCCT | 33990 |
| 5260 | ATCTCCAGCCATTGCTCCTCCAACAGAGACCATGGCTCCTCCAGTCA GGGATCCTGTTCCTGGGAAACCCACGGTCACCATCCGGACTCGAGGC GCCATTATTCAAACCCCAACCCTAGGCCCCATCCAGCCTACTCGGGT GTCAGAAGCTGGCACCACAGTTCCTGGCCAGAT | 33991 |
| 1288 | GGAGGCAGGCGGTGCCGCGGCGCCGGGACCCGACTCATCCGGTGCT TGCGTGTGGTGGTGAGCGCAGCGCCGAGGATGAGGAGGTGCAACAG CGGCTCCGGGCCGCCGCCGTCGCTGCTGCTGCTGCTGCTGTGGCTGC TCGCGGTTCCCGGCGCTAACGCGGCCCCGCGGTCG | 33992 |
| 8756 | CACCCCCACCGACCTCTCGGAGACAGGAATCCGCTCTGCCCCTGCAT CCTCCTCTGCTCACCCTTCTCTCAGTAGTGTTTGTCAGACACCAGTCC GGACCTCAGCTCTCGATCTAGTTCCCGAGTAAGATTTAGCTCCCGGG AAAGCGTGCCTGAAACAAGCCGGAGTGAGCCT | 33993 |
| 8952 | CCTGTACCATAACCAGGAGGCTGATGGTTGCTCAGGCCTCCCTCAAA CTAGCCAATGAGAAGTGCACGGGTCCTGGTCGCCTAGGAAACCGCG TGACAACAAGATGGCGGCGCTGCGGGACGGCTAGCGGCCCTGCGTG GGAGTTCCTGACAGCTGGATTCTAGAAGTAGAACT | 33994 |
| 2759 | TTCCCCGGAAGTGTTGGTTAAAGCCCCTCCAATCAGCGGCTCGGTGC GGCAAGTTTGAATTTCGTGGAGGCTCGGGTTGTGAGGGTTCCTGCTT CGGAGTCGGCGGTGGTCGTCCAGACCGAGTGTTCTTTACTTTTTGTTT GGTTGAGGTTTCACGCTAGAAGGTGGCTCAGG | 33995 |
| 1241 | CTGTCCATACACTCTCTCATCATCCTGTTCCTTGGATTGGACTTCACT AAGCAATTTATCACTCACCTTCAGACTTACATGTGGGAGTTTTCACA ACAGTAGTTTTGGAATCATTAGAACTTGGATTGATTTCATCATTTAAC AGAAACAAACAGCCCAAATTACTTTATCACC | 33996 |
| 28013 | GAGCTCCAGCCTCCAGGCACCCGGGATCCAGCGCCGCCGCTCATAA CACCCGCGACCCCGCAGCTAAGCGCAGCTCCCGACGCAATGGACCC GGCGCTGGCAGCCCAGATGAGCGAGGCTGTGGCCGAGAAGATGCTC CAGTACCGGCGGGACACAGCAGGCTGGAAGATTTGC | 33997 |
| 4681 | TGTTGACTCATGCAAATGAGGTATCTGAACTGCAGCTTCAGTATTAG CAGAGCCACAGGCCGCCTCTGTGGCATCACCAGGGTTTCTCTGAAGA AGAGGGTCTGCATTTTCCTAAACCCAGTGCTGCTCTCCCATCTCCCAT CTTCCTCTCGCAGCTTGATGAGCCCCGGTGTG | 33998 |
| 5602 | TGCCCCAGCCCTCAGGGCCGCCAGCAAGGAAGAAATTTGTGATACC CCTCGACGAGGATGAGGTCCCTCCTGGAGTGGCCAAGCCCTTATTCC GATCTACACAGAGCCTTCCCACTGTGGACACCTCGGCCCAGGCGGCC CCTCAGACCTACGCCGAATATGCCATCTCACAGC | 33999 |
| 1945 | GAGAGGCCGGCGTCTCTCCCCCAGTTTGCCGTTCACCCGGAGCGCTC GGGACTTGCCGATAGTGGTGACGGCGGCAACATGTCTGTGGCTTTCG CGGCCCCGAGGCAGCGAGGCAAGGGGGAGATCACTCCCGCTGCGAT TCAGAAGATGTTGGATGACAATAACCATCTTATT | 34000 |
| 5229 | AACCCCAACCCTAGGCCCCATCCAGCCTACTCGGGTGTCAGAAGCTG GCACCACAGTTCCTGGCCAGATTCGCCCAACGATGACCATTCCTGGC TATGTGGAGCCTACTGCAGTTGCTACCCCTCCCACAACCACCACCAA GAAGCCACGAGTATCCACACCAAAACCAGCAAC | 34001 |
| 7542 | CTGCAGCATCTTCTACGTCGGGACCACAGCCTCCGCCTCCACAAAGC CTGAACCTCCTTTCGCAGGCTCAGCTGCAGGCACAGCCTCTTGCGCC AGGCGGAACTCAAATGAAAAAGAAAAGTGGCTTCCAGATAACTAGC GTTACTCCTGCTCAGATCCCGCTAGTATCAGCT | 34002 |
| 6866 | CCAATACCTGGGATCCATTGCCTCTCCTTCTGTGCACCCAGCAACGC CCATTTCACCTGGACGTGCCAGCGGCATGACAACCCTCTCTGCAGAA CTTTCCAGTCGACTCTCAACGGCACCCGACCTGACAGCGTTCAGCGA CCCGCGCCAGTTCCCCGCGCTGCCCTCCATCTC | 34003 |

TABLE 2-continued

Illustrative Sequences Encoding IRES sequences

| Oligo-nucleotide Identifier | Sequence | SEQ ID NO: |
|---|---|---|
| 1849 | TCTCTTGCTTCAACAGTGTTTGGACGGAACAGATCCGGGGACTCTCT TCCAGCCTCCGACCGCCCTCCGATTTCCTCTCCGCTTGCAACCTCCGG GACCATCTTCTCGGCCATCTCCTGCTTCTGGGACCTGCCAGCACCGTT TTTGTGGTTAGCTCCTTCTTGCCAACCAACC | 34004 |
| 2558 | AGTTACCTCTCCCCTTTCACGTAGTTTTCATTTGTGGTGAGATTCTCT CCCAGGCCACAAGACATTTCCTGCTCGGAACCTTGTTTACTAATTTC CACTGCTTTTAAGGCCCTGCACTGAAAATGCAAGCTCAGGCGCCGGT GGTCGTTGTGACCCAACCTGGAGTCGGTCCCG | 34005 |
| 2109 | ATCAGCCCAAAGGTAGGCTCAGGCTCCGACGGTGGCCGGCGGGGGT CACGAGGCTTCGTAGTGGAGGAACGGGTTTGGCGTGTGGGACGCAG CTGCCTCTGTACTGGGGAGTCACGGAGTGGCCGGGCTCCAGGGACA TGGCGGCGGCCTCTGCGGTGTCGGTGCTGCTGGTGG | 34006 |
| 297 | ATCCGGAGGCAGCCTGCAGGAAGCCGTAGCGCCGGTACGTGCCCCT CTCCTGTCTGGAGGCGGGTGTAGAAGTCCGACCGCGGAAGCCAGAC TGCTGTCCAGTCGGCGAGCGCGTACCATTCAGCATCGGCTCCGCCCG AGTCCCACCTTCCTCAGGCTCTGATTGGCTGACAC | 34007 |
| 2621 | CAACAGAAGCCAAGAAGGAAGCCGTCTATCTTGTGGCGATCATGTA TAAGCTGGCCTCCTGCTGTTTGCTTTTCATAGGATTCTTAAATCCTCT CTTATCTCTTCCTCTCCTTGACTCCAGGGAAATATCCTTTCAACTCTC AGCACCTCATGAAGACGCGCGCTTAACTCCGG | 34008 |
| 6574 | TGGCTGACACATTCCTGGAGCACATGTGCCGCCTGGACATTGATTCA CCACCCATCACAGCCCGGAACACTGGCATCATCTGTACCATTGGCCC AGCTTCCCGATCAGTGGAGCTGAAGAAGGGAGCCACTCTCAAAATC ACGCTGGATAACGCCTACATGGAAAAGTGTGACG | 34009 |
| 1033 | GACATTTACATCCTGCCCAGCGACAACTCTGGACAAGTCAGTCCCCC AGAGTCTCCAACTGTGACCACTTCCTGGCAGTCTGAGAGCTTACCTG TGTCACTGTCAGCTAGCCAGAGTTGGCACACAGAAAGCCTGCCAGT GTCACTAGGCCCTGAGTCCTGGCAGCAGATTGCA | 34010 |
| 8789 | CCTCTGACTTGACCCAATGAAAGAAGCATATGGCACTTGTGAAGATA AATGTTACTCCTCCCTTTTTAATTGGAACTTCTGCTTAGGACCTGTGT ATGACGTTTCACCTGTGATCTGTTCTTTCGGTAGCCACTGACTTTGAG TTACAGGAAGGTCTCCGAAGATTTGTGTCAA | 34011 |
| 6392 | CTTCCCTGAGGAGGACGACCCCACCAACTGGCTGCGTTGCTACTACT ACGAAGACACCATCAGCACCATCAAGTCTGTGGCCTGGGAGGGAGG GGCCTGTCCAGCCTTCCTGCCATCCCTACGACCACTGCCCCCTCACAT CACCTTCTCATGGGTCCCTCTCCCACTCCAAAGC | 34012 |
| 6885 | ATTTATGATTTCAACATGGATACATATTTCAGTTCTTTCTTTTTCTCAC TATCTGAAAATACATTTCCCTCCCTCTCTTCCCCCCAATATCTCCCTT TTTTTCTCTCTTCCTCTATCTTCCAAACCCCACTTTCTCCCTCCTCCTT TTCCTGTGTTCTCTTAAGCAGATAGCAC | 34013 |
| 561 | CCCTTCCGGCTGGCCCCGCTCAGTCACCCGCAGCAGGCGTGCAGTTT CCCGGCTCTCCGCGCGGCCGGGGAAGGTCAGCGCCGTAATGGCGTT CTTGGCGTCGGGACCCTACCTGACCCATCAGCAAAAGGTGTTGCGGC TTTATAAGCGGGCGCTACGCCACCTCGAGTCGTG | 34014 |
| 7556 | ATACAAATTTGCCTTTGGCACAACAGATACCACTAAGTTCTACCCAG TTCTCCGCACAATCATTAGCTCAGGCAATTGGAAGCCAAATTGAAGA TGCCAGGCGTGCAGCGGAGCCCTCCTTAGTTGGCTTACCTCAGACTA TCAGTGGTGACAGTGGGGGAATGTCAGCAGTTT | 34015 |
| 8800 | TCCGTCCTCCAGGATCTGGGGAGAAAGAGCCCCATCCCTTCTCTCTC TGCCACCATTTCGGACACCCCGCAGGGACTCGTTTTGGGATTCGCAC TGACTTCAAGGAAGGACGCGAACCCTTCTCTGACCCCAGCTCGGGCG GCCACCTGTCTTTGCCGCGGTGACCCTTCTCTC | 34016 |
| 5781 | GTTTACTTCCCCTGCCAGCATTGGGGTGCTCTCTAAGCAACAGTAGG CGGAGAGTGGTCTGGCGTATTAAAAACAAAGGATCGTCAAGTGGGC CTTCCAGGCATTGCTTTGACTTAGTACATGTAGAGGATGTGGCAGT TCTCTCCGTCCCTGCCACTGCTGGTTTCTTTGTT | 34017 |

TABLE 2-continued

Illustrative Sequences Encoding IRES sequences

| Oligo-nucleotide Identifier | Sequence | SEQ ID NO: |
|---|---|---|
| 2930 | TATTTTAAGCCCAGTCTTCCCTGGGCCACCTTTAGCAGATCCTCGTGC GCCCCCGCCCCTGGCCGTGAAACTCAGCCTCTATCCAGCAGCGACG ACAAGTAAAGTGGCCCGCCGGTTTCTGAGCCTTCTGCCCTGCGGGA CACGGTCTGCACCCTGCCCGCGGCCACGGACC | 34018 |
| 3426 | CCAGCGGAAGTAATTCTTTCGACTGCCCCGGAACCCACCGGAGCAG GCAGCTGGGGGTGGGGGGCGGCCCTGGGATAGGGGCTGTGGCAGT ACGCGGGGACCCGGCTGCGGTGGCTGCGGGACTGACGAATGGAGAG GAGAAAACCTATGGTGGCTGTGAAGGACCTGATGCC | 34019 |
| 5800 | ATGGGGAAGGTGAAGGTCGGAGTCAACGGATTTGGTCGTATTGGGC GCCTGGTCACCAGGGCTGCTTTTAACTCTGGTAAAGTGGATATTGTT GCCATCAATGACCCCTTCATTGACCTCAACTACATGGTTTACATGTTC CAATATGATTCCACCCATGGCAAATTCCATGGC | 34020 |
| 27433 | CTGCCTCCCCCCGCTCCCGCTCCCCTGAGCCCAGCCAGACCCCGCG CCGCCCGCGCCCCGCTCGACTCCGGAGGCTCCCGCAGCCCCGGCGTC CGCCCCGCTGCCCCCTCCCCGGGGGCCATGGGGGCGCCCCCGGGCT ACCGGCCCTCAGCTTGGGTGCATCTCCTCCACC | 34021 |
| 424 | ATTTCTGGGAAGCAGTCGATATTATCTGTACGCCTAGAACAGTGCCC TCTGCAGCTGAATAACCCTTTTAACGAGTATTCCAAATTTGATGGCA AGGGTCATGTAGGTACAACAGCAACCAAGAAGATCGATGTCTACCT CCCTCTGCACTCGAGCCAGGACAGACTGCTGCCA | 34022 |
| 28259 | CTCTGGTGATACAGAAGAAAAGACAGTCTCCATTTTCAAACAGTCCC TCCTGGGAGAACACAGACAGGCAGAGGATTACAACACAAGGCAGCA AGCACTGGGAGACGAAAGTTTTGGCATCTGTTCCCTGGCTGTGCCAA GATGGGCGATTGGAGCTTCCTGGGAAATTTCCTG | 34023 |
| 6972 | GTCTACTATGTCTGAACTGTGGTTTCTTGTTTATCCTTTTTTCCTTAGT TGGACTGTAATGTATGGTCTGTCAACCTGTGAATCTTTAAAGTATGA TTCAGGTATTGTTGTATTCTTTACTGTGTAATAAAAAAGTTGAAAAA AATCTGGATCCTCTGTCTCCCTCGTCCCCGG | 34024 |
| 417 | TTTCGTGACCTTGTCCAGTAGAAGGCTATTTAATTTTCACAACTGCTT GAATTTTGACATACAAGATGAAGCAAGATGCCTCAAGAAATGCTGC CTACACTGTGGATTGTGAAGATTATGTGCATGTGGTAGAATTTAATC CCTTTGAGAATGGGGATTCAGGAAACCTAATTG | 34025 |
| 8182 | TGTCTGCACCAGCCGGCCTCCAGCCTGGCTGGACCCTGCTGCCTGTG TGGCCCGGAGCCAGAGGCCCCCACACTCCCAGCTGCTCTTCTACAGA TGCCATCAACGAGCAGGACTCTGGGTGGCTCCACTGTCTAAGGGCTC TGCGAGTGACCCGGCGGGCGAGCTCCGTGCTGC | 34026 |
| 7572 | CTTACGTAGTAATTACATTTCCTTGAAAAAACTATAGTGAATAGAAA TCCCTAGCCATTTCATTTTTTATGTTTTTAATGAAGATCTTTAAAATA CCATAGGTGGTAATCGTGGAAAATTTGAAAAATCTCATGTCAGTGTA TTAAGATGGTGGAGAAGTTTTTTTCTCCATTA | 34027 |
| 1415 | ATTCATGAAAATCCACTACTCCAGACAGACGGCTTTGGAATCCACCA GCTACATCCAGCTCCCTGAGGCAGAGTTGAGAATGGAGAGAATGTT ACCTCTCCTGGCTCTGGGGCTCTTGGCGGCTGGGTTCTGCCCTGCTGT CCTCTGCCACCCTAACAGCCCACTTGACGAGGA | 34028 |
| 7327 | GAGCTTCCAGGGATATTTGAGGCACCATCCCTGCCATTGCCGGGCAC TCGCGGCGCTGCTAACGGCCTGGTCACATGCTCTCCGGAGAGCTACG GGAGGGCGCTGGGTAACCTCTATCCGAGCCGCGGCCGCGAGGAGGA GGGAAAAGGCGAGCAAAAAGGAAGAGTGGGAGGA | 34029 |
| 705 | GCCCCCTCCCCTGACTATCAAAGCAGCGGCCGGCTGTTGGGGTCCAC CACGCCTTCCACCTGCCCCACTGCTTCTTCGCTTCTCTCTTGGAAAGT CCAGTCTCTCCTCGGCTTGCAATGGACCCCAACTGCTCCTGCGCCGC TGGTGTCTCCTGCACCTGCGCTGGTTCCTGCA | 34030 |
| 8561 | AGTCGCATAGTGGTTTTTCCGCTCGCGTCGCTGTGTGAAAGTTGGCT CGCCGCTCTTTGCACGCCCTCCCTGGAGGCCGACCCGAGACGCCAAG CTGGAGAGACCGTGCCTCCCCGAGGCCGGCCGCCCCGCGAGCACAG CCTCCGCCCCCGTTGCACTGCCGGGCTGGGCAAT | 34031 |

TABLE 2-continued

Illustrative Sequences Encoding IRES sequences

| Oligo-nucleotide Identifier | Sequence | SEQ ID NO: |
|---|---|---|
| 1679 | GGTGGCGGGAAGAGGAGGCGCGAGAATGGAGGTGGAGGCCGTCTG TGGTGGCGCGGGCGAGGTGGAGGCCCAGGACTCTGACCCTGCCCCT GCCTTCAGCAAGGCCCCCGGCAGCGCCGGCCACTACGAACTGCCGT GGGTTGAAAAATATAGGCCAGTAAAGCTGAATGAAAT | 34032 |
| 5635 | TATTTCCCTCTACTGAGTAAACCCTATCTGTGATTCCCCCAAACATCT GGCATGGCTCCCTTTTGTCCTTCCTGTGCCCTGCAAATATTAGCAAA GAAGCTTCATGCCAGGTTAGGAAGGCAGCATTCCATGACCAGAAAC AGGGACAAAGAAATCCCCCCTTCAGAACAGAGG | 34033 |
| 5583 | TGTTACTTAAGAATGCTTTCCAGGTGGAAAGTTCCTTAAGTTTGAGG CTTCAAATTCCATACAGCACATTAAAATCCCATTCATGAGTTTGAAA TACTGCTCTGTTGTCTTGGAAATACCAATCAGATTGTTGGCTGAAGT GATGTGGATAAAGAAGGGATCTTAGAAAAACTA | 34034 |
| 9027 | ACGAAGTTCCGGAAATGGAATTACCGAGTCAGATGAGAAACACAAG TCATCAATGAATTAACAAGCAACACATTGTCACATCCAGCTGTTGAA GAGTGGTTAACTCAGCTTGATCTCCGAAGACTCTTCTGCACCCCACC CCGCCCCCAACTGCTTTCCAAAGAGAAACAGAAA | 34035 |

The IRES may be of any length or size. For example, the IRES may be about 100 nucleotides to about 600 nucleotides in length (e.g., about 200, about 225, about 250, about 275, about 300, about 325, about 350, about 375, about 400, about 425, about 450, about 475, about 500, about 525, about 550, or about 575 nucleotides in length, or a range defined by any two of the foregoing values). In some embodiments, the IRES may be about 200 nucleotides to about 800 nucleotides in length (about 200, about 210, about 220, about 240, about 260, about 280, about 320, about 340, about 360, about 380, about 420, about 440, about 460, about 480, about 500, about 520, about 540, about 560, about 580, about 600, about 620, about 640, about 660, about 680, about 700, about 720, about 740, about 760, about 780, or about 800 nucleotides in length, or a range defined by any two of the foregoing values). In some embodiments, the IRES may be about 200 to about 400, about 400 to about 600, about 600 to about 700, or about 600 to about 800 nucleotides in length. In some embodiments, the IRES is about 210 nucleotides in length. In some embodiments, the IRES may be about 100 to about 3000 nucleotides in length.

In some embodiments, a circular RNA molecule comprises of an IRES sequence that consists of a sequence encoded by a DNA sequence of any one of SEQ ID NO: 1-228 or SEQ ID NO: 229-17201. In some embodiments, a circular RNA molecule comprises an IRES sequence encoded by a DNA sequence of any one of SEQ ID NO: 1-228 or SEQ ID NO: 229-17201, wherein the IRES sequence additionally comprises up to 1000 additional nucleotides. In some embodiments, the IRES sequence is encoded by a sequence of any one of SEQ ID NO: 1-228 or SEQ ID NO: 229-17201 and additionally comprises up to 1000 additional nucleotides located at the 5' end of that sequence. In some embodiments, the IRES sequence is encoded by a sequence of any one of SEQ ID NO: 1-228 or SEQ ID NO: 229-17201 and additionally comprises up to 1000 additional nucleotides located at the 3' end of that sequence. In some embodiments, the IRES sequence is encoded by a sequence of any one of SEQ ID NO: 1-228 or SEQ ID NO: 229-17201 and additionally comprises up to 1000 additional nucleotides located at the 5' end of that sequence and up to 1000 additional nucleotides located at the 5' end of that sequence.

In some embodiments, a circular RNA molecule comprises an internal ribosome entry site (IRES) sequence region, wherein the IRES sequence region comprises a sequence encoded by a DNA sequence of any one of SEQ ID NO: 1-228 or SEQ ID NO: 229-17201, and wherein the sequence encoded by a DNA sequence of any one of SEQ ID NO: 1-228 or SEQ ID NO: 229-17201 has a minimum free energy (MFE) of less than −18.9 kJ/mol and a melting temperature of at least 35.0° C.

In some embodiments, a circular RNA molecule comprises an internal ribosome entry site (IRES) sequence region, wherein the IRES sequence region comprises a sequence encoded by a DNA sequence of any one of SEQ ID NO: 1-228 or SEQ ID NO: 229-17201, and wherein the IRES sequence region has a minimum free energy (MFE) of less than −18.9 kJ/mol and a melting temperature of at least 35.0° C., over its entire length.

In some embodiments, a circular RNA molecule comprises an internal ribosome entry site (IRES) sequence region, wherein the IRES sequence region comprises a sequence encoded by a DNA sequence of any one of SEQ ID NO: 1-228 or SEQ ID NO: 229-17201, and additionally comprises up to 1000 additional nucleotides located at the 5' end of and up to 1000 additional nucleotides located at the 5' end, and wherein the IRES sequence region has a minimum free energy (MFE) of less than −18.9 kJ/mol and a melting temperature of at least 35.0° C., over its entire length.

In some embodiments, the recombinant circular RNA molecule comprises a protein-coding nucleic acid sequence operably linked to the IRES in a non-native configuration. Any protein or polypeptide of interest (e.g., a peptide, polypeptide, protein fragment, protein complex, fusion protein, recombinant protein, phosphoprotein, glycoprotein, or lipoprotein) may be encoded by the protein-coding nucleic acid sequence. In some embodiments, the protein coding-nucleic acid sequence encodes a therapeutic protein. Examples of suitable therapeutic proteins include cytokines, toxins, tumor suppressor proteins, growth factors, hormones, receptors, mitogens, immunoglobulins, neuropeptides, neurotransmitters, and enzymes. Alternatively, the protein-coding nucleic acid sequence can encode an antigen of a pathogen (e.g., a bacterium, virus, fungus, protist, or parasite), and the circRNA can be used as, or as one component of, a vaccine. Therapeutic proteins, and examples thereof, are further described in, e.g., Dimitrov, D. S., *Methods Mol Biol.*, 899: 1-26 (2012); and Lagassé et al., *F1000Research*, 6: 113 (2017).

Ideally, the IRES is "in-frame" with respect to the protein-coding nucleic acid sequence, that is, the IRES is positioned in the circRNA molecule in the correct reading frame for the encoded protein. Examples of IRES elements that were found to be in-frame with one or more coding sequences are set forth in SEQ ID NO: 28984-32953. In some embodiments, however, the IRES may be "out of frame" with respect to the protein-coding nucleic acid sequence, such that the position of the IRES disrupts the ORF of the protein-coding nucleic acid sequence. In other embodiments, the IRES may overlap with one or more ORFs of the protein-coding nucleic acid sequence. In addition, while in some embodiments the protein-coding nucleic acid sequence comprises at least one stop codon, in other embodiments the protein-coding nucleic acid sequence may lack a stop codon. The instant inventors have found that a circRNA molecule comprising a protein-coding nucleic acid sequence having an in frame non-native IRES and lacking a stop codon can initiate a recursive (i.e., infinite loop) translation mechanism. Such recursive translation may produce a concatenated protein multimer (e.g., >200 kDa). This particular circRNA design allows for the production of repeating ORF units up to 10 times the size of the single ORF. Without being bound to any particular theory, use of the circRNAs described herein for recursive gene encoding may represent a novel "data compression" algorithm for genes, addressing the gene size limitation associated with many current gene therapy applications.

In some embodiments, the IRES comprises (i) at least one RNA secondary structure element and (ii) a sequence that is complementary to an 18S rRNA. In some embodiments, the IRES comprises (i) at least one RNA secondary structure element and (ii) a sequence that is complementary to an 18S rRNA, wherein the RNA secondary structure of the IRES is formed from the nucleotides at about position 40 to about position 60 of the IRES, wherein the first nucleic acid at the 5' end of the IRES is considered to be position 1. The relative location of the at least one RNA secondary structure and the sequence that is complementary to an 18S RNA may vary. For example, in some embodiments, the IRES comprises (i) at least one RNA secondary structure element and (ii) a sequence that is complementary to an 18S rRNA, and wherein the at least one RNA secondary structure is located 5' to the sequence that is complementary to an 18S rRNA (See FIG. 4K). In some embodiments, the IRES comprises (i) at least one RNA secondary structure element and (ii) a sequence that is complementary to an 18S rRNA, and wherein the at least one RNA secondary structure element is located 3' to the sequence that is complementary to an 18S rRNA (See FIG. 19B).

DNA Molecules, Vectors, and Cells

In some embodiments, the disclosure provides a DNA molecule comprising a nucleic acid sequence encoding any one of the recombinant circRNA molecules disclosed herein. Accordingly, described herein are DNA sequences that may be used to encode circular RNAs. In some embodiments, a DNA sequence encodes a circular RNA comprising an IRES. In some embodiments, a DNA sequence encodes a circular RNA comprising a protein-coding nucleic acid. In some embodiments, the DNA sequence encodes a circular RNA molecule; wherein the circular RNA molecule comprises a protein-coding nucleic acid sequence and an internal ribosome entry site (IRES) operably linked to the protein-coding nucleic acid sequence in a non-native configuration. In some embodiments, the DNA sequence encodes a protein coding-nucleic acid sequence, wherein the protein is a therapeutic protein.

The DNA sequences disclosed herein may, in some embodiments, comprise at least one non-coding functional sequence. For example, the non-coding functional sequence may be a microRNA (miRNA) sponge. A microRNA sponge may comprise a complementary binding site to a miRNA of interest. In some embodiments, a sponge's binding sites are specific to the miRNA seed region, which allows them to block a whole family of related miRNAs. In some embodiments, the miRNA sponge is selected from any one of the miRNA sponges shown in Table 3, below.

TABLE 3 miRNA sponges

| miRNA | Binding sites | Cell context |
|---|---|---|
| 92, empty | four bulged sites | rat cerebellar neuronal cultures |
| miR-155, empty | eight bulged sites | B cell lymphoma cell line |
| 15a, empty | two perfect sites | human prostate cell lines, xenograft |
| 113, empty | two perfect sites | mouse cardiac myocytes, heart |
| 326, empty | seven bulged sites | tail vein injection, TH cells |
| 16, 20,21, 30-5p, CXCR4 | tour to nine bulged sites | mammalian cell lines |
| 16, 20, CXCR4 | four to nine bulged sites | mammalian cell lines |
| let-7, 22,124, 125, 132, 143, empty | five to seven bulged sties | rat hippocampal neuronal cultures |
| 183, CXCR4 | seven bulged sites | HEK293T cell line |
| A.t. 156, 319, empty | one bulged site | transgenic *Arabidopsis* plants |
| 16, CXCR4 | seven to nine bulged sites | human multiple myeloma cell lines, xenograft |
| 16, 23a, 142-3p. 221,223, nonspecific | four perfect or four bulged sites | U937 cell line, mouse hematopoietic stem/progenitor cells, transplant |
| KSHV miR-K1, CXCR4, empty | nine bulged sites | BC-3 B cell lymphoma cell line |

TABLE 3-continued miRNA sponges

| miRNA | Binding sites | Cell context |
| --- | --- | --- |
| 21, 140-3p, 140-5p, empty | one to two perfect sites | mammalian cell lines |
| 133, empty | three perfect sites | mouse cardiac myocytes |
| 204, 211, empty | two perfect sites | ST2 cell line, osteogenic and adipogenic differentiation |
| 96/182/183, empty | four bulged sites each | mouse retina |
| let-7, 16, empty | six to nine bulged sites | lung cancer cell line |
| D.m. 7, 8, 9a, 276a | 10 bulged sites | Transgenic fruitflies |
| 9, 10b, CXCR4 | eight bulged sites | 4T1 breast cancer cell line, xenograft |
| herpesvirus miR-K12-7, K12-8, BART1-5p, BART4, empty | six bulged sites | human B cell lines |
| 144, 451, empty | four perfect sites | mouse hematopoietic stem/progenitor cells, transplant |
| let-7, 29, 125, let-7/125, 128, empty | 16 bulged sites | neural stem cells |
| 21, empty | two perfect sites | mouse cardiocytes |
| 18a, 19b, 20a, nonspecific | one perfect site | K562 cell line |
| 145/146, empty | eight to nine bulged sites each | mouse hematopoietic stem/progenitor cells, transplant |
| 31, CXCR4 | seven bulged sites | MCF7-Ras breast cancer cell line, xenograft |

In some embodiments, the non-coding sequence may be an RNA binding protein site. RNA binding proteins and binding sites therefore are listed in numerous databases known to those of skill in the art, including RBPDB (rbpdb.ccbr.utoronto.ca). In some embodiments, the RNA binding protein comprises one or more RNA-binding domains, selected from RNA-binding domain (RBD, also known as RNP domain and RNA recognition motif, RRM), K-homology (KH) domain (type I and type II), RGG (Arg-Gly-Gly) box, Sm domain; DEAD/DEAH box (SEQ ID NOs: 34036 and 34037), zinc finger (ZnF, mostly C-x8-X-x5-X-x3-H (SEQ ID NO: 34038)), double stranded RNA-binding domain (dsRBD), cold-shock domain; Pumilio/FBF (PUF or Pum-HD) domain, and the Piwi/Argonaute/Zwille (PAZ) domain.

In some embodiments, the DNA sequence comprises an aptamer. Aptamers are short, single-stranded DNA molecules that can selectively bind to a specific target. The target may be, for example, a protein, peptide, carbohydrate, small molecule, toxin, or a live cell. Some aptamers can bind DNA, RNA, self-aptamers or other non-self aptamers. Aptamers assume a variety of shapes due to their tendency to form helices and single-stranded loops. Illustrative DNA and RNA aptamers are listed in the Aptamer database (scicrunch.org/resources/Any/record/nlx_144509-1/SCR_001781/resolver?q=*&l=).

In some embodiments, the DNA sequence encodes a circular RNA molecule that comprises between about 200 nucleotides and about 10,000 nucleotides.

In some embodiments, the DNA sequence encodes a circular RNA molecule that comprises a spacer between the IRES and a start codon of the protein-coding nucleic acid sequence. The spacer may be of any length. For example, in some embodiments, the length of the spacer is selected to optimize translation of the protein-coding nucleic acid sequence.

In some embodiments, the DNA sequence encodes a circular RNA molecule comprising an IRES that is configured to promote rolling circle translation. In some embodiments, the DNA sequence encodes a circular RNA comprising a protein-coding nucleic acid sequence that lacks a stop codon. In some embodiments, the DNA sequence encodes a circular RNA molecule comprising (i) an IRES that is configured to promote rolling circle translation, and (ii) a protein-coding nucleic acid sequence that lacks a stop codon.

The DNA sequences described herein may be comprised in one or more vectors. For example, in some embodiments, a viral vector comprises a DNA sequence encoding a circular RNA. The viral vector may be, for example, an adeno-associated virus (AAV) vector, an adenovirus vector, a retrovirus vector, a lentivirus vector, a vaccinia or a herpesvirus vector.

In some embodiments, the viral vector is an AAV. As used herein, the term "adeno-associated virus" (AAV), includes but is not limited to, AAV1, AAV2, AAV3 (including types 3 A and 3B), AAV4, AAV5, AAV6, AAV7, AAV8, AAV9, AAV10, AAV11, AAV12, avian AAV, bovine AAAV, canine AAV, equine AAV, ovine AAV, and any other AAV now known or later discovered. In some embodiments, the AAV vector may be a modified form (i.e., a form comprising one or more amino acid modifications relative thereto) of one or more of AAV1, AAV2, AAV3 (including types 3 A and 3B), AAV4, AAV5, AAV6, AAV7, AAV8, AAV9, AAV10, AAV11, AAV12, avian AAV, bovine AAV, canine AAV, equine AAV, or ovine AAV. Various AAV serotypes and variants thereof are described, e.g., BERNARD N. FIELDS et al, VIROLOGY, volume 2, chapter 69 (4th ed., Lippincott-Raven Publishers). A number of relatively new AAV serotypes and clades have been identified (see, e.g., Gao et al. (2004) J Virology 78:6381-6388; Moris et al. (2004) Virology 33-:375-383). The genomic sequences of various serotypes of AAV, as well as the sequences of the native terminal repeats (TRs), Rep proteins, and capsid subunits are known in the art. Such sequences may be found in the literature or in public databases such as the GenBank® Database. See, e.g., GenBank Accession Numbers NC_044927, NC_002077, NC_001401, NC_001729, NC 001863, NC 001829, NC_001862, NC_000883, NC_001701, NC_001510, NC_006152, NC_006261, AF063497, U89790, AF043303, AF028705, AF028704, J02275, JO 1901, J02275, X01457, AF288061, AH009962, AY028226, AY028223, NC 001358, NC 001540, AF513851, AF513852, AY530579; the disclosures of which are incorporated by reference herein for teaching parvovirus and AAV nucleic acid and amino acid sequences. See also, e.g., Srivistava et al. (1983) J Virology 45:555; Chiorini et al. (1998) J. Virology 71:6823; Chiorini et al (1999) J Virology 73:1309; Bantel-Schaal et al. (1999) J. Virology 73:939; Xiao et al. (1999) J. Virology 73:3994; Muramatsu et al. (1996) Virology 221:208; Shade et al. (1986) J Virol. 58:921; Gao et al. (2002) Proc. Nat. Acad. Sci. USA 99: 1 1854; Moris et al. (2004) Virology 33-:375-383; international patent publications WO 00/28061, WO 99/61601, WO 98/11244; and U.S. Pat. No. 6,156,303; the disclosures of which are incorporated by reference herein.

In some embodiments, a DNA sequence described herein is comprised in an AAV2 vector, or a variant thereof. In some embodiments, a DNA sequence described herein is comprised an AAV4 vector, or a variant thereof. In some embodiments, a DNA sequence described herein is comprised in an AAV8 vector, or a variant thereof. In some embodiments, a DNA sequence described herein is comprised in an AAV9 vector, or a variant thereof.

In some embodiments, a DNA sequence described herein is comprised in a viral-like particle (VLP). Viral like particles are molecules that closely resemble viruses, but are non-infectious because they contain little or no viral genetic material. They can be naturally occurring or synthesized through the individual expression of viral structural proteins, which can then self-assemble into a virus-lie structure. Combinations of structural capsid proteins from different viruses can be used to create VLPs. For example VLPs may be derived from the, AAVs, retrovirus, Flaviviridae, paramyoxoviridae, or bacteriophages. VLPs can be produced in multiple cell culture systems, including bacteria, mammalian cell lines, insect cell lines, yeast and plant cells.

In some embodiments, a DNA sequence described herein is comprised in a non-viral vector. The non-viral vector may be, for example, a plasmid comprises the DNA sequence. In some embodiments, the non-viral vector is a closed-ended DNA. A closed-ended DNA is a non-viral, capsid-free DNA vector with covalently closed ends (see, e.g., WO2019/169233). In some embodiments, a mini-intronic plasmid vector comprises a DNA sequence described herein. Mini-intronic plasmids are expression systems that contain a bacterial replication origin and selectable marker maintaining the juxtaposition of the 5' and the 3' ends of transgene expression cassette as in a minicircle (see, e.g., Lu, J., et al., Mol Ther (2013) 21(5) 954-963).

In some embodiments, a DNA sequence described herein is comprised in a lipid nanoparticle. Lipid nanoparticles (or LNPs) are submicron-sized lipid emulsions, and may offer one or more of the following advantages: (i) control and/or targeted drug release, (ii) high stability, (iii) biodegradability of the lipids used, (iv) avoid organic solvents, (v) easy to scale-up and sterilize, (vi) less expensive than polymeric/surfactant based carriers, (vii) easier to validate and gain regulatory approval. In some embodiments, the lipid nanoparticles range in diameter between about 10 and about 1000 nm.

In some embodiments, a DNA sequence encodes a circular RNA molecule, wherein the circular RNA molecule comprises a protein-coding nucleic acid sequence and an internal ribosome entry site (IRES) operably linked to the protein-coding nucleic acid sequence in a non-native configuration wherein the IRES comprises: at least one RNA secondary structure; and a sequence that is complementary to an 18S ribosomal RNA (rRNA).

In some embodiments, a DNA sequence encodes a circular RNA molecule, wherein the circular RNA molecule comprises a protein-coding nucleic acid sequence and an internal ribosome entry site (IRES) operably linked to the protein-coding nucleic acid sequence in a non-native configuration wherein the IRES comprises: at least one RNA secondary structure element; and a sequence that is complementary to an 18S ribosomal RNA (rRNA); wherein the IRES has a minimum free energy (MFE) of less than −18.9 kJ/mol and a melting temperature of at least 35.0° C.; and wherein the RNA secondary structure element is formed from the nucleotides at about position 40 to about position 60 of the IRES, wherein the first nucleic acid at the 5' end of the IRES is considered to be position 1.

In some embodiments, a DNA sequence comprises a nucleic acid sequence encoding a circular RNA molecule; wherein the circular RNA molecule comprises a protein-coding nucleic acid sequence and an internal ribosome entry site (IRES) operably linked to the protein-coding nucleic acid sequence in a non-native configuration; wherein the IRES is encoded by any one of the nucleic acid sequences listed of SEQ ID NO: 1-228 or SEQ ID NO: 229-17201, or a nucleic acid sequence that is at least 90% or at least 95% identical thereto.

Also provided herein are cells comprising a recombinant circRNA molecule, a DNA molecule, or a vector described herein. Any prokaryotic or eukaryotic cell that can be contacted with and stably maintain the recombinant circRNA molecule, DNA molecule encoding the recombinant circRNA molecule, or vector comprising the recombinant circRNA molecule may be used in the context of the present disclosure. Examples of prokaryotic cells include, but are not limited to, cells from the genera *Bacillus* (such as *Bacillus subtilis* and *Bacillus brevis*), *Escherichia* (such as *E. coli*), *Pseudomonas, Streptomyces, Salmonella*, and *Erwinia*. In some embodiments, the host cell is a eukaryotic cell. Suitable eukaryotic cells are known in the art and include, for example, yeast cells, insect cells, and mammalian cells. Examples of yeast cells include those from the genera *Hansenula, Kluyveromyces, Pichia, Rhinosporidium, Saccharomyces*, and *Schizosaccharomyces*. Suitable insect cells include Sf-9 and HIS cells (Invitrogen, Carlsbad, Calif.) and are described in, for example, Kitts et al., *Biotechniques*, 14: 810-817 (1993); Lucklow, *Curr. Opin. Biotechnol.*, 4: 564-572 (1993); and Lucklow et al., *J. Virol.*, 67: 4566-4579 (1993).

In some embodiments, the cell is a mammalian cell. A number of mammalian cells are known in the art, many of which are available from the American Type Culture Collection (ATCC, Manassas, Va.). Examples of mammalian cells include, but are not limited to, HeLa cells, HepG2 cells, Chinese hamster ovary cells (CHO) (e.g., ATCC No. CCL61), CHO DHFR-cells (Urlaub et al., *Proc. Natl. Acad. Sci. USA*, 97: 4216-4220 (1980)), human embryonic kidney (HEK) 293 or 293T cells (e.g., ATCC No. CRL1573), and 3T3 cells (e.g., ATCC No. CCL92). Other mammalian cell lines are the monkey COS-1 (e.g., ATCC No. CRL1650) and COS-7 cell lines (e.g., ATCC No. CRL1651), as well as the CV-1 cell line (e.g., ATCC No. CCL70). Further exemplary mammalian host cells include primate cell lines and rodent cell lines, including transformed cell lines. Normal diploid cells, cell strains derived from in vitro culture of primary tissue, as well as primary explants also are suitable. Other mammalian cell lines include, but are not limited to, mouse neuroblastoma N2A cells, HeLa, mouse L-929 cells, and BHK or HaK hamster cell lines, all of which are available from the American Type Culture Collection (ATCC; Manassas, Va.). Methods for selecting mammalian cells and methods for transformation, culture, amplification, screening, and purification of such cells are well known in the art (see, e.g., Ausubel et al., supra). In some embodiments, the mammalian cell is a human cell.

Method of Producing a Protein

The disclosure further provides a method of producing a protein in a cell, which comprises contacting a cell with the above-described recombinant circular RNA molecule, the above-described DNA molecule comprising a nucleic acid sequence encoding the recombinant circRNA molecule, or a vector comprising the recombinant circRNA molecule under conditions whereby the protein-coding nucleic acid sequence is translated and the protein is produced in the cell.

In some embodiments, a method of producing a protein in a cell comprises contacting a cell with a DNA sequence described herein, or a vector comprising the DNA sequence, under conditions whereby the protein-coding nucleic acid sequence is translated and the protein is produced in the cell. Also provided is a protein produced by the disclosed methods.

In some embodiments, production of the protein is tissue-specific. For example, the protein may be selectively produced in one or more of the following tissues: muscle, liver, kidney, brain, lung, skin, pancreas, blood, or heart.

In some embodiments, the protein is expressed recursively in the cell.

In some embodiments, the half-life of the circular RNA in the cell is about 1 to about 7 days. For example, the half-life of the circular RNA may be about 1, about 2, about 3, about 4, about 5, about 6, about 7, or more days.

In some embodiments, the protein is produced in the cell for at least about 10%, at least about 20%, or at least about 30% longer than if the protein-coding nucleic acid sequence is provided to the cell using a viral vector encoding a linear RNA or as a linear RNA.

In some embodiments, the protein is produced in the cell at a level that is at least about 10%, at least about 20%, or at least about 30% higher than if the protein-coding nucleic acid sequence is provided to the cell using a viral vector or as a linear RNA.

Use of the IRES sequences described herein to express a protein from a circular RNA may, in some embodiments, allow for continued expression of a protein from the circular RNA in a cell even under stress conditions. In response to one or more stress conditions, production of proteins from linear RNA is often suppressed. Accordingly, in some embodiments, circRNA can be used as an alternative for production of proteins from linear RNAs during stress conditions. In some embodiments, a protein expressed from a circular RNA in a cell is expressed under one or more stress conditions. In some embodiments, expression of a protein from a circular RNA in a cell is not substantially disrupted when the cell is exposed to one or more stress conditions. For example, exposure of the cell to one or more stress conditions may change expression of a protein from a circular RNA by less than 15%, less than 10%, less than 5%, less than 3%, less than 1%, or less than 0.5%. In some embodiments, a protein expressed from a circular RNA is expressed at a level under one or more stress conditions that is substantially the same as the level expressed in the same cell in the absence of the one or more stress conditions. In some embodiments, the level of expression of a protein from a circular RNA in a cell is at least about 70%, at least about 75%, at least about 80%, at least about 85%, at least about 90%, at least about 95%, or at least about 99%, relative to the level of expression in the absence of the one or more stress conditions. A non-limiting list of conditions which may cause cellular stress include changes in temperature (including exposure to extreme temperatures and/or heat shock), exposure to toxins (including viral or bacterial toxins, heavy metals, etc.), exposure to electromagnetic radiation, mechanical damage, viral infection, etc.

In some embodiments, the circRNAs described herein (including components thereof, such as the IRES sequences) facilitate cap-independent translation activity from the circRNA. Canonical translation via a cap-independent mechanism may be reduced in some human diseases. Accordingly, the use of circRNAs to express proteins may be particularly helpful for treating such diseases. In some embodiments, use of the circRNAs described herein facilitates cap-independent translation activity from the circRNA under conditions wherein cap-dependent translation is reduced or turned-off in a cell.

As discussed above, translation of the protein-coding nucleic acid sequence may occur in an infinite loop (i.e., recursively) when the IRES is in-frame with the protein-coding nucleic acid sequence and the protein-coding sequence lacks a stop codon. Thus, in some embodiments, the method of producing a protein in a cell produces a concatenated protein.

Any prokaryotic or eukaryotic host cell described herein may be contacted with the recombinant circRNA molecule or a vector comprising the circRNA molecule. The host cell may be a mammalian cell, such as a human cell. In some embodiments, the cell is in vivo. In some embodiments, the cell is in vitro. In some embodiments, the cell is ex vivo. In some embodiments, the cell is in a mammal, such as a human.

In some embodiments, regardless of cell type chosen, 5' cap-dependent translation is impaired in the cell (e.g., decreased, reduced, inhibited, or completely obliterated). In some embodiments, there is no substantial 5' cap-dependent translation in the cell.

The recombinant circular RNA molecule, a DNA molecule encoding same, or vectors comprising same, may be introduced into a cell by any method, including, for example, by transfection, transformation, or transduction. The terms "transfection," "transformation," and "transduction" are used interchangeably herein and refer to the introduction of one or more exogenous polynucleotides into a host cell by using physical or chemical methods. Many transfection techniques are known in the art and include, for example, calcium phosphate DNA co-precipitation (see, e.g., Murray E. J. (ed.), *Methods in Molecular Biology*, Vol. 7, Gene Transfer and Expression Protocols, Humana Press (1991)); DEAE-dextran; electroporation; cationic liposome-mediated transfection; tungsten particle-facilitated microparticle bombardment (Johnston, *Nature,* 346: 776-777 (1990)); strontium phosphate DNA co-precipitation (Brash et al., Mol. Cell. Biol., 7: 2031-2034 (1987); and magnetic nanoparticle-based gene delivery (Dobson, J., *Gene Ther,* 13 (4): 283-7 (2006)).

Naked RNA, DNA molecules encoding circular RNA molecules, or vectors comprising the circular RNAs or DNAs encoding circular RNAs may be administered to cells in the form of a composition. In some embodiments, the composition comprises a pharmaceutically acceptable carrier. The choice of carrier will be determined in part by the particular circular RNA molecule, DNA sequence, or vector and type of cell (or cells) into which the circular RNA molecule, DNA sequence, or vector is introduced. Accordingly, a variety of formulations of the composition are possible. For example, the composition may contain preservatives, such as, for example, methylparaben, propylparaben, sodium benzoate, and benzalkonium chloride. A mixture of two or more preservatives optionally may be used. In addition, buffering agents may be used in the composition. Suitable buffering agents include, for example, citric acid, sodium citrate, phosphoric acid, potassium phosphate, and various other acids and salts. A mixture of two or more buffering agents optionally may be used. Methods for preparing compositions for pharmaceutical use are known to those skilled in the art and are described in more detail in, for example, Remington: The Science and Practice of Pharmacy, Lippincott Williams & Wilkins; 21st ed. (May 1, 2005).

In some embodiments, the composition containing the recombinant circular RNA molecule, DNA sequence, or vector, can be formulated as an inclusion complex, such as cyclodextrin inclusion complex, or as a liposome. Liposomes can be used to target host cells or to increase the half-life of the circular RNA molecule. Methods for preparing liposome delivery systems are described in, for example, Szoka et al., Ann. Rev. Biophys. Bioeng., 9: 467 (1980), and U.S. Pat. Nos. 4,235,871; 4,501,728; 4,837,028; and 5,019,369. The recombinant circRNA molecule may also be formulated as a nanoparticle.

A host cell can be contacted in vivo or in vitro with a recombinant circRNA molecule, a DNA sequence, or a vector, or compositions containing any of the foregoing. The term "in vivo" refers to a method that is conducted within living organisms in their normal, intact state, while an "in vitro" method is conducted using components of an organism that have been isolated from its usual biological context. When the method is conducted in vivo, in some embodiments the production of the protein is tissue-specific. By "tissue-specific" is meant that the protein is produced in only a subset of tissue types within an organism, or is produced at higher levels in a subset of tissue types relative to the baseline expression across all tissue types. The protein may be produced in any tissue type, such as, for example, tissues of muscle, liver, kidney, brain, lung, skin, pancreas, blood, or heart.

Inhibiting circRNA Translation

The disclosure also provides an oligonucleotide molecule comprising a nucleic acid sequence that hybridizes to an internal ribosome entry site (IRES) present on a circular RNA molecule and inhibits translation of the circular RNA molecule. In some embodiments, the circular RNA molecule is a naturally occurring circular RNA molecule. In some embodiments, the circular RNA molecule is a recombinant circular RNA molecule, such as the recombinant circRNA molecule described herein. In some embodiments, the recombinant circRNA molecule may comprise a protein-coding nucleic acid sequence and an IRES operably linked to the protein-coding nucleic acid sequence (optionally, in a non-native configuration), wherein the IRES comprises at least one RNA secondary structure; and a sequence that is complementary to an 18S ribosomal RNA (rRNA); and wherein the IRES has a minimum free energy (MFE) of less than −18.9 kJ/mol and a melting temperature of at least 35.0° C., as described herein. In some embodiments, the recombinant circRNA molecule may comprise a protein-coding nucleic acid sequence and an IRES operably linked to the protein-coding nucleic acid sequence (optionally, in a non-native configuration); wherein the IRES is encoded by any one of the nucleic acid sequences listed in SEQ ID NO: 1-228 or SEQ ID NO: 229-17201, or a nucleic acid sequence that is at least 90% or at least 95% identical thereto.

The oligonucleotide that hybridizes to the IRES on a recombinant circRNA molecule may be of any type and size. In some embodiments, the oligonucleotide may be about 8 to about 80 nucleotides in length, such as about 15 to about 30 nucleotides in length. In some embodiments, the oligonucleotide may be about 20, about 22, or about 24 nucleotides in length. In some embodiments, the oligonucleotide may be an antisense oligonucleotide (also referred to as "ASO"). The term "antisense oligonucleotide," as used herein, refers to a short, synthetic, single-stranded oligodeoxynucleotide or oligodeoxyribonucleotide which is complementary to a target RNA sequence and can reduce, restore, or modify protein expression through several distinct mechanisms (Rinaldi, C., Wood, M., Nat Rev Neurol, 14: 9-21 (2018); Crooke, S. T., Nucleic Acid Ther., 27: 70-77 (2017); and Chan et al., Clin. Exp. Pharmacol. Physiol. 33: 533-540 (2006)). In some embodiments, the antisense oligonucleotide may be a locked nucleic acid oligonucleotide (LNA). The term "locked nucleic acid (LNA)" refers to oligonucleotides that contain one or more nucleotide building blocks in which an extra methylene bridge fixes the ribose moiety either in the C3'-endo (beta-D-LNA) or C2'-endo (alpha-L-LNA) conformation (Grunweller A, Hartmann R K, BioDrugs, 21(4): 235-243 (2007)). In some embodiments, the oligonucleotide is a small interfering RNA (siRNA), small hairpin RNA (shRNA), CRISPR (sgRNA), or micro RNA (miRNA).

The oligonucleotide may comprise one or more modifications that enhance hybridization of the oligonucleotide to the IRES of the circRNA molecule and/or inhibition of translation of the circRNA molecule. The modification may be at the 5' or at the 3' end of the oligonucleotide. Suitable modifications include, but are not limited to, a modified internucleoside linkage, a modified sugar, or a modified nucleobase. In some embodiments, the oligonucleotide may be conjugated to a fluorophore (e.g., Cy3, FAM, Alexa 488, etc.) or to another molecule (e.g., biotin, alkaline phosphatase, antibody, nucleic acid aptamer, peptide, etc.). In some embodiments, the oligonucleotide may be labeled with a peptide or protein, for example using CLICK chemistry. It will be appreciated that the naturally occurring internucleoside linkage of RNA and DNA is a 3' to 5' phosphodiester linkage. Oligonucleotides having one or more modified, i.e. non-naturally occurring, internucleoside linkages are known to exhibit desirable properties such as, for example, enhanced cellular uptake, enhanced affinity for target nucleic acids, and increased stability in the presence of nucleases. Modified internucleoside linkages include, for example, internucleoside linkages that retain a phosphorus atom as well as internucleoside linkages that do not have a phosphorus atom. Representative phosphorus-containing internucleoside linkages include, but are not limited to, phosphodiesters, phosphotriesters, methylphosphonates, phosphoramidate, and phosphorothioates. Methods of preparing phosphorous-containing and non-phosphorous-containing linkages are well known.

In some embodiments, the oligonucleotide molecule may comprise a modified backbone. Oligonucleotides having modified backbones include those that retain a phosphorus atom in the backbone and those that do not have a phosphorus atom in the backbone. Modified oligonucleotides that do not have a phosphorus atom in their internucleoside backbone may be referred to as "oligonucleosides." Examples of modified oligonucleotide backbones include, but are not limited to, phosphorothioates, chiral phosphorothioates, phosphorodithioates, phosphotriesters, aminoalkylphosphotri-esters, methyl and other alkyl phosphonates including 3'-alkylene phosphonates, 5'-alkylene phosphonates and chiral phosphonates, phosphinates, phosphoramidates including 3'-amino phosphoramidate and aminoalkylphosphoramidates, thiono-phosphoramidates, thionoalkylphosphonates, thionoalkylphospho-triesters, selenophosphates and boranophosphates having normal 3'-5' linkages, 2'-5' linked analogs of these, and those having inverted polarity wherein one or more internucleotide linkages is a 3' to 3', 5' to 5', or 2' to 2' linkage.

The oligonucleotide molecule may further comprise one or more nucleotides having modified sugar moieties. Sugar modifications may impart nuclease stability, binding affinity or some other beneficial biological property to the oligonucleotide. The furanosyl sugar ring of a nucleoside can be modified in a number of ways including, but not limited to, addition of a substituent group, particularly at the 2' position; bridging of two non-geminal ring atoms to form a bicyclic nucleic acid (BNA); and substitution of an atom or group such as —S—, —N(R)— or —C($R^1$)($R^2$) for the ring oxygen at the 4'-position. Modified sugars include, but are not limited to: substituted sugars, especially 2'-substituted sugars having a 2'-F, 2'-$OCH_2$ (2'-OMe) or a 2'-O($CH_2$)2-$OCH_3$ (2'-O-methoxyethyl or 2'-MOE) substituent group; and bicyclic modified sugars (BNAs), having a 4'-($CH_2$)n-O-2' bridge, where n=1 or n=2. Methods for the preparation of modified sugars are well known to those skilled in the art.

In some embodiments, the oligonucleotide may be chemically modified at its 5' and/or its 3' end. In other words, one or more moieties may be chemically (e.g., covalently) linked to the 5' and/or 3' end of the oligonucleotide molecule. Such modifications include, for example, chemical linkage of protein or sugar moieties to the 5' and/or 3' end of the oligonucleotide molecule. Other modifications that enhance oligonucleotide affinity for target nucleic acids and/or increase oligonucleotide stability are known in the art (see, e.g., U.S. Patent Application Publication US 2019/0323013) and may be employed in the context of the present disclosure.

The disclosure also provides a method of inhibiting translation of a protein-coding nucleic acid sequence present on a circular RNA molecule, which method comprises contacting the circular RNA molecule with the above-described oligonucleotide molecule, whereby the oligonucleotide molecule hybridizes to the RNA secondary structure and/or the nucleic acid sequence complementary to 18S rRNA present on the IRES of the circular RNA molecule and inhibits translation of the circular RNA molecule.

In some embodiments, the oligonucleotide can hybridize to either the RNA secondary structure element or the nucleic acid sequence that is complementary to 18S rRNA present on the IRES. In other embodiments, the oligonucleotide can hybridize to both the RNA secondary structure element and the nucleic acid sequence that is complementary to 18S rRNA. For example, a first oligonucleotide may hybridize to the RNA secondary structure element and a second oligonucleotide may hybridize to the nucleic acid sequence that is complementary to 18S rRNA. Alternatively, a single oligonucleotide may hybridize to both the RNA secondary structure element and the nucleic acid sequence that is complementary to 18S rRNA present on the IRES. Appropriate hybridization stringency conditions are described herein.

Also provided is a composition comprising (i) a DNA sequence disclosed herein and a (ii) non-coding circular RNA, or a DNA sequence encoding the same. The DNA sequence may encode a circRNA. In some embodiments, the non-coding circular RNA may comprise one or more of a binding site for an RNA binding protein, an aptamer, or a miRNA sponge. In some embodiments, the non-coding circular RNA may have one or more functions, such as sponging miRNAs, regulating mRNA splicing machinery, sequestering RNA-binding proteins (RBPs), regulating RBP interaction, or activating immune responses.

Also provided is a method of delivering a non-coding circular RNA to a cell, the method comprising contacting the cell with a composition comprising (i) a DNA sequence disclosed herein and a (ii) non-coding circular RNA, or a DNA sequence encoding the same, thereby delivering the non-coding circular RNA to the cell.

The following examples further illustrate the invention but, of course, should not be construed as in any way limiting its scope.

EXAMPLES

The following examples describe the development of a high-throughput screen to systematically identify and quantify RNA sequences that can direct circRNA translation. Over 17,000 circRNA internal ribosome entry sites (IRES) were identified and validated, and it was shown that 18S rRNA complementarity and a structured RNA element on the IRES are important for facilitating circRNA cap-independent translation. With genomic and peptidomic analyses of the IRES, nearly 1,000 putative endogenous protein-coding circRNAs were identified, along with hundreds of translational units encoded by these circRNAs. circFGFR1p, a protein encoded by circFGFR1, was also characterized. This protein functions as a negative regulator of FGFR1 to suppress cell growth under stress conditions.

Example 1

This example describes the systematic identification of RNA sequences that facilitate cap-independent circRNA translation. Canonical translation via a cap-independent mechanism may be reduced in numerous human diseases. Accordingly, the use of circRNAs to express proteins may be particularly helpful for treating such diseases.

To systematically identify the RNA sequence that can facilitate cap-independent translation on circRNAs, an oligo-split-eGFP-circRNA reporter construct was developed that allows for screening and quantifying the cap-independent translation activity of synthetic oligonucleotide inserts ("oligos" hereafter) on circRNA in a high-throughput manner (FIG. 1A). Specifically, the construct contains a bicistronic mRuby reporter followed by a permuted split-eGFP reporter flanked by human ZKSCAN1 introns, where during transcription, the pre-mRNA of the construct will undergo spliceosome-mediated back-splicing and reconstitute full-length eGFP on the circRNA. Because full-length eGFP is only reconstituted upon back-splicing, the eGFP fluorescence signal can only come from the circRNA through cap-independent translation. A synthetic oligonucleotide library was then cloned into the construct to drive the expression of eGFP reporter (FIG. 1A). The library contained 55,000 oligos of sequences from the reported IRESs in the IRESite database (including human and non-human IRES; see Mokrejš et al., Nucleic acids research 38, D131-D136 (2009)), the native 5' untranslated region (5' UTR) of viral and human genes, and the native and synthetic sequences from viral and human transcripts (FIG. 1A). Library design is detailed in Weingarten-Gabbay et al., Science 351, aad4939 (2016). For the viral and human transcripts, genes were selected that have been reported to remain associated with polysomes when the cap-dependent translation was suppressed and the genes with alternative isoforms that differ in their translation start site (FIG. 1A).

Figure 8C:
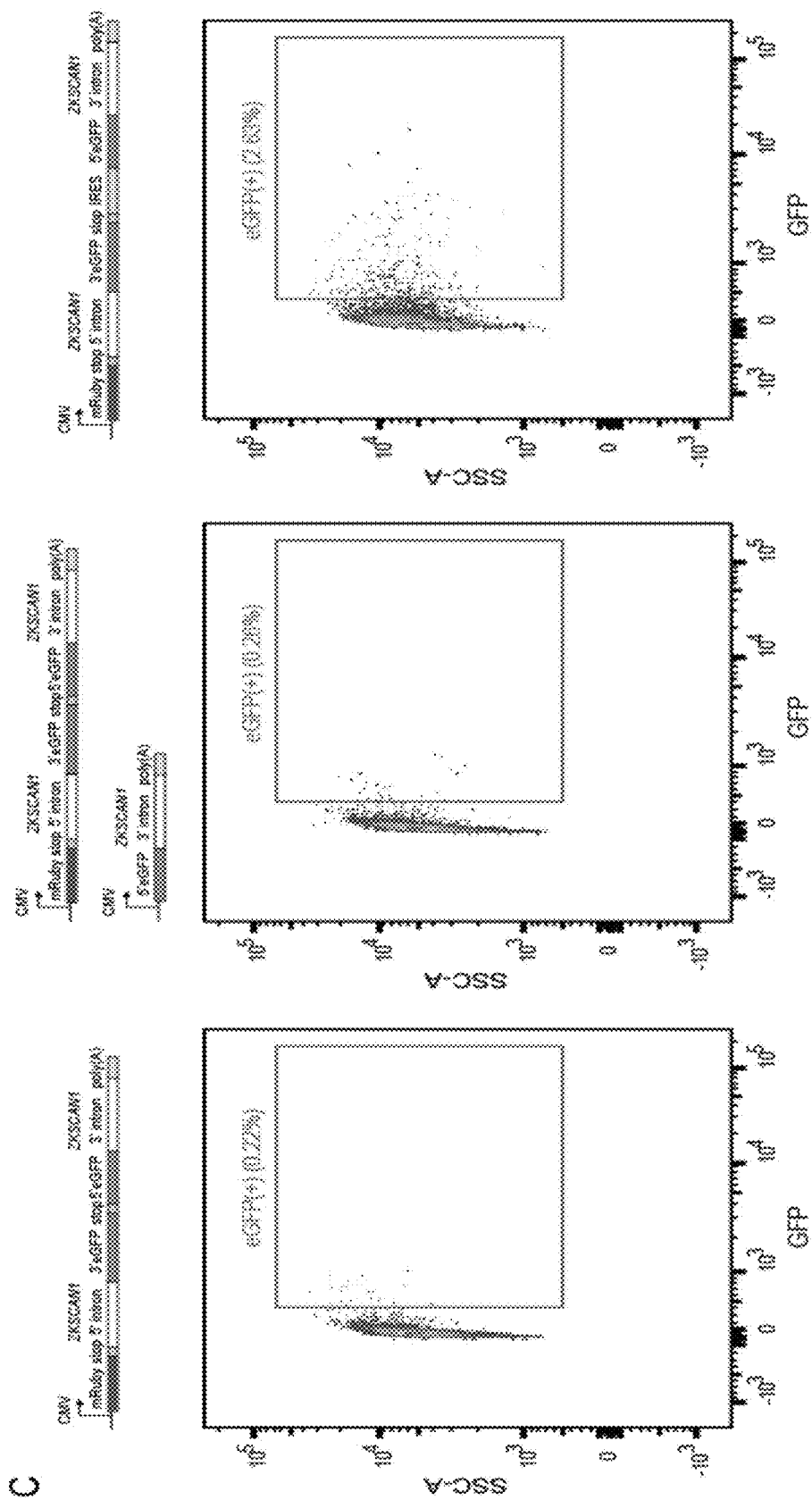

Two well-known concerns for bicistronic IRES screens are cryptic promoters or splice sites that activate transcription or readthrough of the downstream open reading frame (ORF), respectively. The design used herein obviates both concerns because ectopic transcription of only the 5' fragment of the split-eGFP cannot produce fluorescence signal. Northern blots, quantitative reverse transcription polymerase chain reaction (qRT-PCR), RNase R treatment, and reporter gene experiments confirmed that the eGFP signal detected did not come from trans-splicing or the nicking of the eGFP circRNA (FIG. 8A-8C). The reporter produces a ~3000 nucleotide (nt) primary linear transcript and a ~900 nt eGFP circRNA; RNase R exonuclease treatment can efficiently remove the linear transcript but not the circRNA (FIG. 8A). The mRuby gene allowed for normalization for transduction efficiency by translation of a regular linear mRNA. Following transfection into human embryonic kidney (HEK) 293T cells, the transfected cells were sorted by the ratio of eGFP to mRuby fluorescence into seven bins, and deconvoluted the frequencies of oligo sequences in each pool by deep sequencing (FIG. 1A). With this system, it is possible quantify the cap-independent translation activity on circRNA for each oligo in the library in a high-throughput manner.

Figure 1B:
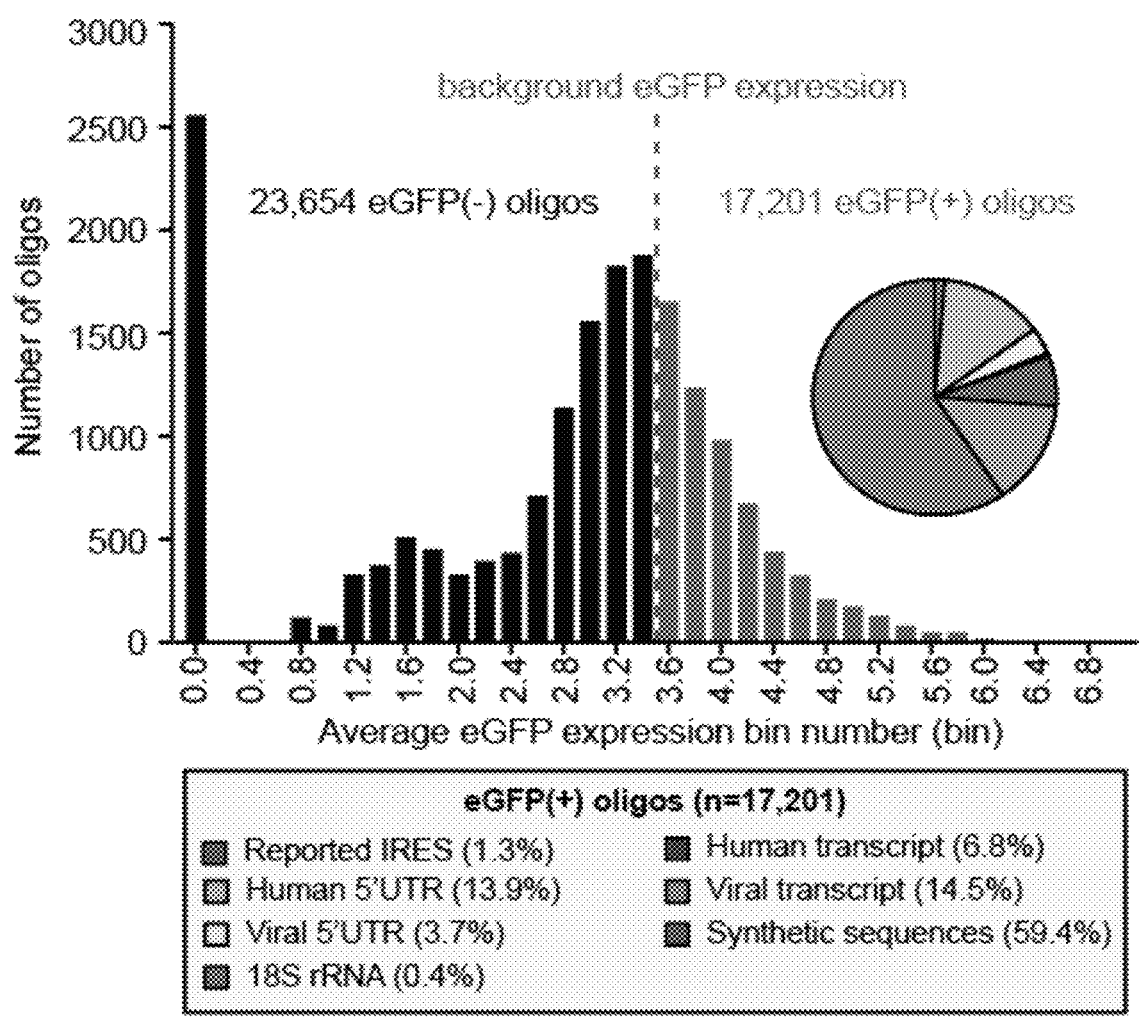
Figure 1C:
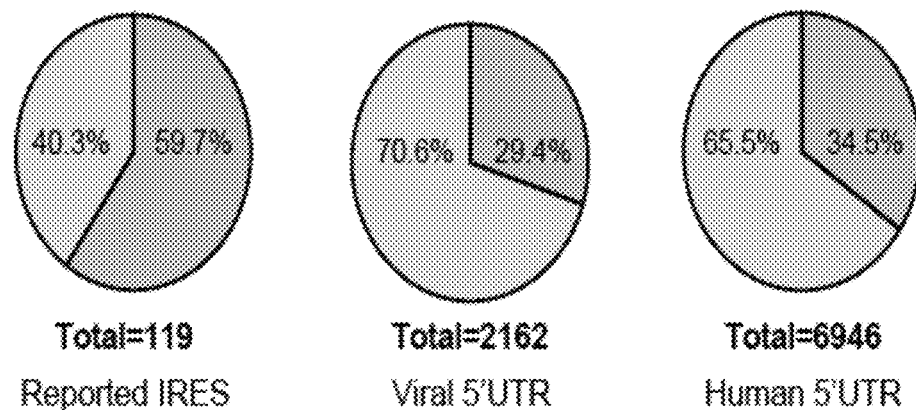
Figure 9A:
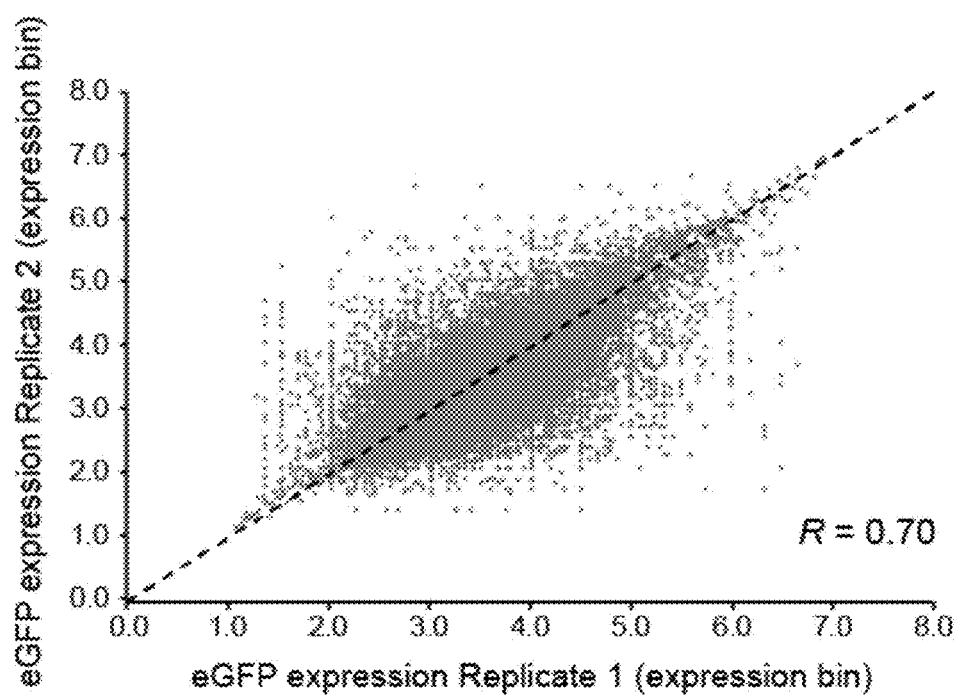
FIG. 9A-9F show high-throughput identification of IRES sequences that can facilitate cap-independent translation activity on circRNAs.
Figure 9B:
Figure 9C:
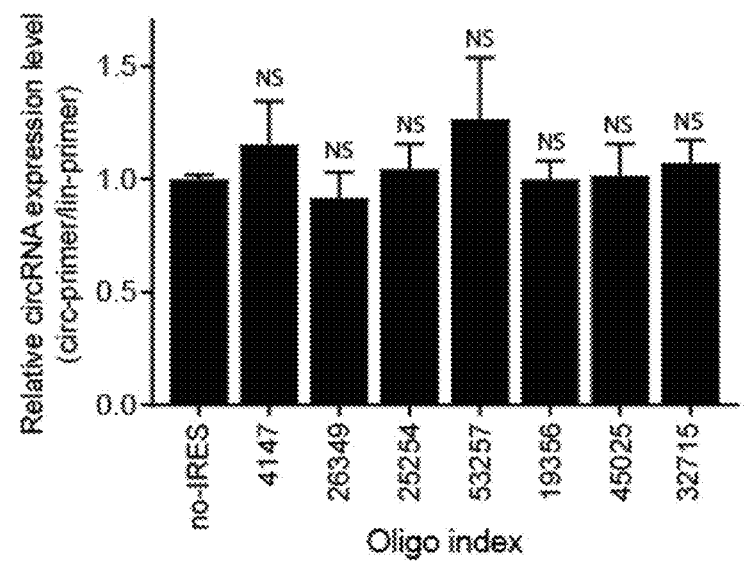
Figure 9D:
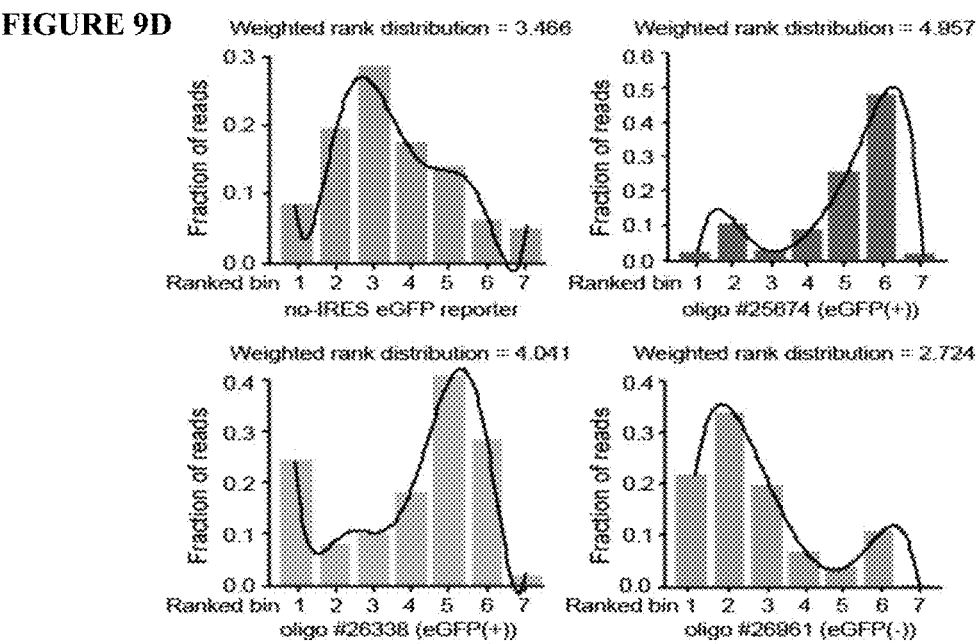
Figure 9E:
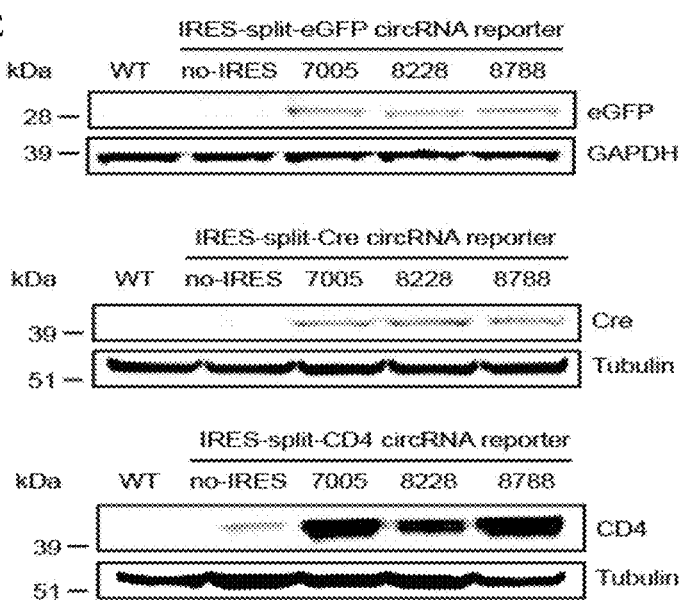
Figure 9F:
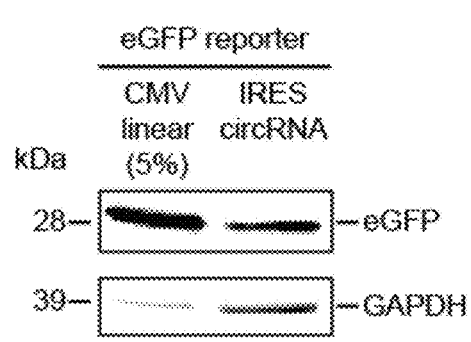
Figure 10A:
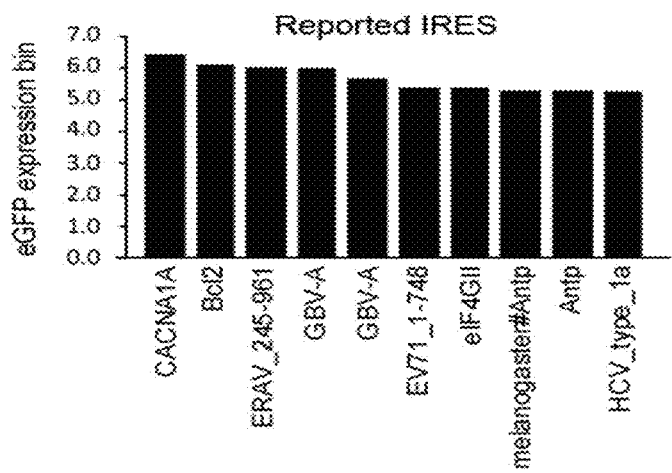
FIG. 10A-10C show the high-throughput IRES screening assay can capture IRES from viral and human 5' UTRs. These figures show examples of IRESs captured in the screening assay with top 10 eGFP expression among the reported IRESs (i.e., linear IRESs) (FIG. 10A), viral 5' UTRs (FIG. 10B), and human 5' UTRs (FIG. 10C).
Figure 10B:
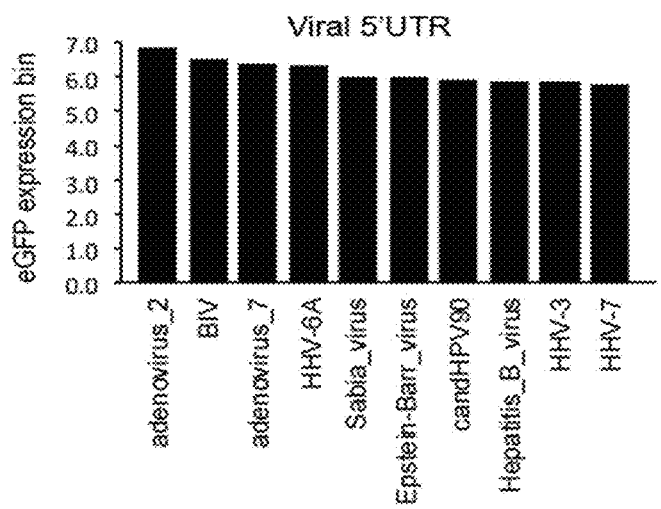
Figure 10C:
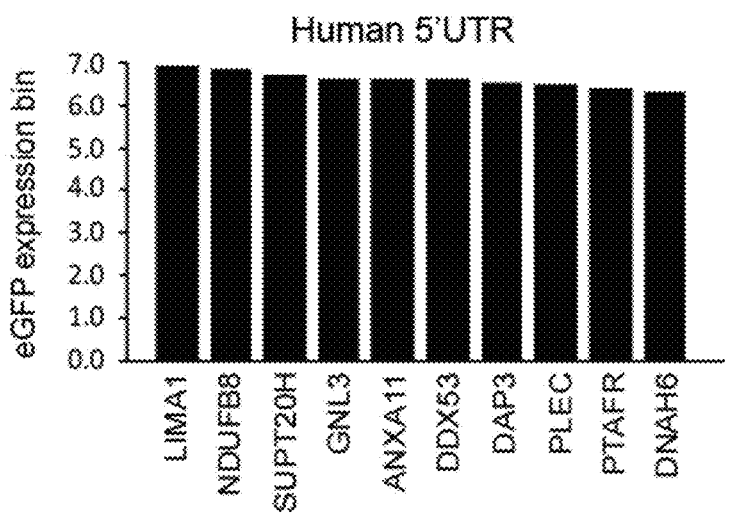

40,855 out of 55,000 oligos were captured from the library (~74.3%). To quantify the eGFP expression level of each oligo, the mean weighted rank distribution of the reads across the bins was calculated. The weight of each bin is the fraction of the number of reads in this bin of its total reads in all seven bins. The rank is the bin number from the bin with the lowest eGFP intensity (bin #1) to the bin with the highest eGFP intensity (bin #7). (FIG. 1B). It was found that the quantification of translation activity was highly reproducible between two independent biological replicates (Pearson's correlation coefficient R=0.70) (FIG. 9A). It was further confirmed that the results were not confounded by the change of circRNA back-splicing efficiency due to different oligo inserts (FIGS. 9B and 9C). This screening assay revealed three groups of oligos according to their eGFP expression level—a group (~2,500) of oligos which showed no eGFP expression (eGFP expression (bin)=0.0), and two groups of oligos showing a bimodal distribution of eGFP expression (eGFP expression (bin)=0.8-2.2 and 2.4-7.0, respectively). To determine the oligos with cap-independent translation activity (eGFP(+) oligos), the weighted rank distribution of the eGFP intensity of the cells transfected with no-IRES-inserted reporter plasmid (empty eGFP circRNA) was calculated as the background eGFP expression. The oligos were defined as eGFP(+) oligos were the oligos with eGFP expression higher than the background eGFP expression (eGFP expression (bin)=3.466387) (FIG. 1B). The background eGFP expression was calculated based on the distribution of the reads across the bins rather than a simple cut off value, which is a more conservative approach to avoid possible false positive events because the empty circRNA eGFP reporter could have weak translation activity (FIG. 9D). With this approach, 17,201 eGFP(+) oligos were identified from the screening assay (FIG. 1B, SEQ ID NO: 1-17201). Further, it was verified that the screening result was not eGFP reporter specific because the eGFP(+) oligos identified were able to initiate circRNA translation of reporters with different coding sequences (CDSs) (FIG. 9E). Although circRNA translation is reproducibly detected, substantially weaker cap-independent translation activity was observed for the circRNA driven by the eGFP(+) oligos compared to the linear RNA translation driven by the cap-dependent translation (FIG. 9F).

Figure 1D:
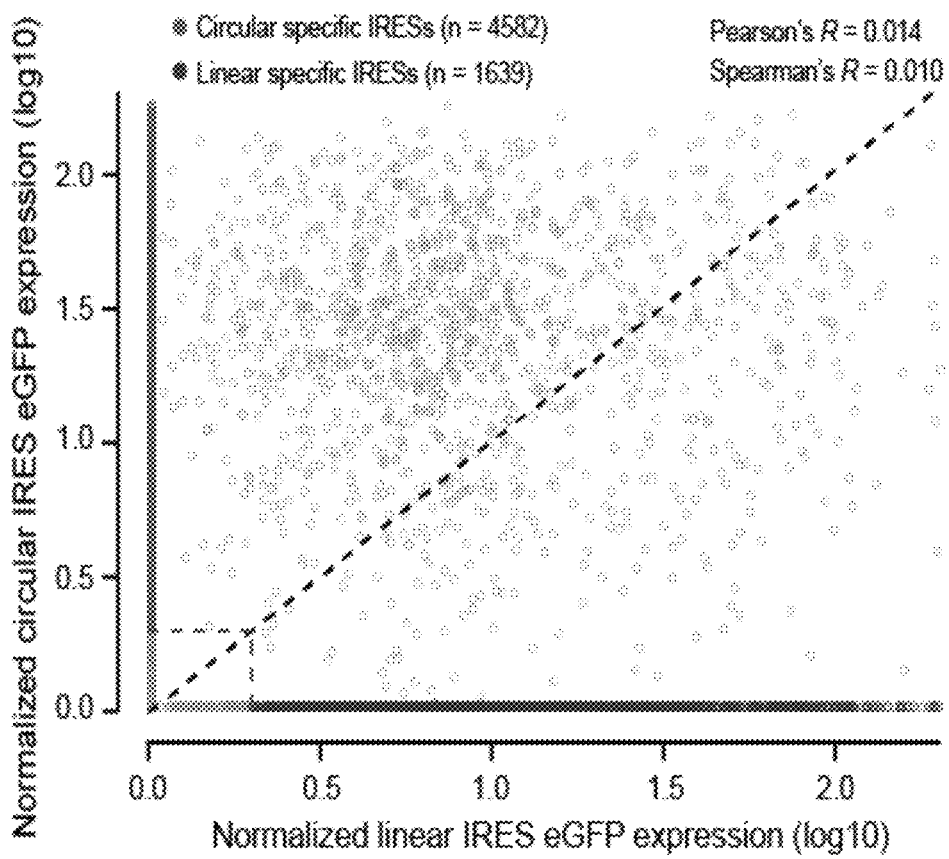

Because a previous study has utilized the same synthetic oligo library on a linear bicistronic eGFP reporter screening assay to identify oligos with cap-independent translation activity on linear RNA over no-IRES-inserted reporter plasmid as threshold (Weingarten-Gabbay et al., 2016), it was possible to compare the cap-independent translation activity of each oligo sequence on linear RNA and circular RNA respectively. For each oligo, the normalized eGFP expression was calculated, from the circRNA vs. from the linear RNA template. It was discovered that among the oligos captured in both circRNA and linear RNA reporter screens (n=13,645), a large number of the oligos showed cap-independent translation activity in both linear and circular RNA screening system (n=7,424) (FIG. 1D, FIG. 11A). However, there was little correlation between the overall IRES activity of circular vs. linear RNA (Pearson's R=0.014; Spearman's R=0.010) (FIG. 1D). Interestingly, some oligos were also captured that show IRES activity specifically in either linear or circular screening system (linear IRES and circular IRES, respectively) (FIG. 1D). To define linear and circular IRES, a more conservative approach was taken, where linear IRES represents the oligo showing cap-independent translation activity in the linear RNA screening system only; and circular IRES represents the oligo showing cap-independent translation activity in the circular RNA screening system only. With this approach, 4,582 circular IRESs and 1,639 linear IRESs were identified (FIG. 1D, FIG. 11A).

Furthermore, when the distribution of the human and viral IRES was examined among circular IRES, linear IRES, and the IRES showing translation activity in both linear and circular RNA, respectively, no significant difference was found among the IRES (FIG. 11B-11D). The result suggests that the recruitment or the activity of circRNA-specific IRES trans-acting factors (ITAFs) on the circular RES may depend on circRNA-specific biogenesis, such as circRNA back-splicing or circRNA nuclear export to distinguish circRNAs from linear RNAs. Together, these results demonstrate that the high-throughput screening assay utilizing the circRNA reporter construct is able to systematically identify the RNA sequences harboring IRES activity that can facilitate cap-independent translation on circRNA.

Example 2

This example demonstrates that synthetic circRNAs harboring eGFP+ oligo sequences are actively translated.

Figure 2A:
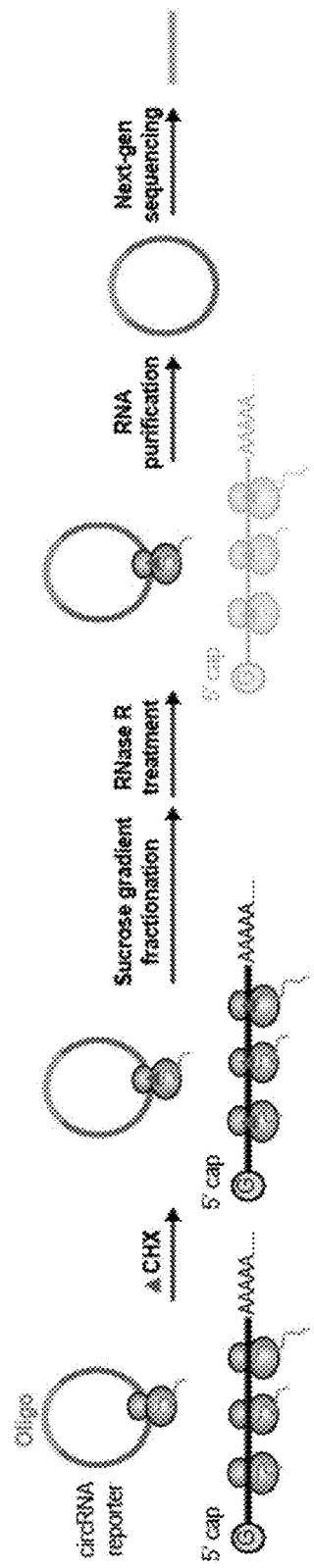
Figure 2D:
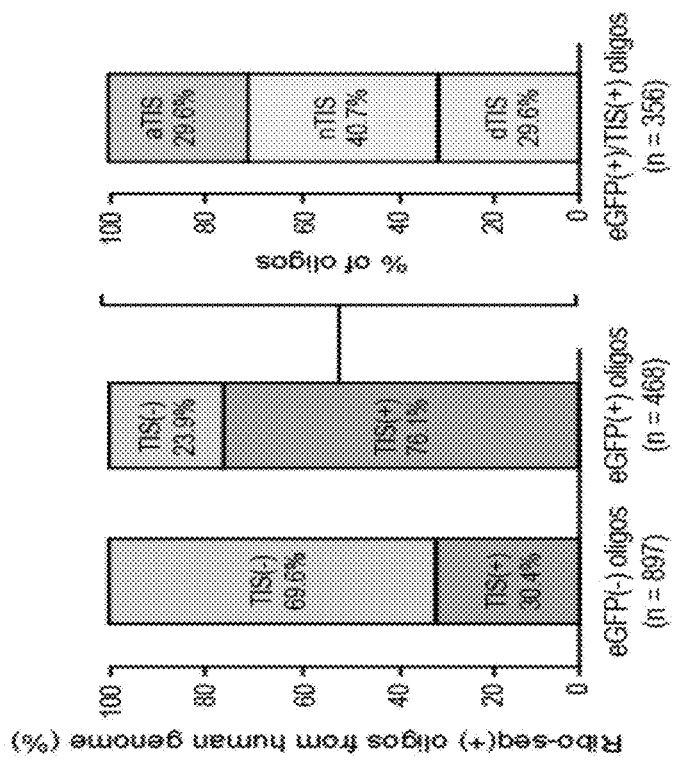
Figure 2E:
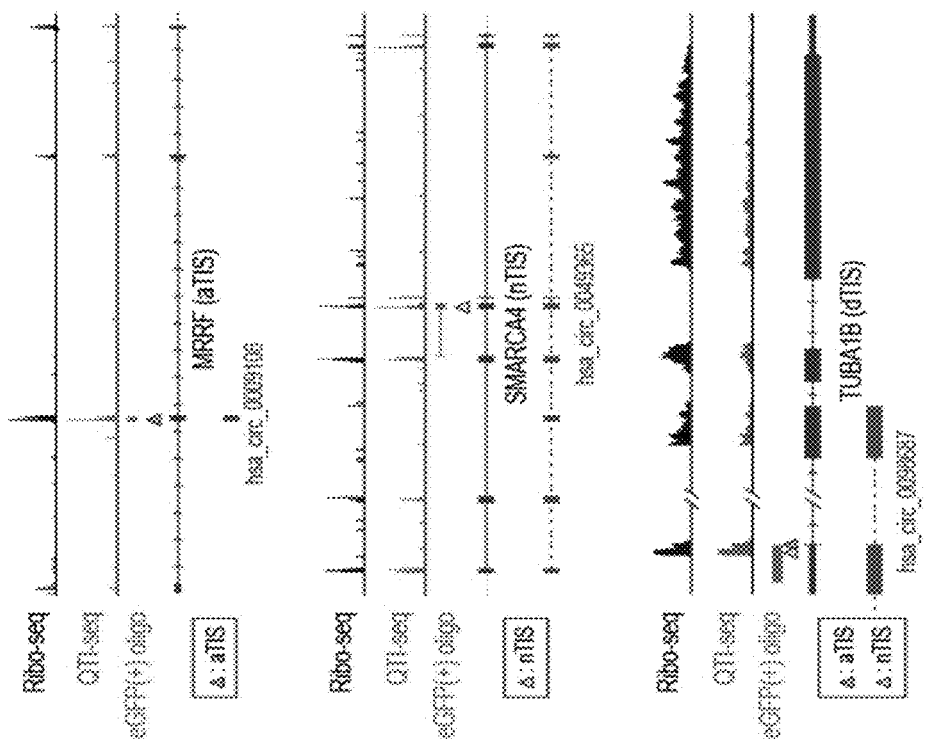
Figure 12A:
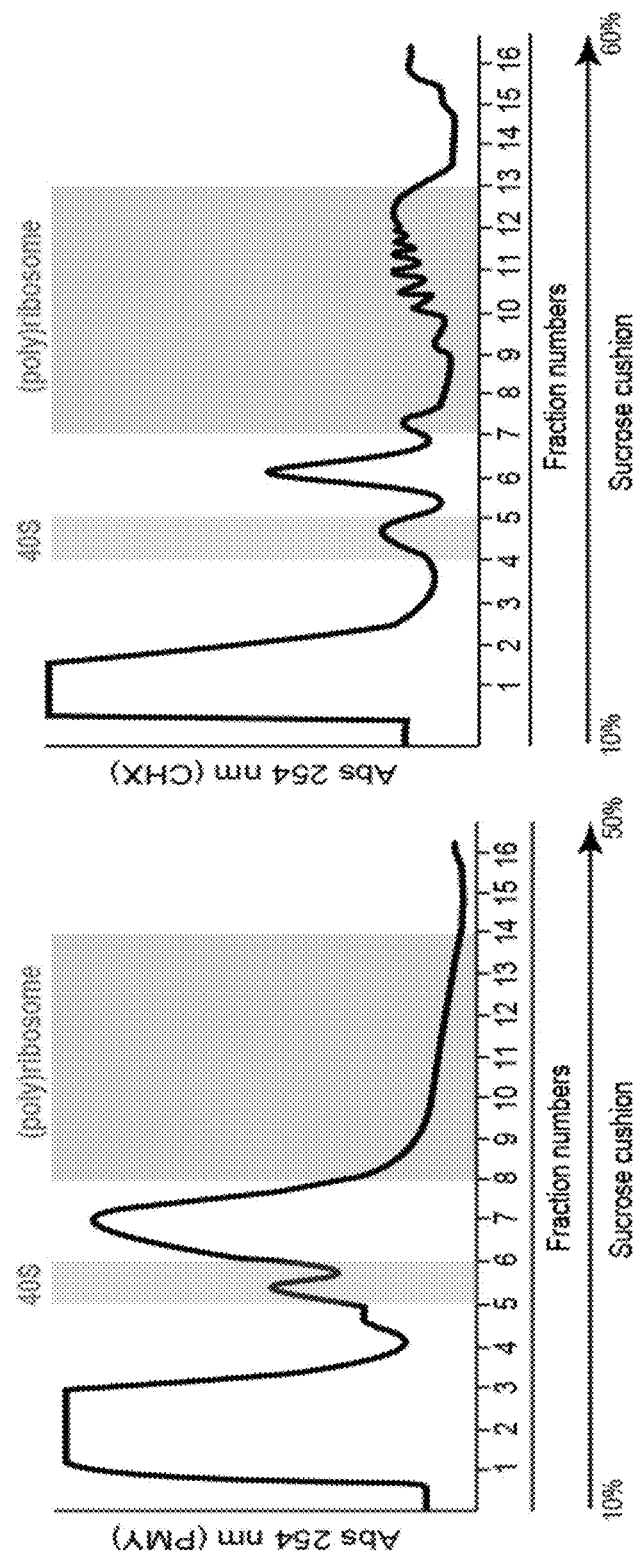
FIG. 12A-12E show that the circRNAs containing the eGFP(+) oligo sequence are more actively translated.
Figure 12C:
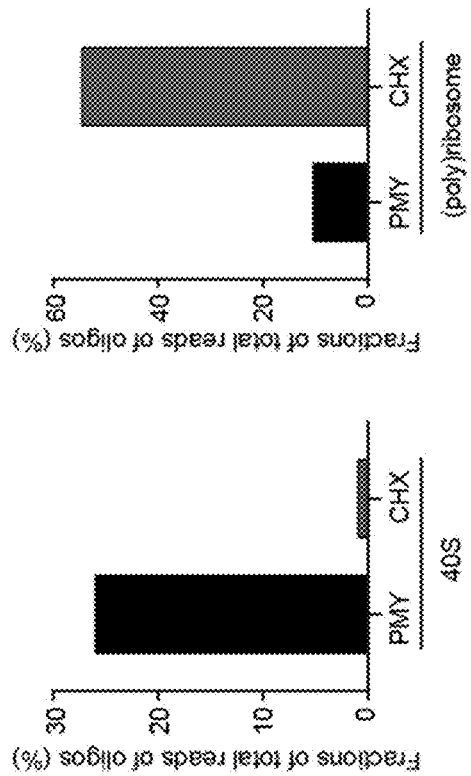
Figure 12E:
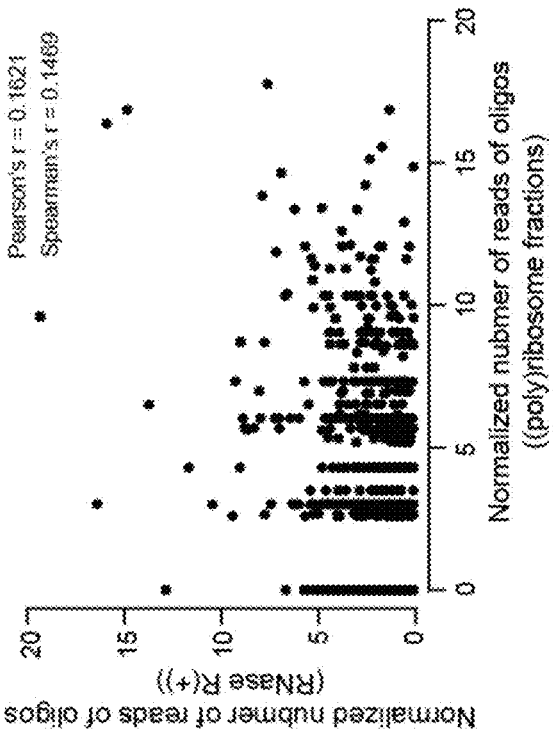
Figure 12B:
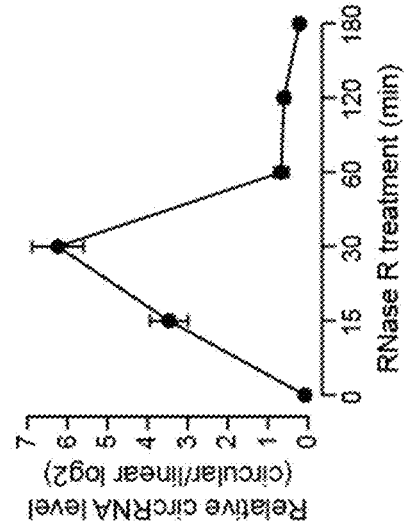
Figure 12D:
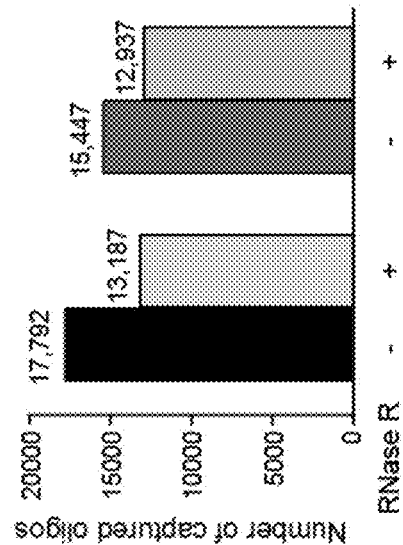

To validate the screening results of Example 1, polysome profiling was used to examine whether circRNAs containing the identified eGFP(+) oligo sequence are actively translated and engaged on the ribosome. First, HEK-293T cells were transfected with the oligo-split-eGFP-circRNA reporter construct containing the synthetic oligo library, treated the transfected cells with cycloheximide (CHX), and isolated (poly)ribosome-associated RNAs with sucrose gradient fractionation (FIG. 2A, 2B, FIG. 12A). Further, the fractions with RNase R were treated to obtain high enrichment of (poly)ribosome-associated circRNAs and high-throughput sequencing was performed to identify the IRES sequences harbored by the circRNA in each fraction. The RNase R treatment was performed in conditions that allows RNase R to digest potential G-quadruplex containing linear RNA efficiently, and the RNase R digestion duration was optimized to obtain >100 fold circRNA enrichment over linear RNA (FIG. 12B). In comparison to the CHX treatment, treating transfected cells with puromycin (PMY) caused translated circRNAs shifting from the poly(ribosome)-associated fractions to the 40S fraction (FIG. 12C), suggesting that CHX treatment is able to capture translated circRNAs. To avoid the result being confounded by the weakly translated circRNAs (data not shown), the ratio of (poly)ribosome-enriched oligos among the eGFP(+) oligos with eGFP expression above the 80th percentile was calculated and compared with the eGFP(−) oligos with eGFP expression below the 20th percentile. The result demonstrated that the eGFP(+) oligos are more enriched in the (poly)ribosome fractions (57.2%) than the eGFP(−) oligos (17.9%) (FIG. 2C). It was confirmed that the higher enrichment of (poly)ribosome-associated eGFP(+) oligos was not caused by the capturing efficiency or the expression level of the oligos (FIGS. 12D and 12E). The result suggests that the circRNAs containing the eGFP(+) oligo sequences are more actively translated. However, since polysome profiling has a lower sensitivity for capturing weakly translated circRNAs (data not shown), quantitative translation initiation sequencing (QTI-seq) data was utilized for additional validation. Next, published data from the QTI-seq was examined, which is a modified ribosome-profiling (Ribo-seq) technique that maps the translation initiation sites (TIS) genome-wide (Gao et al., Nat Methods 12, 147-153, 2015). First, it was examined if the eGFP(+) oligo sequences overlap with those identified TIS on the human transcripts. The results demonstrated that among the oligos derived from the human genome with Ribo-seq coverage, the majority of the eGFP(+) oligos (~76%) overlaps with the identified TIS on human transcripts identified by QTI-seq (TIS(+) oligos), while only 30% of the eGFP(−) oligos are TIS(+) (FIGS. 2D and 2E, FIG. 13A), suggesting that the eGFP(+) oligos are more likely to initiate translation at those TIS than the eGFP(−) oligos. Interestingly, by examining the eGFP(+)/TIS(+) oligos on the human genome, three types of eGFP(+)/TIS(+) oligos were identified: (1) oligos containing the translated initiation site that have been annotated on linear transcripts (annotated TIS; aTIS), (2) oligos containing the translated initiation site that were not annotated on linear transcripts (non-annotated TIS; nTIS) which can be located at the 5' UTR, CDS or 3' UTR region of the transcripts, and (3) oligos containing both aTIS and nTIS signal (dual TIS; dTIS) (FIGS. 2D and 2E). These different types of TIS(+) oligos may suggest that the oligos utilized different mechanisms for initiating translation. While aTIS oligos (~30%) may utilize the same annotated translation initiation site as the linear transcript for cap-independent translation, nTIS (~41%) in contrast represent novel translation initiation sites that are different from the linear transcript for cap-independent translation, which has been observed in initiating the synthesis of alternative translation products. For dTIS oligos, they may utilize some uncharacterized regulatory mechanisms to coordinate the dual activity between aTIS and nTIS which require further investigation. Importantly, while the oligo library was enriched of the oligos located at the upstream of the annotated start codon, no bias was observed towards the ratio of aTIS oligos, suggesting that the result was not confounded by the design of the oligo library. Interestingly, it was found that eGFP(+)/TIS(+) oligos are located within the genomic regions that encode annotated circRNAs (FIG. 2D), which suggests that these circRNA may utilize the TIS on the oligo for initiating endogenous circRNA translation. Nevertheless, when the position of translation initiation sites was mapped on each oligo, no translation initiation hot spots were observed on the oligo (FIG. 13B), suggesting that the translation initiation is not influenced by the position on the oligo. Together, the results above provide strong evidence that the screening assay described herein is able to identify the oligo sequences that are capable of facilitating cap-independent translation activity on circRNAs.

Example 3

This example describes the identification of 18S rRNA complementary sequences that facilitate circRNA translation.

Figures 3I, 3J:
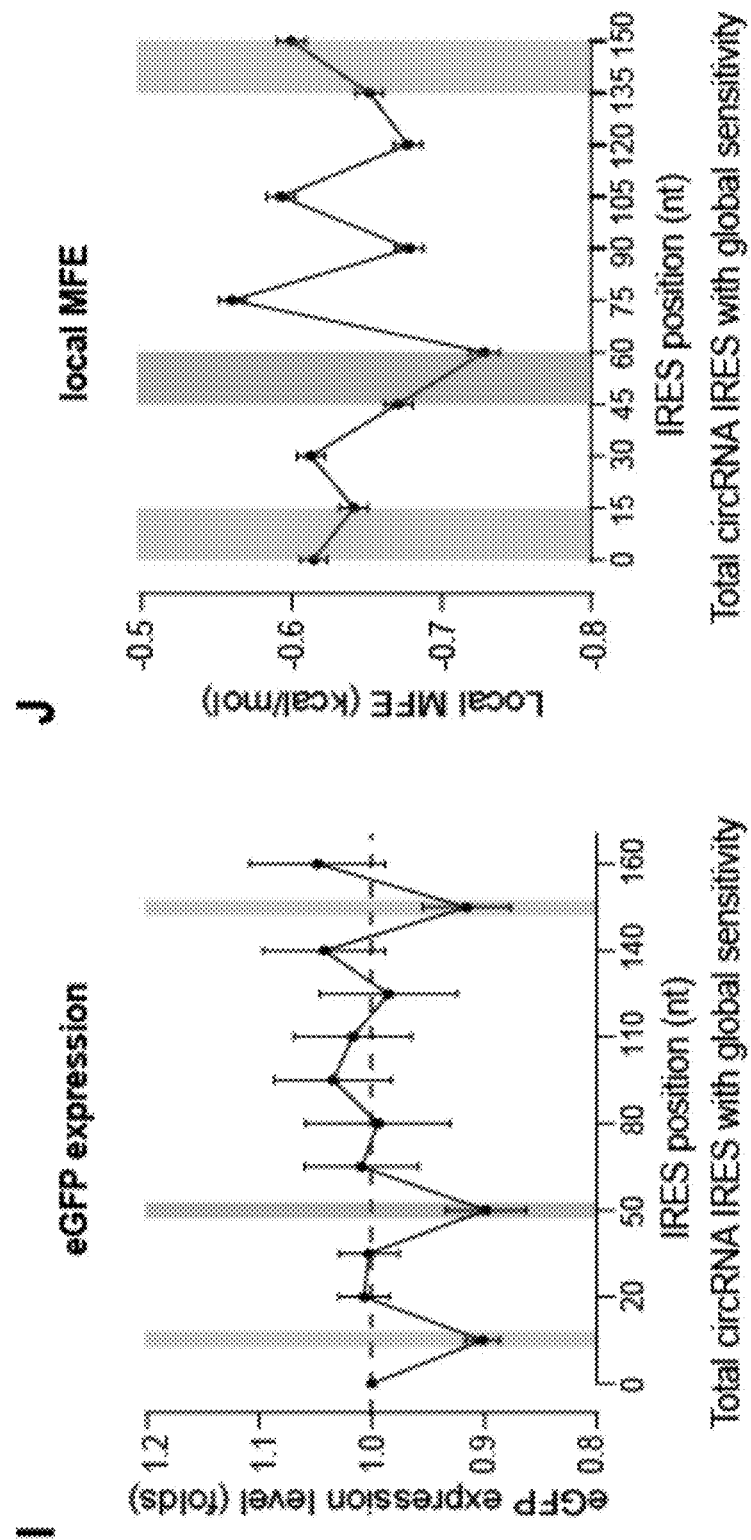

Watson-Crick base-pairing between IRES and 18S ribosomal RNA (18S rRNA) has been demonstrated to facilitate cap-independent translation of linear mRNAs. Thus, it was evaluated whether the screen may identify the regions on human 18S rRNA that can interact with circRNA IRES and facilitate cap-independent translation. The synthetic oligo library was designed to contain 171 oligos with sequences complementary to human 18S rRNA, with a 10-nt sliding window between each consecutive oligo that reconstitutes the entire 1869-nt full-length 18S rRNA sequence (FIG. 3A, SEQ ID NO: 28977-28983). For each position on the 18S rRNA, the average eGFP expression of all the oligos containing the corresponding complementary sequence was calculated. With this sliding window method, the circRNA IRES activity was determined for each 10-nt window across the human 18S rRNA sequence (FIG. 3A). Six "active regions" on the 18S rRNA were identified, where the complementary sequence within these active regions shows average eGFP expression higher than the background eGFP expression (FIG. 3B). Interestingly, active regions 2, 4, 5, and 6 harbor helices that have been reported to contact mRNAs in the eukaryotic ribosome initiation complex and interact with translated RNAs (Pisarev et al., EMBO J 27, 1609-1621 (2008)) (FIG. 3C). Furthermore, active region 4, and active regions 2 and 6, harbored the sequences that have been characterized to facilitate cap-independent translation of IGF1R and HCV IRES, respectively, by Watson-Crick base pairing (FIG. 3C). Active region 3 is located in one of the expansion segments on 18S rRNA (ES6S), which has been implicated in the recruitment of eukaryotic initiation factor 3 (eIF3). eIF3 directly binds to the 5' UTR N6-methyladenosine (m6A) of linear mRNA and initiates cap-independent translation, suggesting that active region 3 on 18S rRNA may be crucial for eIF3-m6A-mediated cap-independent translation. Active region 1 is located in another expansion segment on 18S rRNA (ES3S) that interacts and forms a tertiary structure with active region 3, which suggests that active region 1 may be involved in the eIF3-m6A-mediated cap-independent translation as well. These results suggest that the active regions on 18S rRNA identified indeed play roles in facilitating cap-independent translation.

Figure 13C:
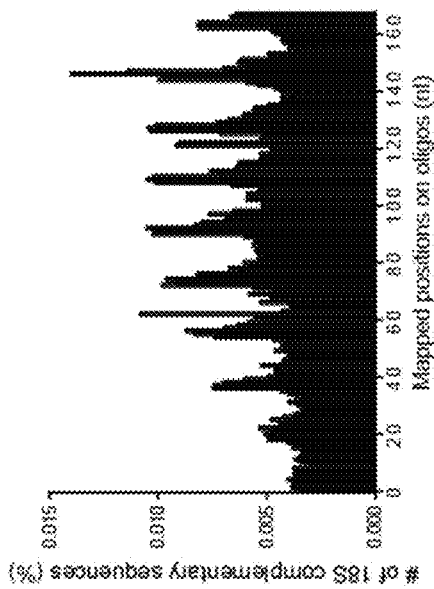
FIG. 13A-13D show that eGFP(+) oligos are more frequently overlapped with the translation initiation sites (TIS) on the human genome. Shown in FIG. 13A is quantification of the number of TIS reads in eGFP(+) or eGFP(−) oligos on the human genome. **** represents p-value <0.001 by an unpaired two-sample t-test. Error bar: SEM. Shown in FIG. 13B are the mapped positions of TIS on each TIS(+) oligo plotted on the oligo. The TIS positions were sorted by the mapped position on the oligo.
Figure 13B:
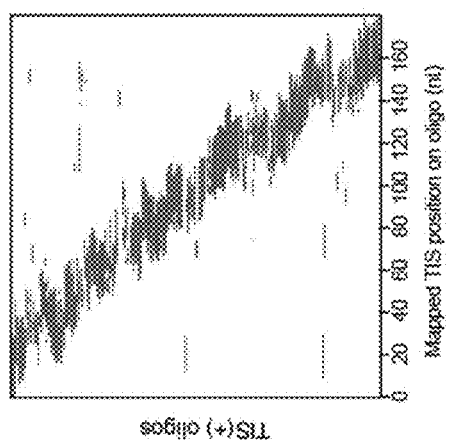
Figure 13A:
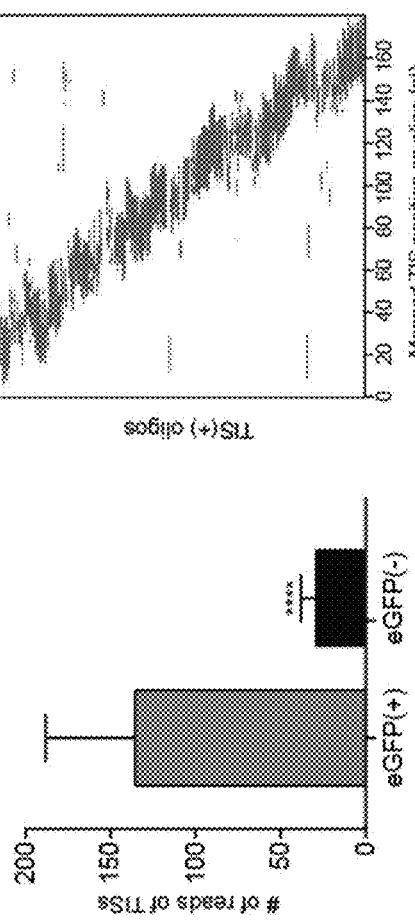
Figure 13D:
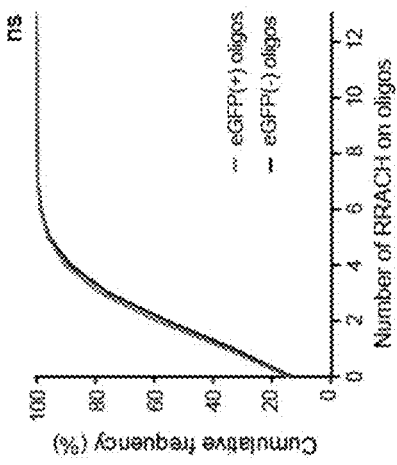

Since the 7-mers derived from active region 4 have been shown to be enriched in reported IRES for linear RNAs, all 7-mers were extracted from the sequence complementary to the active regions of 18S rRNA (active 7-mers), and the number of active 7-mers harbored by the eGFP(+) and eGFP(−) oligos, respectively, were compared. It was found that eGFP(+) oligos have higher enrichment of active 7-mers than eGFP(−) oligos (FIG. 3D). In contrast, when the matched-number of random 7-mers which do not overlap with the active 7-mers between eGFP(+) and eGFP(−) oligos was compared, no significant difference was found (FIG. 3D), suggesting that the higher enrichment of active 7-mers in eGFP(+) oligos observed here is specific to the 18S rRNA complementary sequence. Nevertheless, no hot spot positions of the active 7-mers located on the circRNA IRES were observed (FIG. 13C). To further validate the results, the 18S rRNA complementarity of the IRES was perturbed by either substituting the 18S rRNA complementary sequence with a random 7-mer or adding the flanking 18S rRNA complementary sequence to the IRES and measured their circRNA translation activity (FIG. 3E). Diminished IRES activity was observed with lower 18S rRNA complementarity on the IRES, and conversely stronger IRES activity was programmed with higher 18S rRNA complementarity added to the IRES (FIG. 3E). These results suggest that the circRNA IRES containing RNA sequence complementary to the active regions on 18S rRNA is one of the regulatory elements that can facilitate cap-independent translation on circRNA.

Example 4

This example describes the identification of essential elements on circRNA IRES using systematic scanning mutagenesis.

Scanning mutagenesis was employed to define the essential elements on circRNA IRES. Included in this analysis were oligos designed for scanning mutagenesis of 99 reported IRESs and 734 native 5' UTRs in the synthetic oligo library. The oligos were designed as non-overlapping sliding windows of 14-nt random substitution mutation tiling across the entire IRES or 5' UTR (FIG. 3F). With the screening results, it was possible to determine the effect of the substitution mutations on each 14-nt window on IRES activity across each oligo sequence (FIG. 3F). The essential elements (FIG. 3G; highlighted in blue) were determined as the region from the start position of the mutation (FIG. 3G; black dots) where there was a sharp decrease of the IRES activity to the next start position of the mutation where the IRES activity was resumed or above the mean eGFP expression level. By comparing the quantification result with a well-characterized IRES, hepatitis C virus (HCV) IRES, it was observed that the known functional domains on the HCV IRES (FIG. 3G; redlines) co-localized with the mutation positions that have dramatically reduction in IRES activity. The specific reduction in IRES activity at those mutation positions suggested that the mutations disrupted essential elements of the IRES, abolishing its cap-independent translation activity. The results demonstrated that the assay can indeed capture all of the reported essential elements on the HCV IRES, as well as one possible novel essential element that has not been characterized yet (FIG. 3G).

The same scanning mutagenesis assay was also utilized to further identify the essential elements on the identified circRNA IRES by scanning mutagenesis. The synthetic oligo library contains oligos carrying sliding windows of 14-nt random substitution mutation tiling across the circRNA IRES. With the scanning mutagenesis, two classes of circRNA IRES were captured—circRNA IRES with local sensitivity, which shows reduction in circRNA IRES activity only when a specific position in mutated (FIG. 3H; top), and circRNA IRES with global sensitivity, which mutation in most positions can cause reduction in IRES activity (FIG. 3H; bottom). The local and global sensitive IRES were defined as whether the IRES activity was affected by a single mutation or multiple mutations, respectively. The global sensitive IRESs have more structured sequences (i.e., significantly lower minimum free energy (MFE) value) compared to local sensitive IRESs; which suggests that the overall secondary structure of global sensitive IRESs are crucial for their IRES activity, because the more structured sequences are more likely to be affected by the mutation regardless of the position of the mutation. On the other hand, local sensitive IRESs have less structured sequences and are more resistant to the mutation; which suggests that the IRES activity of local sensitive IRESs may be regulated by a short sequence as the essential element.

By overlaying the eGFP expression level of all the captured circRNA IRESs with global sensitivity, three regions (5-15 nt, 40-60 nt, and 135-165 nt) were identified on the IRES, where when the mutation hit these regions, the IRES activity decreased significantly (FIG. 3I), suggesting that these regions may harbor the key elements for facilitating cap-independent translation of the circRNA IRES. To further characterize if the element harbored by the regions is structure-dependent, the local MFE was calculated along the circRNA IRESs with global sensitivity in a 15 nt non-overlapping window. It was discovered that the local MFE of the 40-60 nt region on the circRNA IRES shows significantly lower local MFE (FIGS. 3I and 3J; shaded in red), suggesting that this region may harbor the local structural element that can drive circRNA translation. In contrast, the local MFE of 5-15 nt and 135-165 nt regions do not differ from other regions on the IRES (FIGS. 3I and 3J; shaded in blue), which suggests that the regulatory elements located at these two regions are not involved in local secondary structures.

Taken together, this data indicates that, with scanning mutagenesis, the assay is able to determine circRNA IRES with local or global sensitivity, and systematically identify essential circRNA IRES elements that are required for IRES activity in a high-throughput manner.

Example 5

This example demonstrates that a stem-loop structure at distinct positions on circRNA IRESs facilitates cap-independent translation.

Figure 14A:
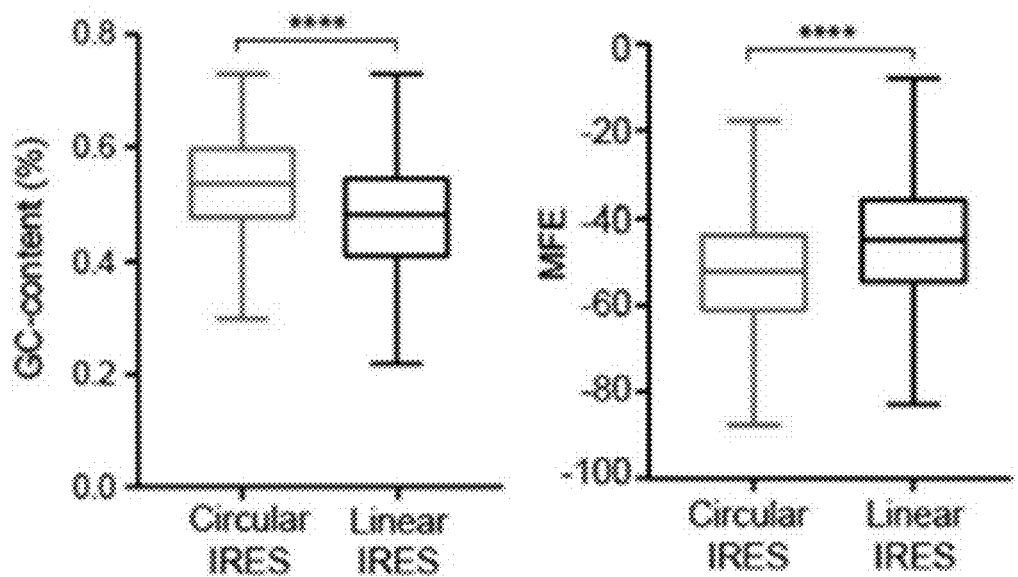
FIG. 14A-14G show a feature comparison between linear and circular IRES sequences. Shown in FIG. 14A is quantification of the GC-content (left) and MFE (right) of circular IRESs and linear IRESs, plotted as Tukey box-plot (outliers not shown). **** represents p-value <0.001 by an unpaired two-sample t-test.
Figure 14B:
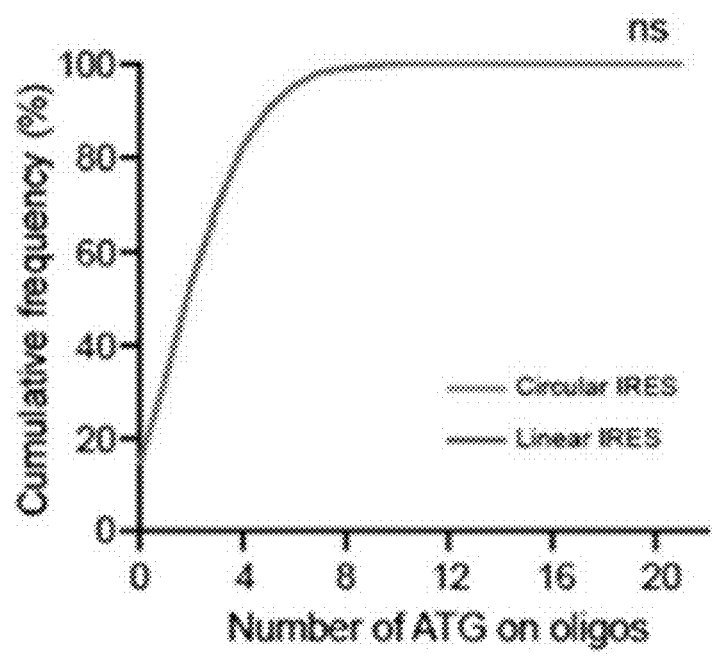
Figure 14C:
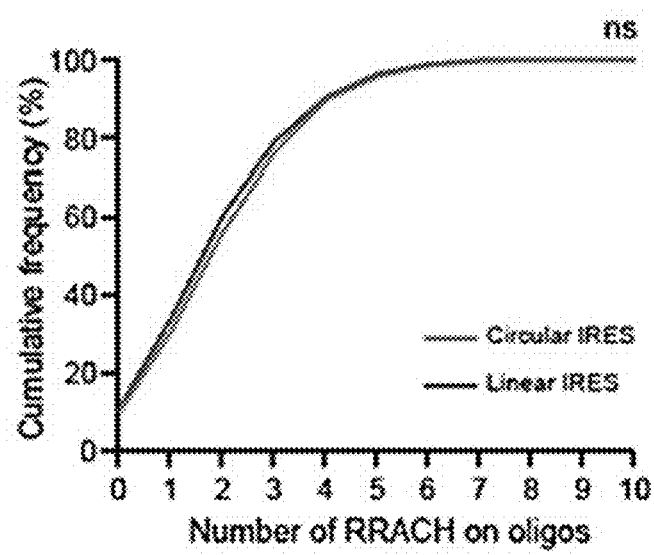
Figure 14D:
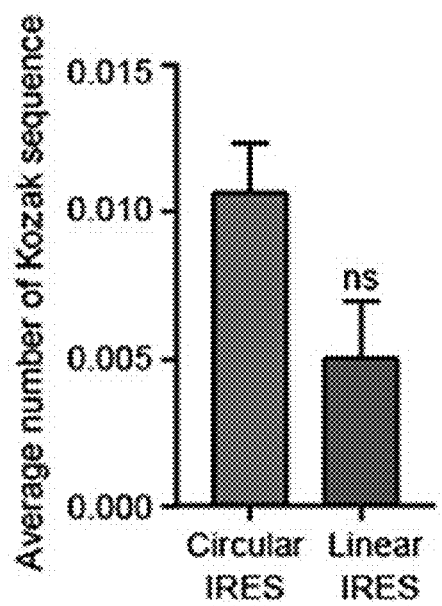

While many native and synthetic IRES have been reported to be able to facilitate cap-independent translation on circRNA, most of the IRES were characterized in a linear RNA reporter system, and no differential IRES activity of IRES on linear vs. circular RNA has been reported yet. By comparing the screening results from the circRNA reporter system described herein with the previous screening study done on a linear RNA reporter system using the same synthetic oligo library, two distinct groups of oligos were identified that harbor IRES activity on either linear or circular RNA specifically (linear IRES and circular IRES, respectively). To characterize the features on these oligos that can distinguish linear and circular IRESs, the primary sequence of the oligos was analyzed, and it was discovered that circular IRES contain higher GC-content and lower MFE than linear IRES (FIG. 14A). On the other hand, the number of the canonical translation start-codon (AUG), the Kozak consensus sequence (ACCAUGG, SEQ ID NO: 34039), and the m6A motif (RRACH, SEQ ID NO: 33944) showed no difference between linear and circular IRESs (FIG. 14B-14D). Since RNA with low MFE often indicates that the RNA has a stable secondary structure, the low MFE of circular IRES suggests some structural elements may play a role in facilitating cap-independent translation activity on circRNA.

Figure 14E:
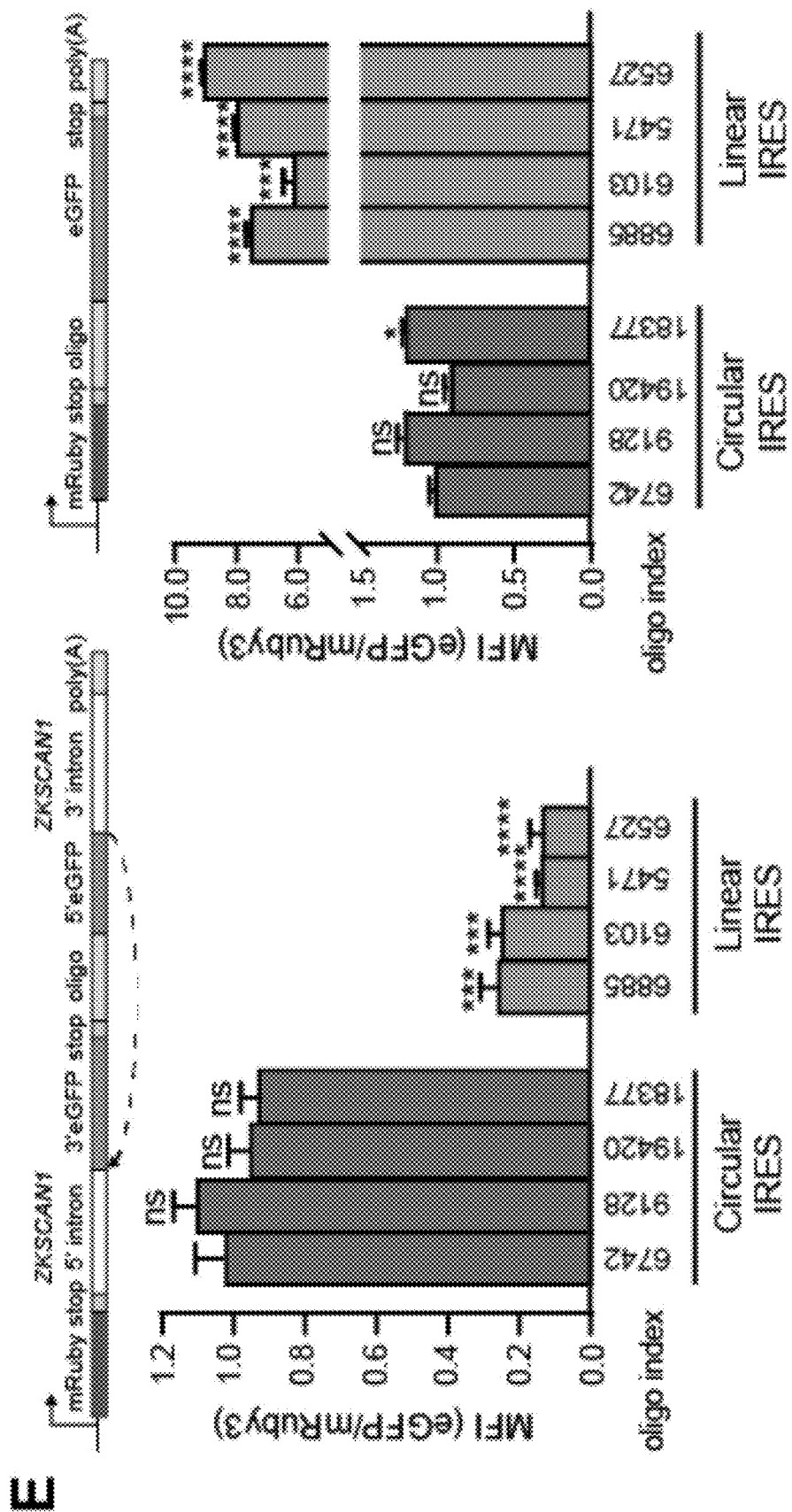
Figure 14F:
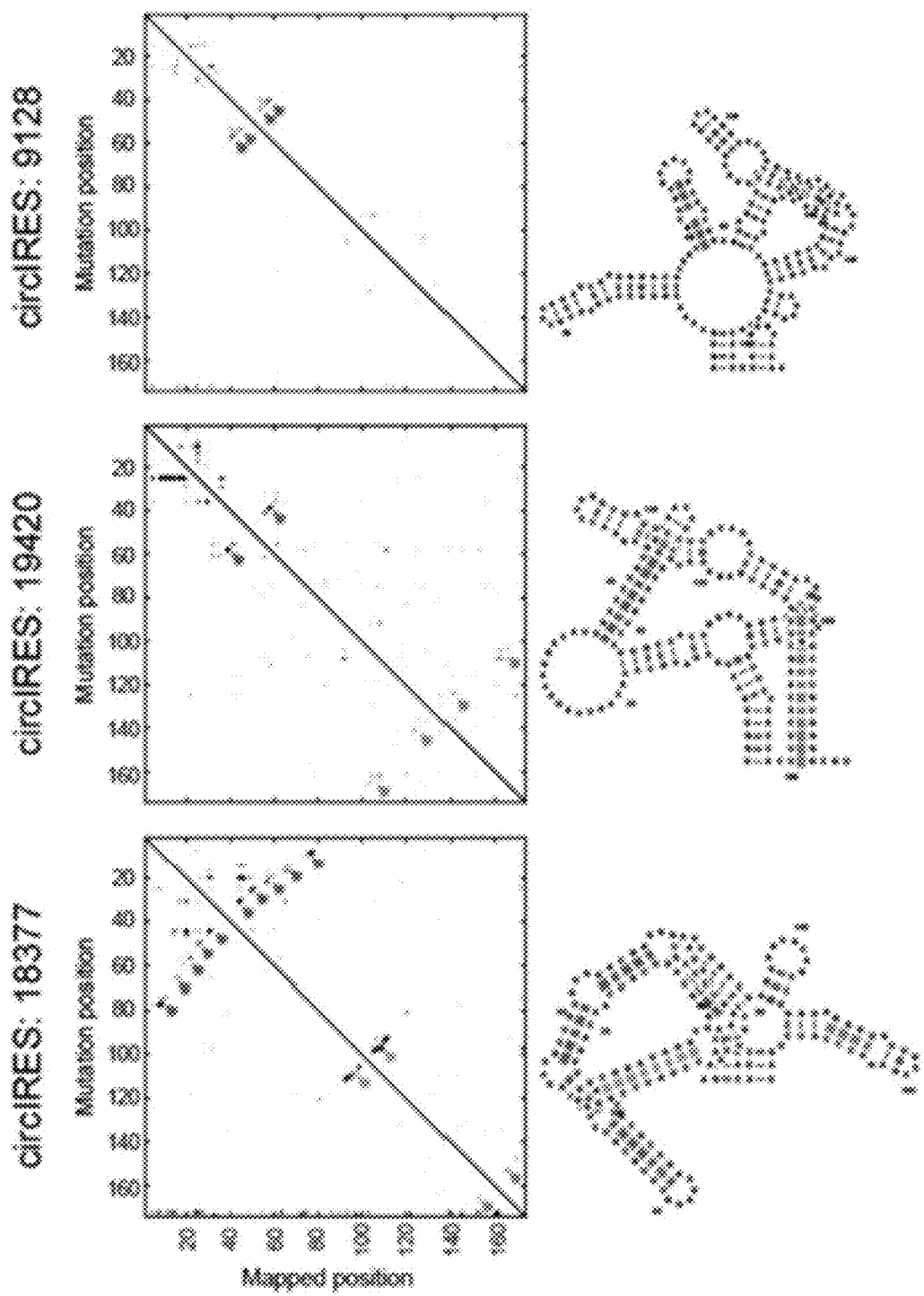
Figure 14G:
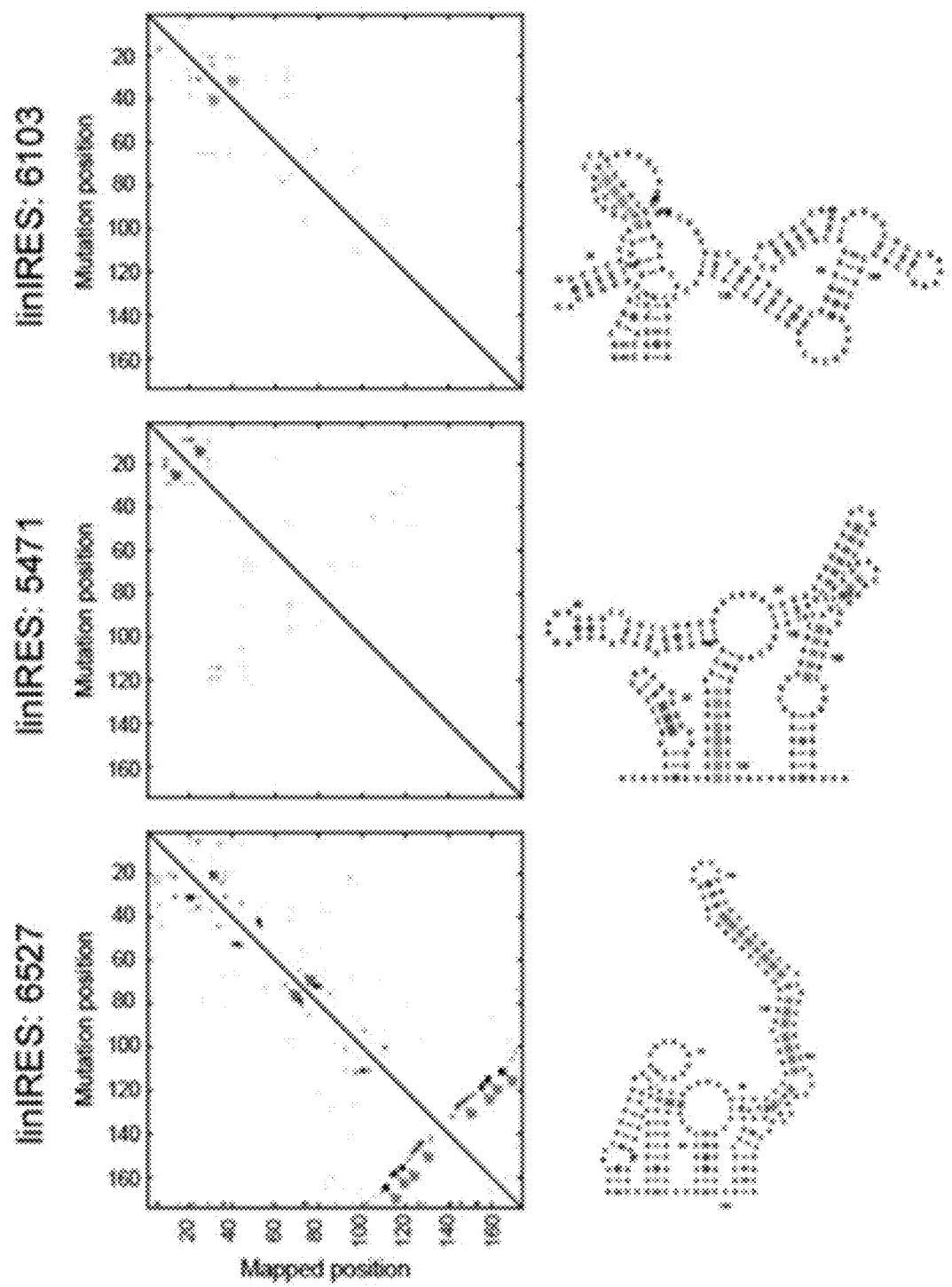

The secondary structure of linear and circular IRES was then characterized with M2-seq, an assay of systematic mutational profiling and chemical structure probing that captures RNA secondary structure with very low false-positive rate. Four circular IRES and linear IRES were selected that specifically show IRES activity on circRNA or linear RNA, respectively (FIG. 14E) and their secondary structure was determined with M2-seq. These oligos were selected because they harbor strong IRES activity in circular RNA system (circular IRES: 6742, 9128, 19420 and 18377) or linear RNA system (linear IRES: 6885, 6103, 5471 and 6527), respectively, and do not show any activity of read-through translation, ribosome re-initiation, and hidden promoter activity on the linear bicistronic construct to ensure that the eGFP signal detected here on the linear bicistronic construct came from the cap-independent translation of the oligos. The M2-seq results revealed that while linear IRES harbored structured elements, the circular IRES are in general more structured than linear IRES (FIGS. 4A and 4B, FIGS. 14F and 14G). Among all four circular IRES examined, all contained a stem-loop structured RNA element (SuRE) on the IRES at a distinct position (40-60 nt position from the +1 position (the first nucleotide) of the IRES), while all the linear IRES examined did not contain such a structure at this position (FIGS. 4A and 4B, FIGS. 14F and 14G). In line with previous systematic scanning mutation profiling, which also suggests that this distinct position on IRES contains structural element required for facilitating circRNA translation (FIGS. 3I and 3J), it was proposed that the SuRE at this distinct position on the IRES can facilitate cap-independent translation activity on circular IRES.

Figures 4E, 4F:
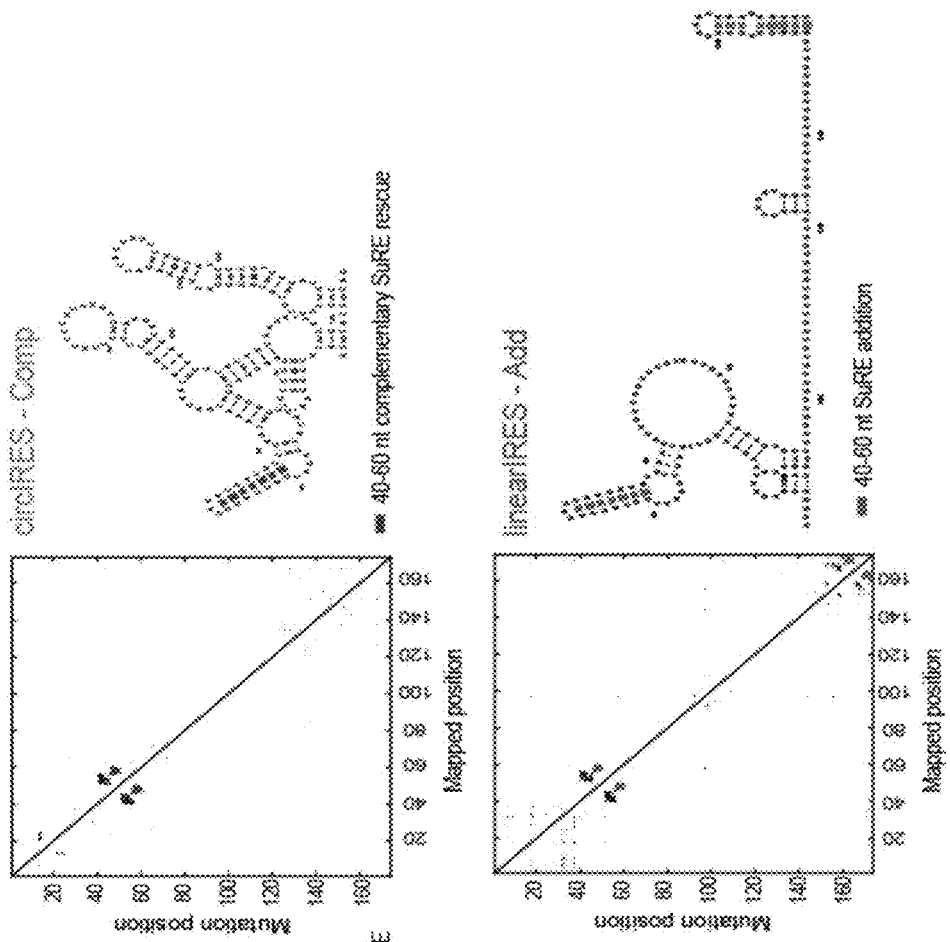
Figures 4G, 4H:
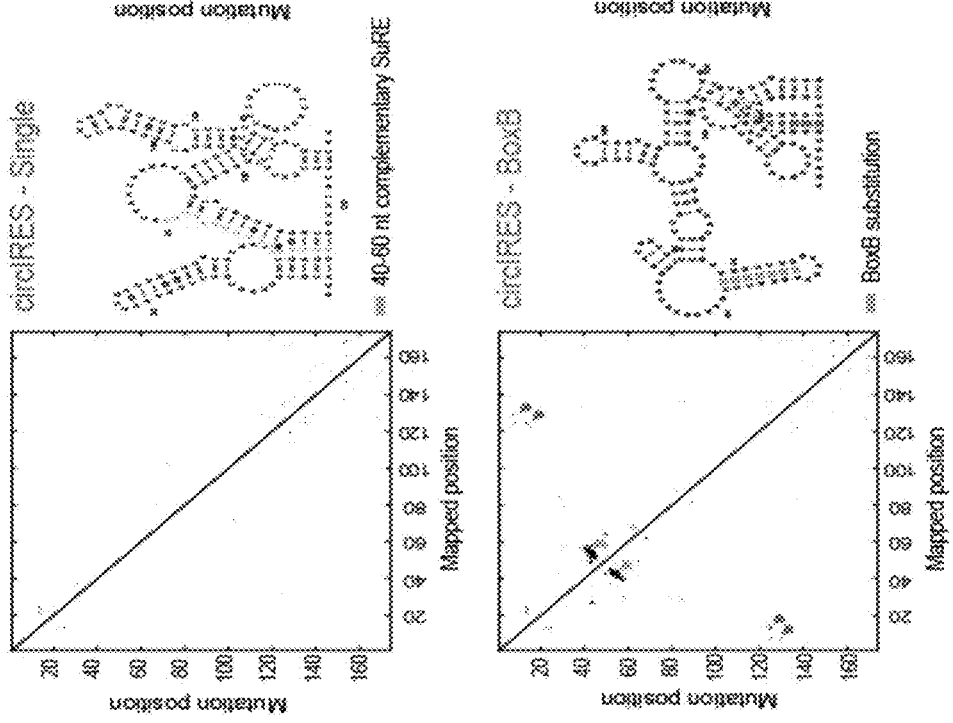
Figure 4I:
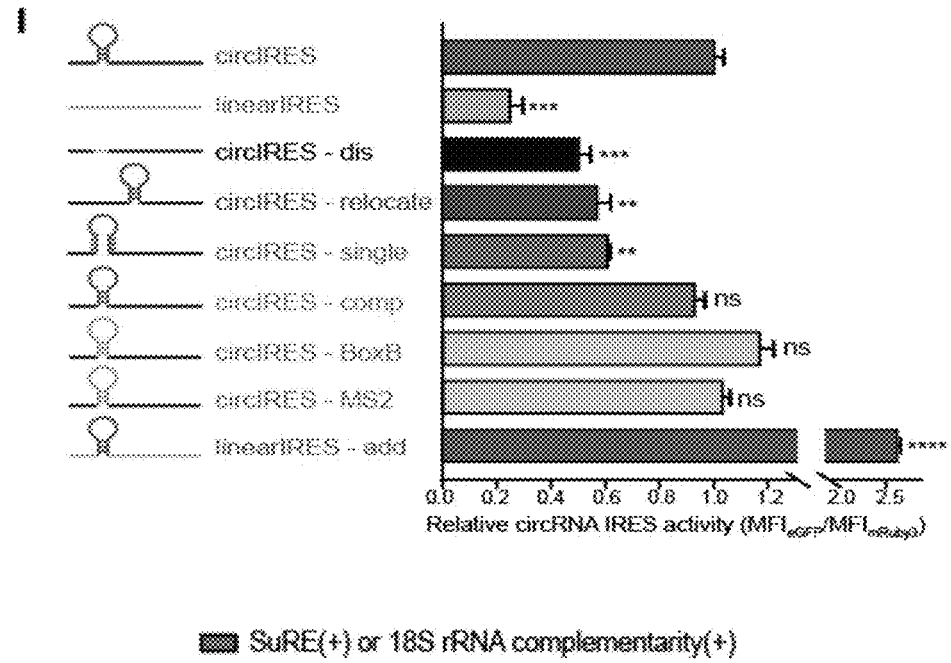

To test this hypothesis, the SuRE at 40-60 nt position on the circular IRES (oligo index: 6742) was disrupted by substituting it with the sequence extracted from the same position on the linear IRES (oligo index: 6885), forming a different secondary structure at this position (FIG. 4C). Interestingly, disrupting the SuRE at this position on the circular IRES leads to a reduction in its IRES activity (FIG. 4I). Moreover, to test if the SuRE element is position sensitive, the SuRE element was relocated from the 40-60 nt position to the 90-110 nt position by swapping the sequences of these two regions on the IRES. A decreased translation activity of the IRES was observed (FIGS. 4D and 4I). To further validate that the SuRE is structural dependent rather than sequence-dependent, compensatory mutagenesis of the SuRE element was performed. Specifically, each of the seven base pairs on the stem region of the SuRE element were mutated to disrupt its duplex structure. Lower translation activity of the IRES was observed (FIGS. 4E and 4I). Furthermore, the translation activity of the IRES can be rescued by compensatory double complementary mutations to restore each of the seven base pairs on the stem region (FIGS. 4F and 4I). Interestingly, when the SuRE was substituted with MS2 or BoxB, which have a similar RNA structure, the same IRES activity was observed as the wild-type IRES (FIGS. 4G and 4I), suggesting that the IRES activity regulated by the SuRE is indeed structure-dependent rather than sequence-dependent. Finally, the linear IRES was converted into a circular IRES by transplanting the SuRE from the circular IRES to the 40-60 nt position on the linear IRES (FIGS. 4H and 4I). The results above suggest that the 40-60 nt SuRE on the IRES can indeed facilitate circRNA translation.

Figure 4J:
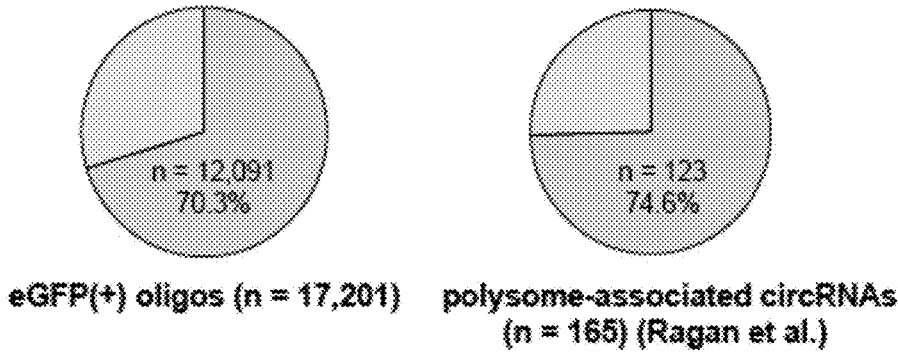
Figure 4K:
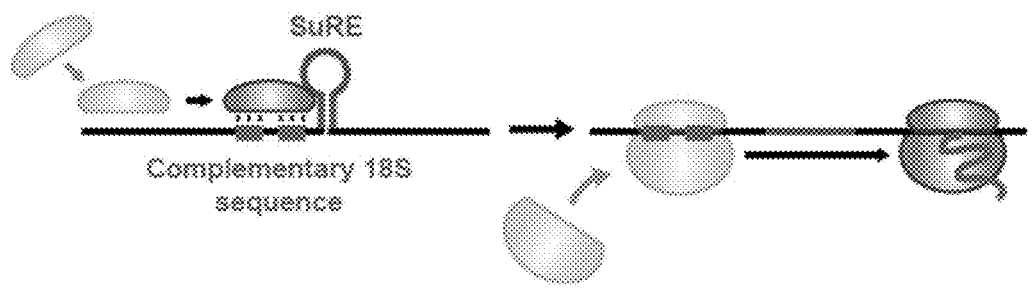

Together, the results above along with the 18S rRNA profiling suggest that two key regulatory elements on circRNA IRES, the 18S rRNA complementarity and 40-60 nt SuRE on the IRES, can facilitate cap-independent translation on circRNA. In line with this model, among the 17,201 eGFP(+) oligos captured by the screen, 12,091 of them (~70%) harbor high 18S rRNA complementarity (18S rRNA complementarity (+)) or 40-60 nt SuRE (SuRE(+)) (FIG. 4J), which suggests that these two regulatory elements can facilitate the exogenous reporter circRNA translation. To further validate if these two regulatory elements can also facilitate endogenous circRNA translation, the polysome-associated circRNAs (translating circRNAs) captured in HEK-293 cells (Ragan et al., 2019) were examined, and it was found that 123 out of 165 endogenous translate circRNAs (~75%) are 18S rRNA complementarity (+) or 40-60 nt SuRE(+) circRNAs (FIG. 4J), indicating that these two regulatory elements are common features among the endogenous translated circRNAs. These results suggest that the 18S rRNA complementarity and 40-60 nt SuRE can facilitate the translation of both exogenous reporter circRNAs and endogenous circRNAs. Nevertheless, no preferential localization of the 18S complementary sequence to the 5' or 3' of the SuRE was observed (FIG. 13C); this suggests that the SuRE on the IRES may cause a pause for RNA unwinding, increasing the chance for the 18S complementary sequence on the IRES to interact with the 18S 25 rRNA on the ribosome, and facilitate cap-independent translation on circRNAs (FIG. 4K).

Example 6

This example demonstrates that the IRES elements facilitate translation initiation of endogenous circRNAs.

Figure 5A:
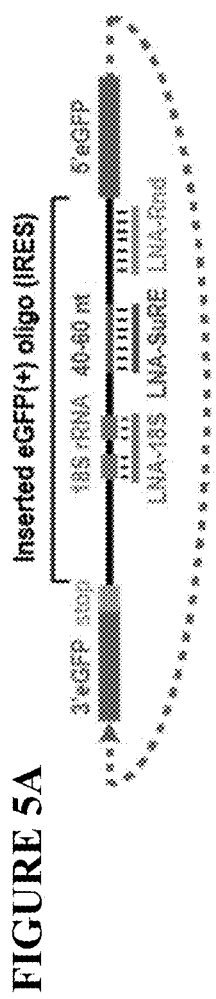
FIG. 5A-5E show that IRES elements facilitate translation initiation of endogenous circRNAs.
Figure 5B:
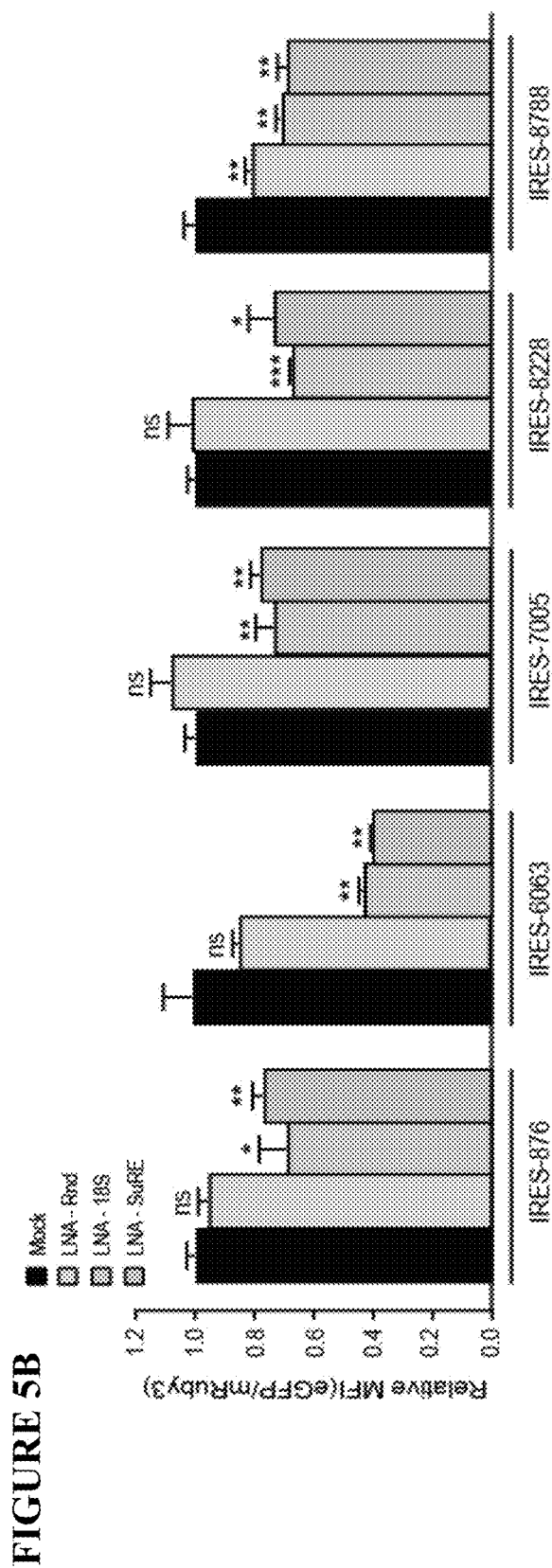
Figure 15A:
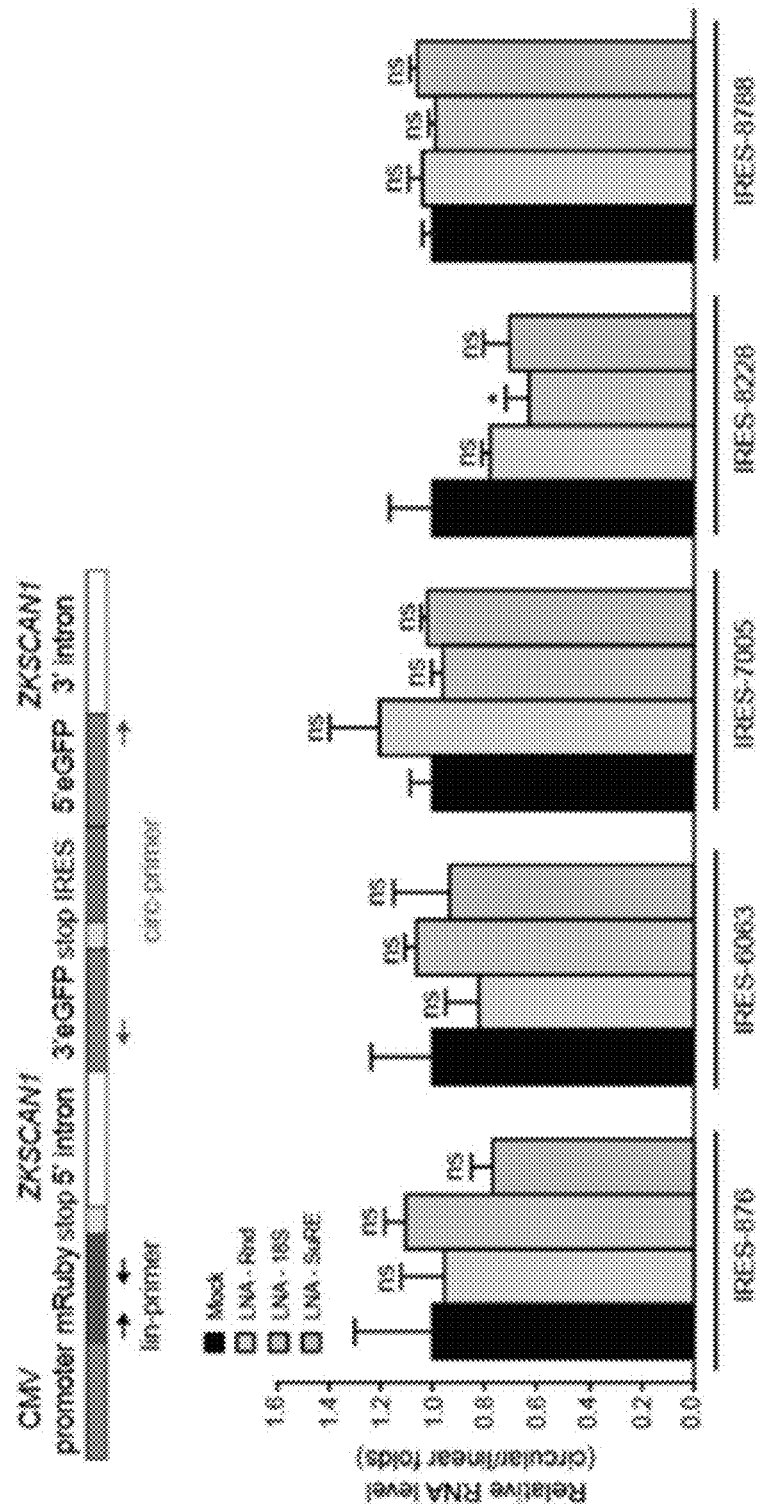
FIG. 15A-15B show that IRES elements facilitate translation initiation of endogenous circRNAs.

To examine if the key regulatory elements identified on the IRES, such as the 18S rRNA complementary sequence and the SuRE at the 40-60 nt position, can facilitate translation of human endogenous circRNAs, a locked nucleic acid (LNA) was utilized to disrupt these key elements on the IRES because LNA has been utilized to specifically disrupt the functional regions on the HCV IRES and inhibit HCV IRES activity. Anti-sense LNAs were designed targeting (i) the 18S rRNA complementary sequence on the IRES to block 18S rRNA binding to the IRES (LNA-18S), (ii) the SuRE at the 40-60 nt position to disrupt the SuRE on the IRES (LNA-SuRE), and (iii) random position downstream of the LNA-18S or LNA-SuRE on the IRES (LNA-Rnd) for identified IRESs (FIG. 5A). The LNAs were then co-transfected with the oligo-split-eGFP-circRNA reporter construct containing the corresponding IRES, respectively, and translation activity of the eGFP reporter was measured by its normalized fluorescence signal intensity. It was found that co-transfecting LNA-18S or LNA-SuRE can indeed disrupt the cap-independent translation activity of all IRESs (10 out of 10 LNAs), while most of the LNA-Rnd co-transfection did not affect the translation activity of the IRES (4 out of 5 LNAs) (FIG. 5B). It was also confirmed that the result was not confounded by the change of circRNA expression level because co-transfecting the LNAs generally did not change the circRNA expression level (FIG. 15A). The result suggests that disrupting the key elements on the IRES with LNA can affect the cap-independent translation activity of the exogenous reporter circRNA.

Figure 5C:
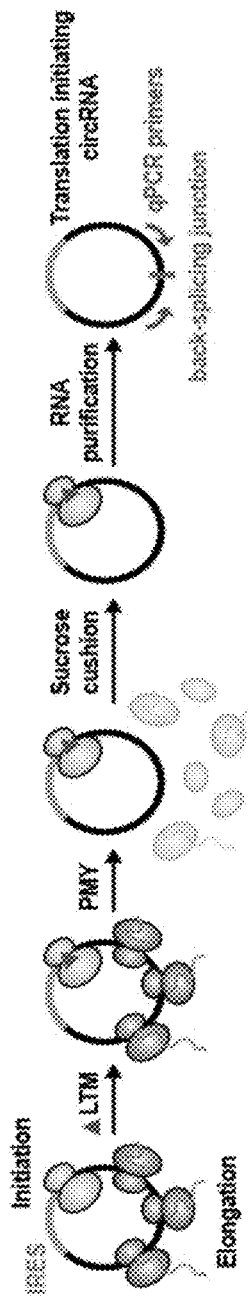
Figure 5D:
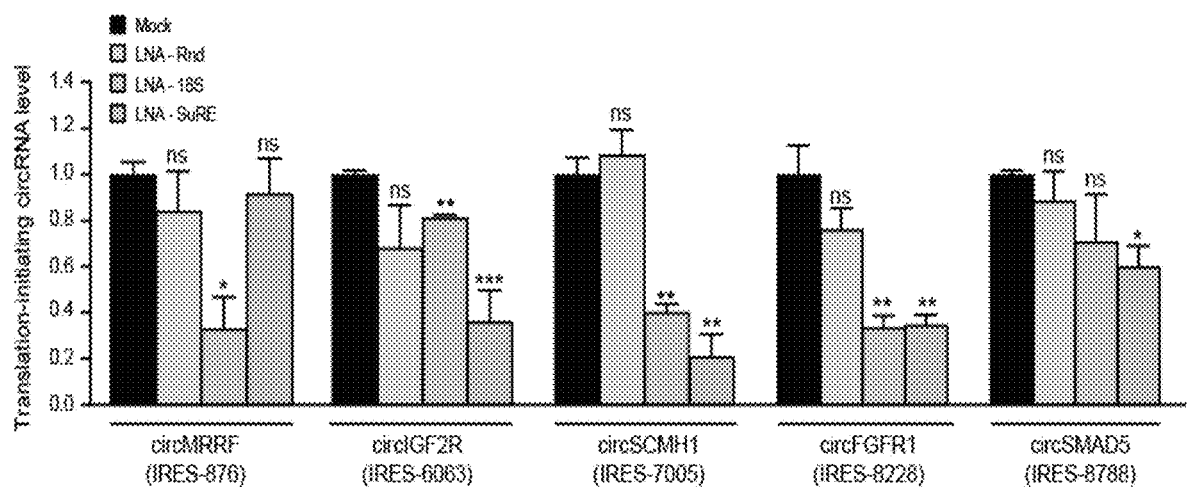
Figure 5E:
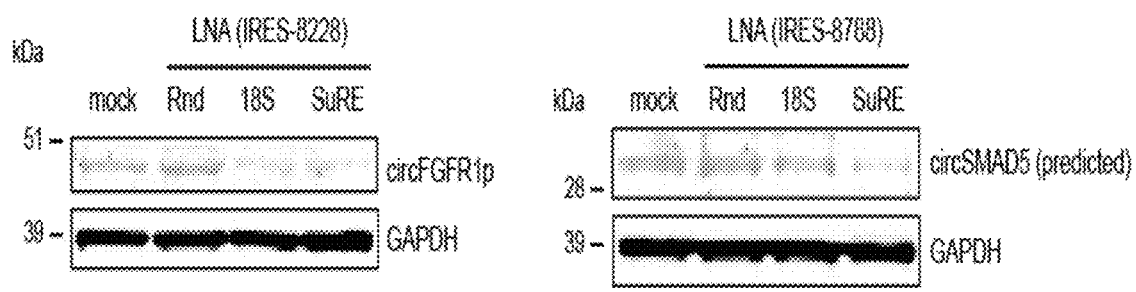
Figure 15B:
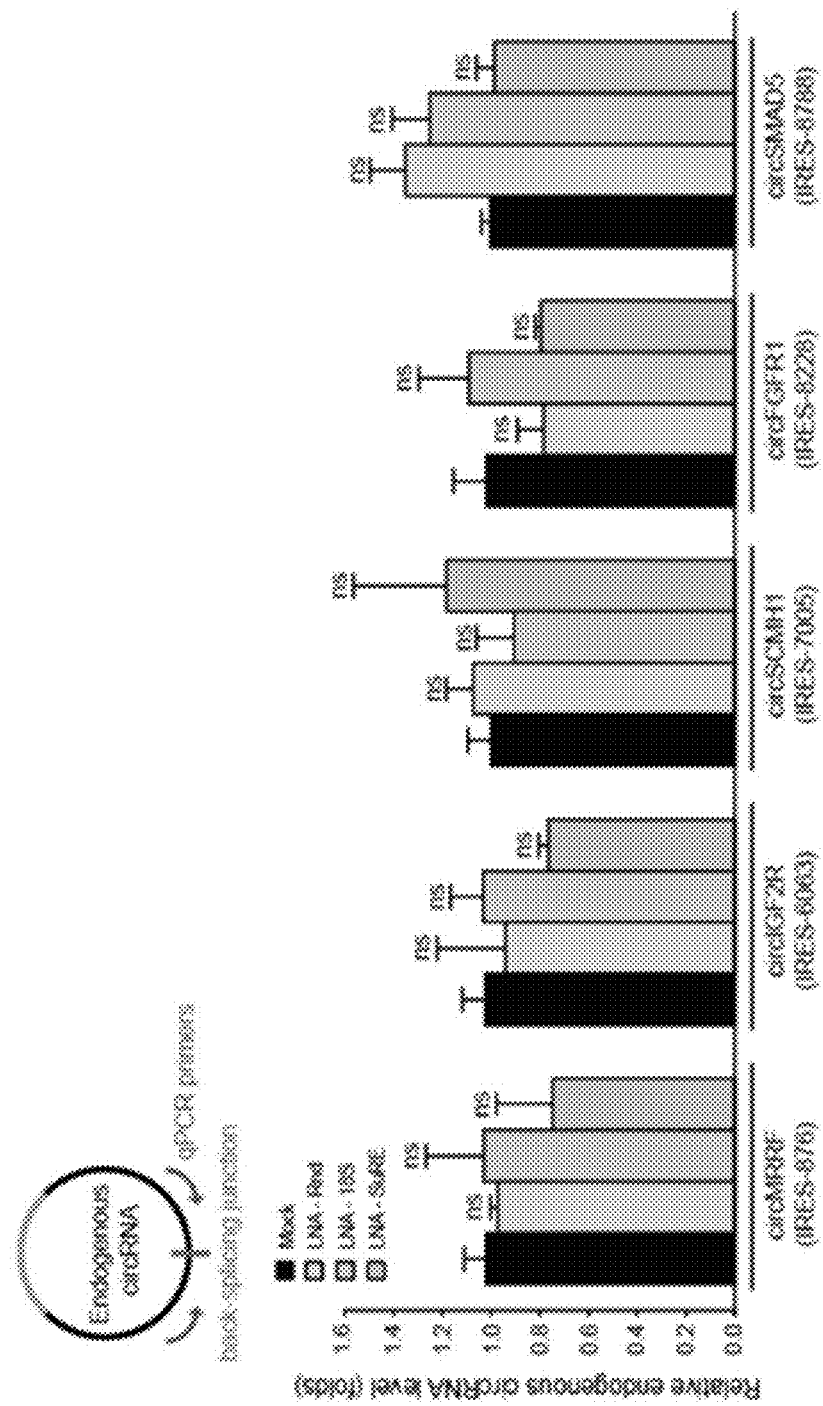

To further examine if the identified key regulatory elements on the IRES can also facilitate translation of human endogenous circRNAs, the cells were transfected with the corresponding anti-sense LNA and quantified translating circRNAs by the QTI method. Specifically, to isolate translating RNAs, LNA-transfected cells were treated with lactimidomycin (LTM) followed by puromycin (PMY) treatment, ribosome-associated RNAs were sedimented with sucrose cushion, and the translating RNAs were purified (FIG. 5C). The level of translating endogenous circRNA was then quantified, which contains the LNA-targeted IRES by qRT-PCR using the divergent primers spanning across the back-splicing junction of the circRNA. It was found that disrupting the key regulatory elements by LNA-18S or LNA-SuRE on the IRES of the endogenous circRNA can in general cause decreased translation activity of the circRNAs (8 out of 10 LNAs), while all the LNA-Rnd did not influence the translation activity of the endogenous circRNAs (5 out of 5 LNAs) (FIG. 5D). It was also confirmed that the LNA transfection did not change the expression level of the endogenous circRNAs (FIG. 15B). Since QTI method specifically captured the RNAs that are at the initiation stage of translation, it suggested that the decrease of endogenous circRNA translation observed upon LNA transfection came from the decrease in translation initiation. The results were further validated by quantifying the protein level produced from the endogenous circRNAs by Western blotting. The Western blotting result matched what was observed in the QTI-qRT-PCR result—disrupting the key regulatory elements on the IRES of the endogenous circRNA generally reduces the protein level produced from the circRNA (3 out of 4 LNAs) (FIG. 5E). The results above suggest that the key elements identified on the IRES, such as the 18S rRNA complementary sequence and the SuRE at the 40-60 nt position, are important for facilitating translation initiation of endogenous circRNAs.

Example 7

Figure 6A:
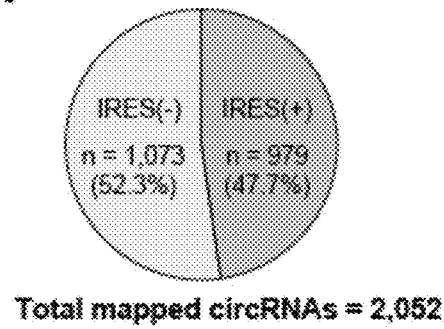
FIG. 6A-6L demonstrate the identification of putative endogenous circRNA-encoded proteins.
Figure 6B:
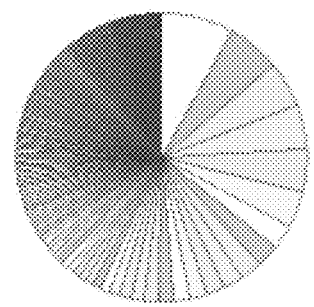
Figure 6C:
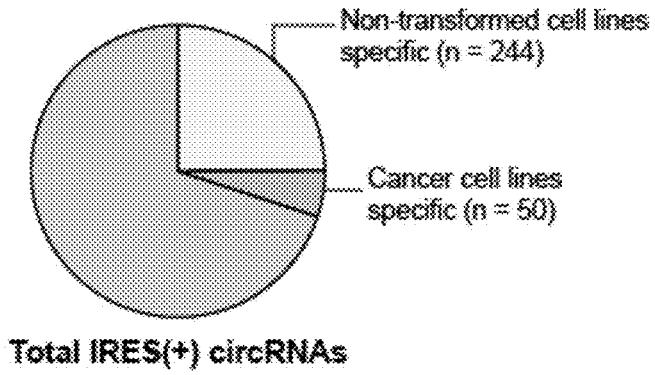
Figure 16A:
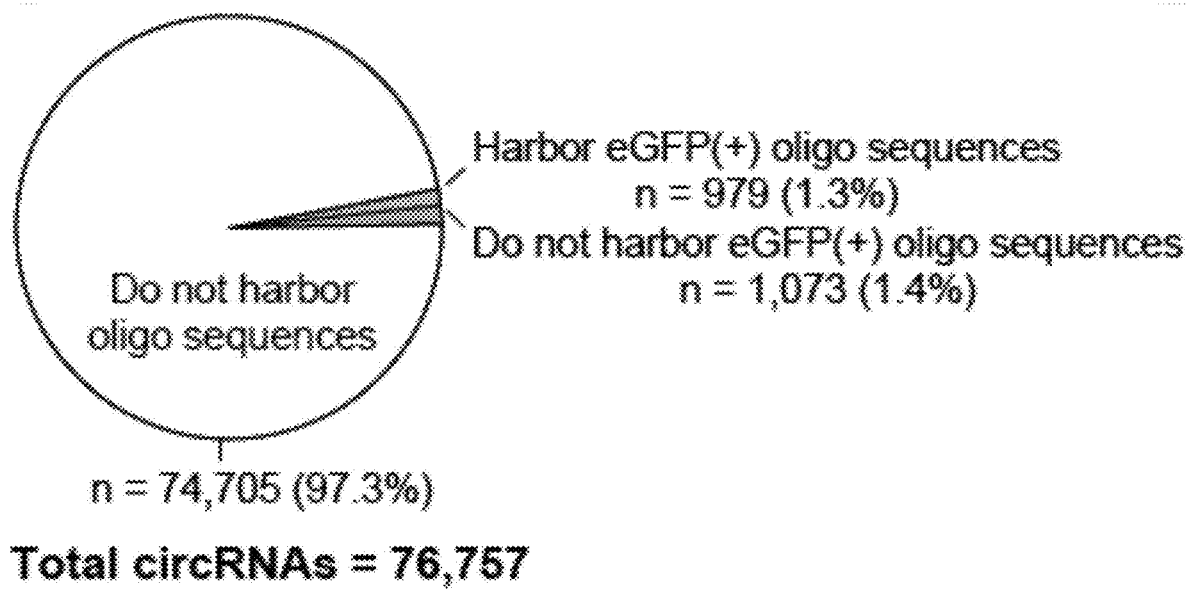

This example describes the identification of possible endogenous protein-coding circRNAs. Introducing synthetic IRES on circRNAs is sufficient to initiate cap-independent translation, suggesting that endogenous circRNAs harboring the active circular IRES may have the potential of producing proteins with cap-independent translation. Thus, to determine the potential circRNA proteome, the eGFP(+) oligo sequences captured in the screens to the human circRNA database (circBase) (Glazar et al., RNA 20, 1666-1670 (2014)) to identify the endogenous circRNAs which harbor the active IRES. Data was gated against false positive by only considering circRNAs that have been annotated by two different circRNA prediction algorithms, and only including circRNAs with high mapping score in this analysis. The result suggested a high proportion of the endogenous circRNAs are potentially protein-coding: Out of 2,052 endogenous circRNAs containing the oligo sequences from the synthetic library used for the screening assay, 979 circRNAs (~48%) contain one or more eGFP(+) oligo sequences (IRES(+) circRNAs) (FIG. 6A, FIG. 16A, Table 6). These circRNAs were generated from various parent genes which showed a fairly homogenous distribution across the genome (Gini index=0.38) (FIG. 6B). To further determine if these IRES(+) circRNAs are associated with cancer progression, the cancer-specific circRNA database (CSCD) (Xia et al., Nucleic Acids Res 46, D925-D929 (2018)) was examined, which contains the collection of potential cancer-associated circRNAs by analyzing the RNA-seq data of 228 cancer and normal cell lines. Interestingly, it was discovered that 294 of 979 IRES(+) circRNAs (~30%) are expressed specifically in either non-transformed cell lines (n=141 cell lines) or cancer cell lines (n=87 cell lines across 19 cancer types), respectively (FIG. 6C), indicating their potential association with cancer progression.

Figure 6D:
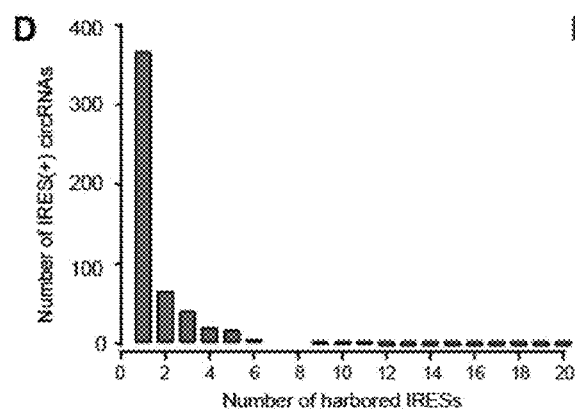
Figure 6E:
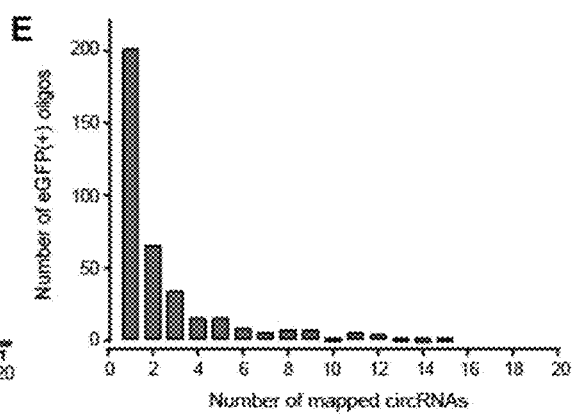
Figure 6F:
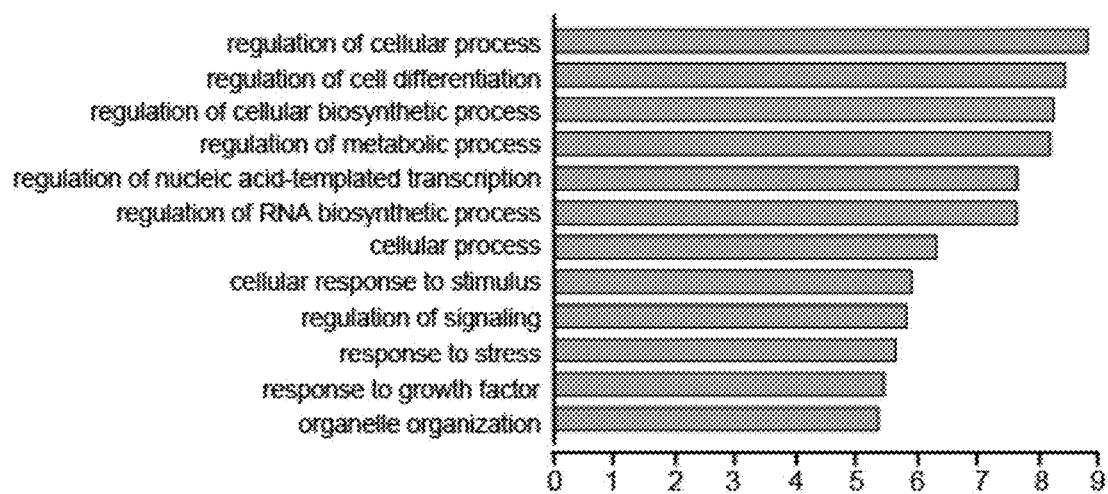
Figure 16B:
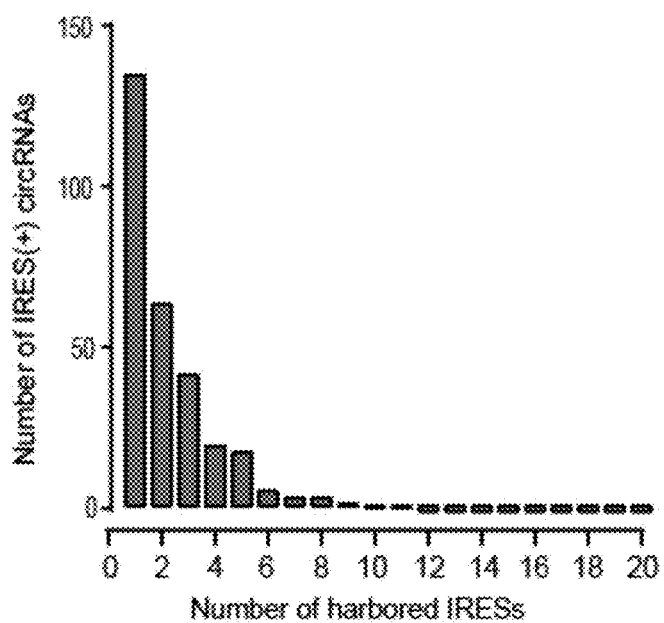
Figure 16C:
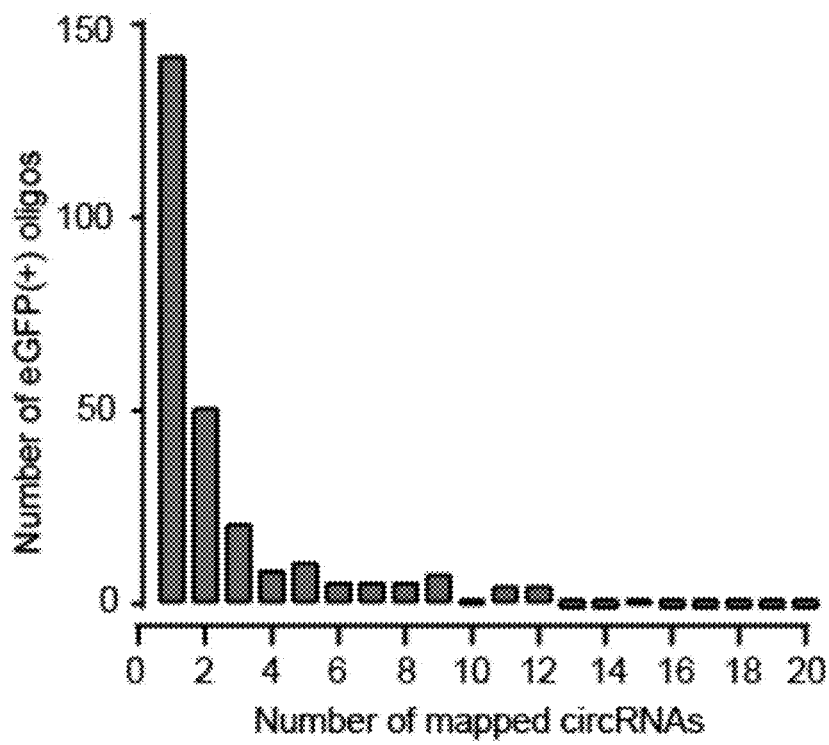
Figure 16D:
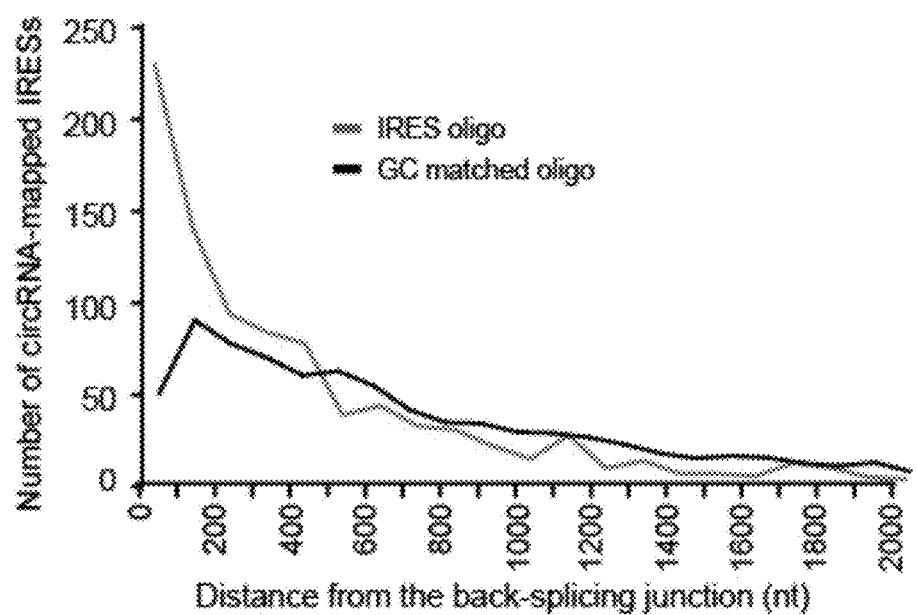

It was discovered that most IRES(+) circRNAs contain only one IRES (FIG. 6D) and most eGFP(+) oligos map to only one circRNA (FIG. 6E), suggesting a specific one-to-one relationship between these IRES(+) circRNAs and the proteins encoded by them. This result is expected in part based on the library design. In addition, for 159 transcripts for which oligos tiling across the entire transcripts were designed, a preponderance of one IRES per circRNA was observed (FIGS. 16B and 16C). Thus, circRNA IRES would have been difficult, if impossible, to discover by comparative sequence analysis across circRNAs, but can be discovered by unbiased functional screening. The result also suggests that circRNA IRES activity may require long RNA sequences which are more likely to show up once per transcript, rather than very short or repetitive sequences that would show up multiple times per transcript. Furthermore, it was discovered that the position of mapped eGFP(+) oligos on circRNAs is most frequently near the back-splicing junction of the circRNA (within 100-200 nt from the junction), while the average position of GC-matched oligos (the 174 nt oligos on the IRES-mapped circRNA with the same GC content as the mapped eGFP(+) oligo) showed a random distribution across a wide range of distance from the back-splicing junction on the circRNAs (100 to 2000 nt from the junction) (FIG. 16D). This result suggests that the cap-independent translation activity of the IRES on the circRNA is back-splicing dependent—the IRES element or its downstream open reading frame (ORF) is only assembled upon back-splicing. This requires the IRES to be located in the proximity of the junction to facilitate its cap-independent translation activity. Finally, gene ontology (GO) analysis of the parent genes of these circRNAs suggested that they are enriched in stress-response and translation regulation (FIG. 6F). Above all, these results demonstrated that with the identified eGFP(+) oligo sequences, it is possible to determine endogenous circRNAs with potential cap-independent translation activity that may encode new protein isoforms.

Example 8

This example describes the identification of potential endogenous circRNA-encoded polypeptides.

Figure 6G:
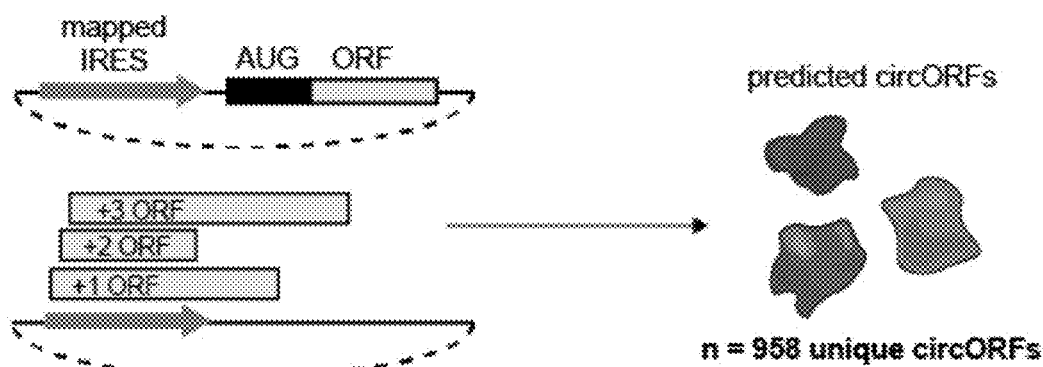

In order to determine the polypeptide sequence of proteins encoded by RNA, protein-coding sequence on the RNA were defined. This is commonly achieved by ORF analysis. However, ORF analysis on circRNAs often returns a large number of results due to the lack of information of where translation initiates on the circRNA. The data presented herein can map the position of eGFP(+) oligo sequences on the circRNA, which allows for determination of the regions on circRNAs where the translation start sites may be located. Thus, to determine the potential polypeptide sequence of the proteins encoded by the endogenous circRNAs, the eGFP(+) oligo sequences were mapped to the sequence of each individual high-confident circRNA in the circBase (pre-gated the high confident circRNAs as described above) to determine the location of the IRES on each circRNA (FIG. 6G). Predicted polypeptide sequences of the protein(s) encoded by each circRNA were then generated by performing ORF analysis from the immediate downstream translation initiation codon (AUG) of the mapped IRES location (FIG. 6G). Because many IRES have been reported to be able to initiate translation from non-canonical initiation codons, ORF analysis was also performed on the top three frames (+1 to +3) with non-canonical initiation codons from the mapped IRES position (FIG. 6G). With this method, a list of predicted polypeptide sequences encoded by human endogenous circRNAs (circORFs) was generated. To be conservative, micropeptides encoded by linear RNAs were also examined and any overlapped circORFs were excluded in the final list (n=5 overlapped circORFs). The final list contains 958 potential circORFs encoded by endogenous circRNAs (FIG. 6G, SEQ ID NO: 32954,-33911, Tables 7A and 7B).

Figure 16G:
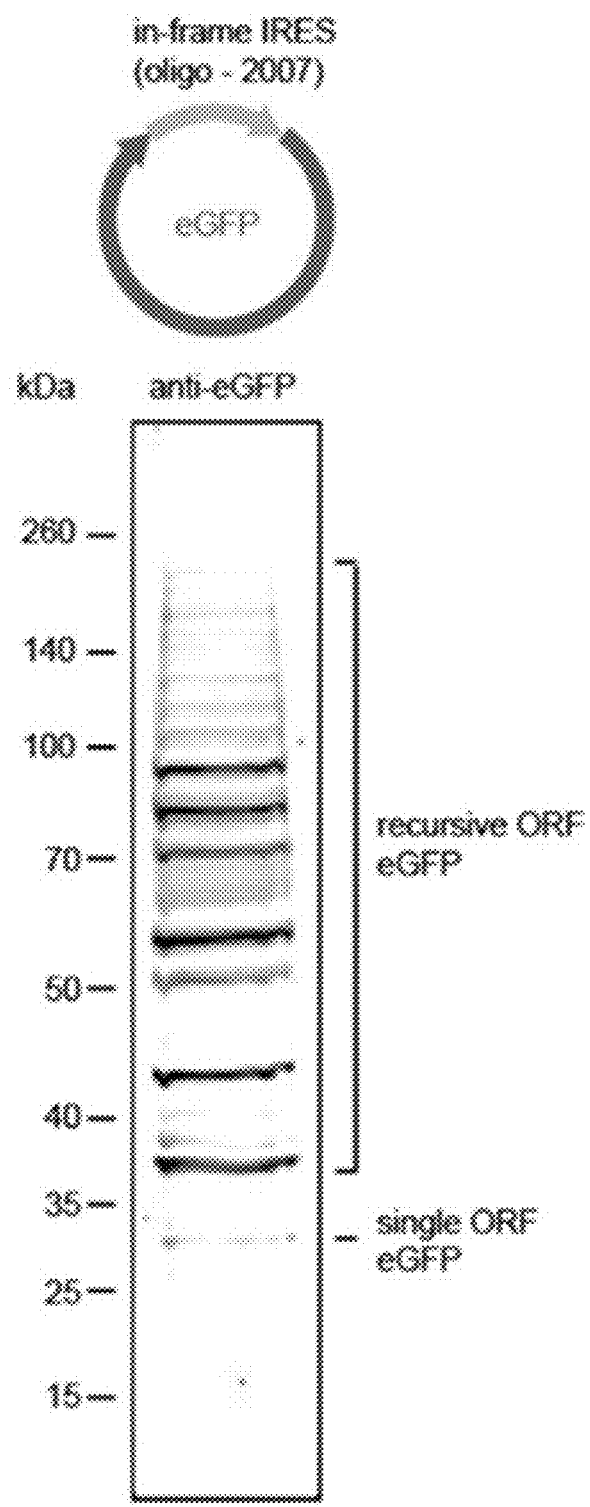

By analyzing the circORF sequences and mapped IRES position on the circRNAs, it was discovered that some circRNAs contain the IRES sequence overlapping the translated region of the ORF (n=457; ~48%) (FIG. 16E). The IRES-overlapping ORF has been observed in some endogenous circRNA-encoded proteins, which suggests some regulatory mechanisms may exist between the initiation and the elongation of circRNA translation. Interestingly, among these circRNAs with IRES-overlapping ORFs, some of them contain in-frame ORFs without stop codons (n=82; ~18%), forming recursive ORFs which may be the mechanism of amplifying the expression level of the circRNA-encoded proteins (FIG. 16F). It was further demonstrated that the in-frame IRES can indeed produce recursive ORF on the eGFP circRNA reporter (FIG. 16G).

Figure 6H:
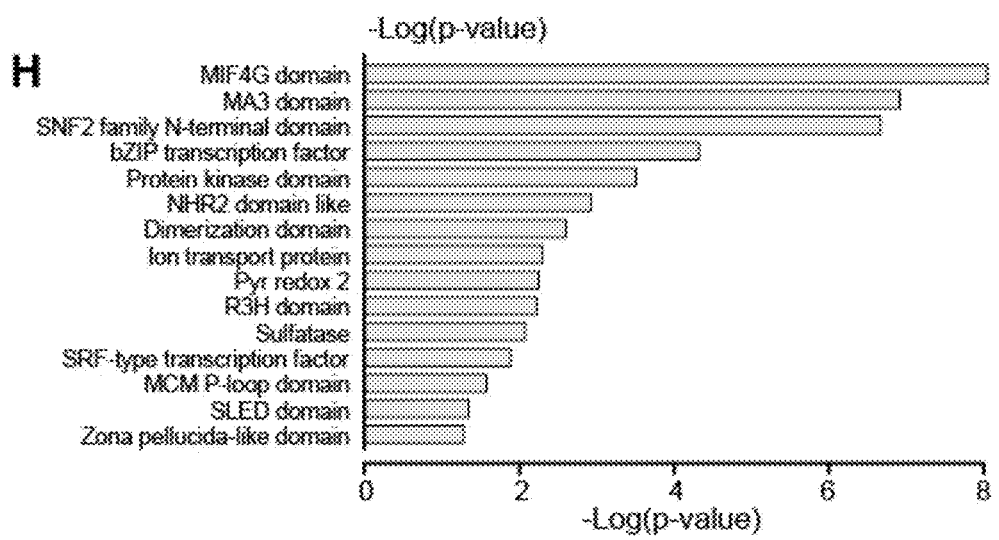
Figure 16H:
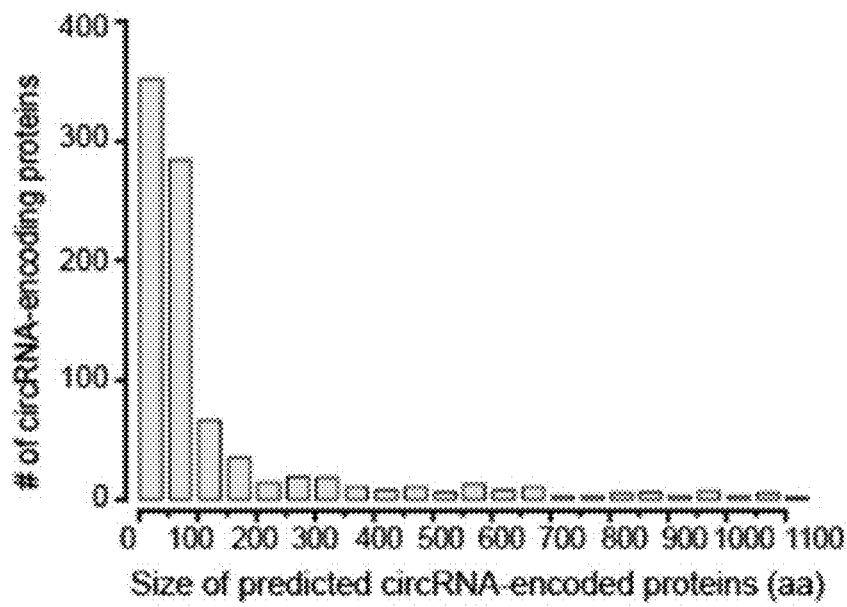

Next, it was the general functions of these potential circORFs were characterized by searching for conserved motifs on the predicted polypeptide sequences. Pfam analysis revealed that a substantial number of circORFs contain conserved motifs. The top motifs are DNA binding motifs, translation elongation factors binding motifs, protein kinase domains, and protein dimerization domains (FIG. 6H), suggesting that circORFs may play roles in regulating various biological functions including signal transduction, transcription, and translation. The size of most of these potential circORFs was small (<100 amino acids) (FIG. 16H), which suggests that the majority of them may be the truncated forms of the proteins generated from their parent linear transcripts.

Figure 16I:
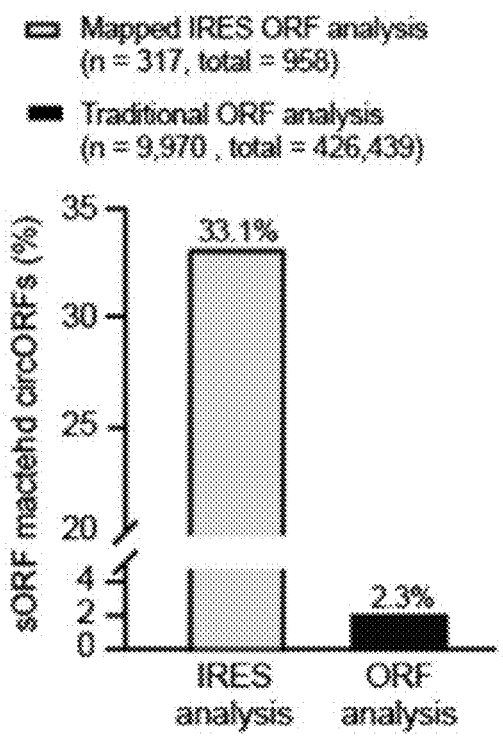

To further validate the potential circORFs, the short open reading frame (sORFs) database was examined (Olexiouk et al., Nucleic acids research 46, D497-D502 (2017)), which contains the polypeptide sequences (<100 amino acids) from the identified sORFs aggregated by multiple ribosome profiling studies, to checked if the polypeptide sequences of these sORFs can match the circORFs. The sORFs were first mapped to the current proteome database (UniProt) and those sORFs that completely matched the ORFs of the annotated linear transcripts were excluded. The remaining sORFs were then mapped to the potential circORFs. 317 predicted circORFs were identified, which can be matched by the sORFs (~33%) (FIG. 16I), suggesting that the mapped IRES ORF analysis method can identify endogenous circORF efficiently. On the other hand, traditional ORF analysis on the same circRNAs, which takes all possible translation initiation locations, gives a huge number of predicted polypeptides (n=426,439), where only a very small fraction of those polypeptides were captured by sORF studies (n=9,970; ~2%) (FIG. 16I). Thus, knowledge of the circRNA IRES led to an ~15-fold improvement in predicting circRNA derived sORFs. Together, the result suggests that in comparison to traditional ORF analysis, the mapped IRES ORF analysis is able to identify endogenous circORFs more efficiently.

Figure 6I:
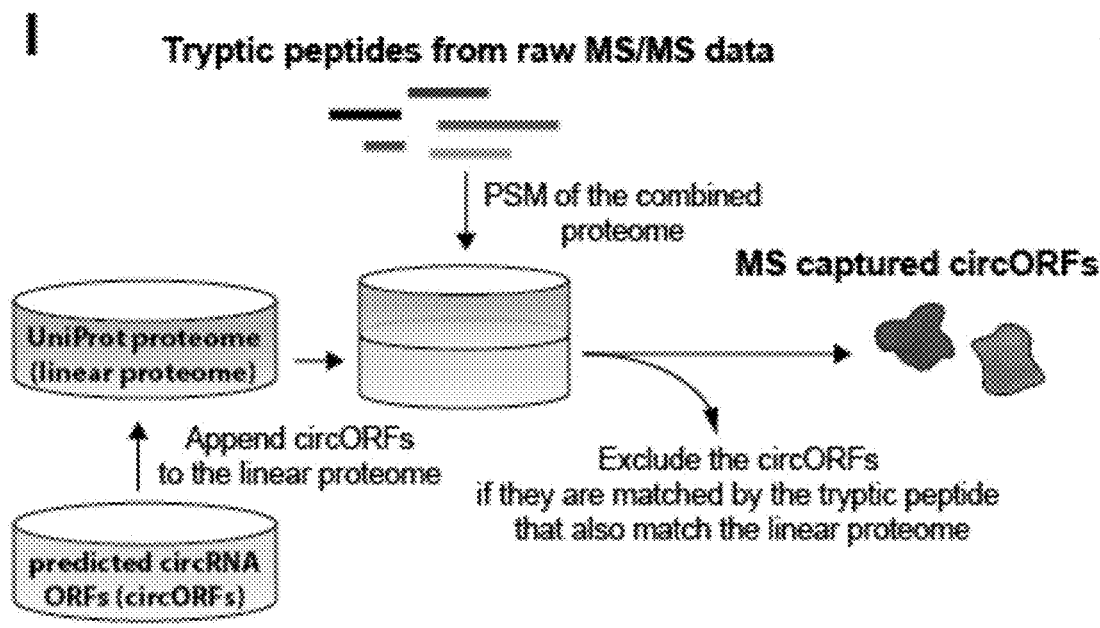
Figure 6J:
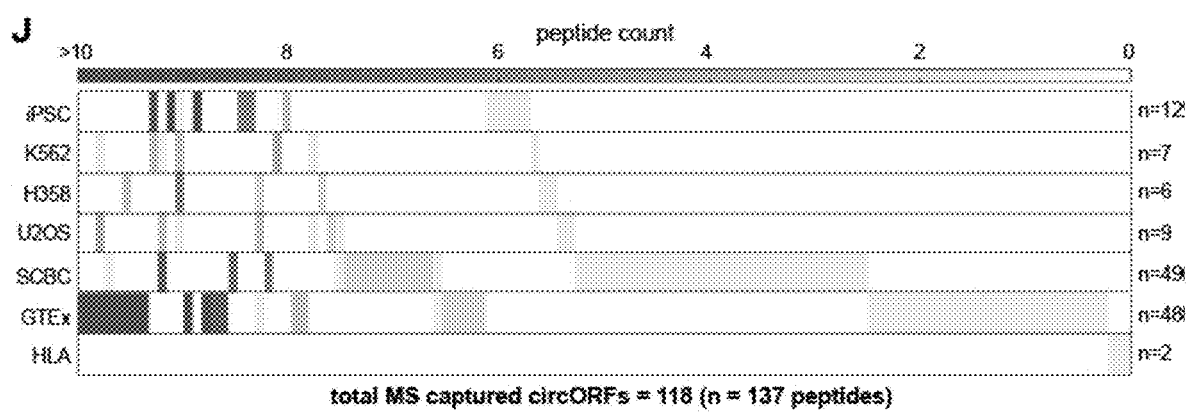
Figure 6K:
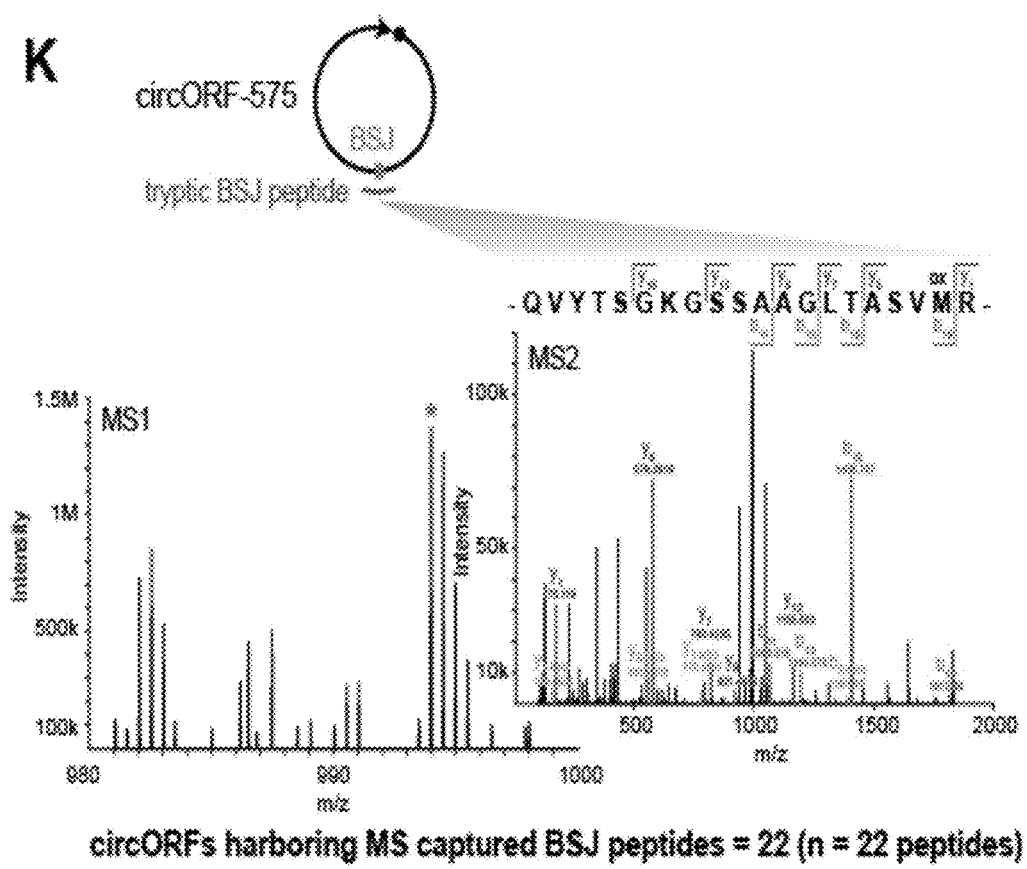
Figure 6L:
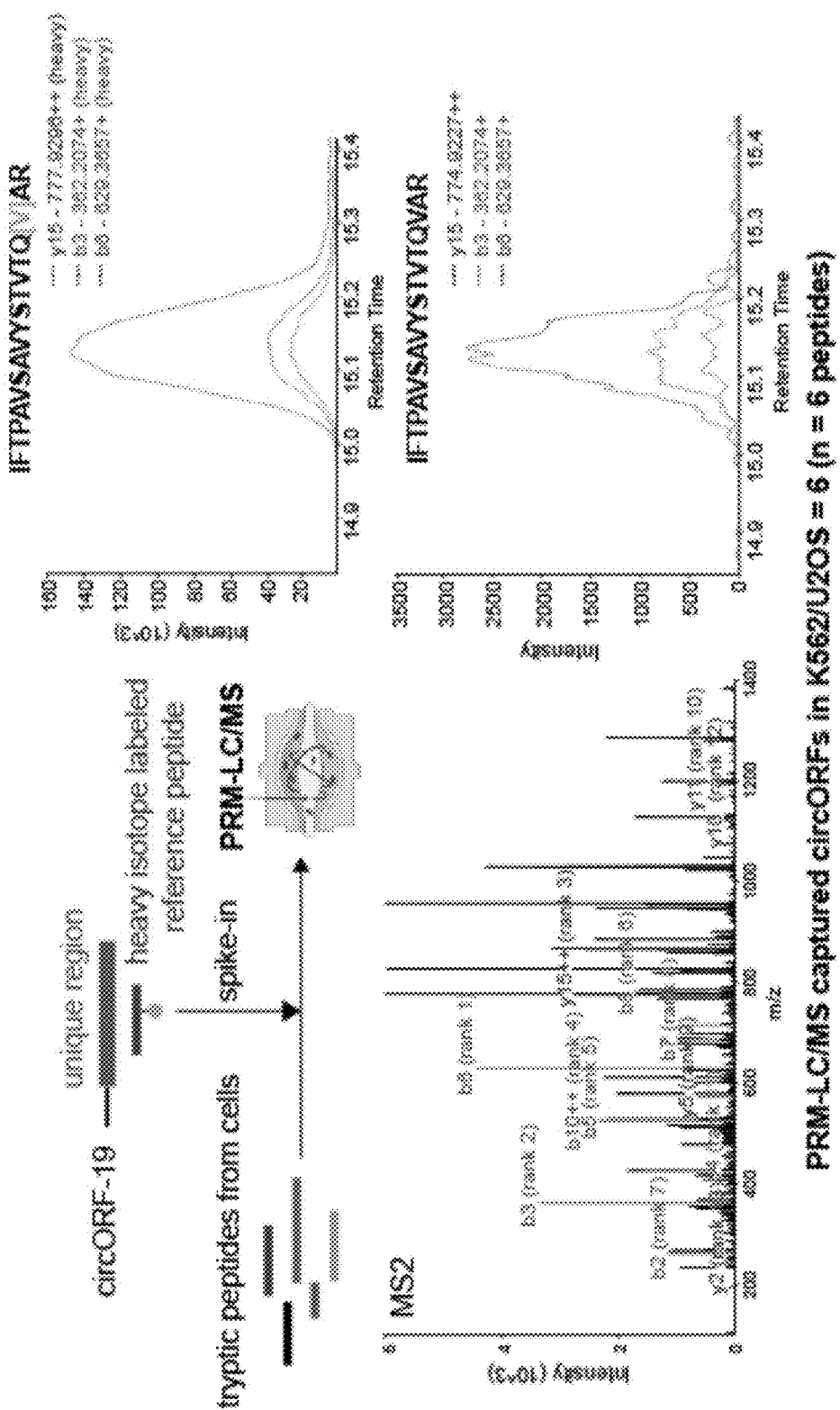
Figure 16J:
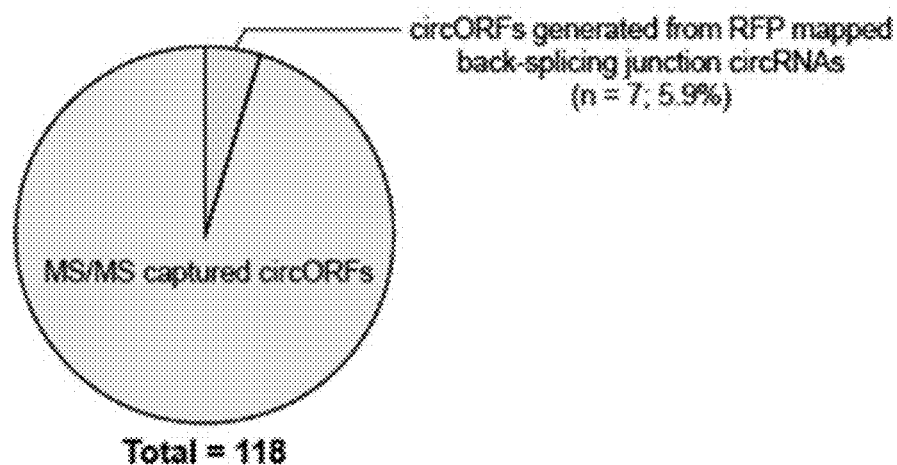

Subsequently, peptidomic analyses was performed on the tandem mass spectrometry (MS/MS) datasets to validate the endogenous expression of the circORFs. Specifically, the predicted circORF list was appended to the current proteome database (UniProt; linear proteome) and generated a combined proteome database (circORFs+linear proteome). The raw MS/MS data was then taken from a wide range of cell lines, including K562, H358, U20S, subcellular compartments SubCellBarCode (SCBC) database, and 32 normal human tissues from the GTEx collection and performed peptide-spectrum match (PSM) against the combined proteome database (FIG. 6I). To distinguish circORFs from the linear proteome, the circORFs were excluded if the circORFs are matched by the tryptic polypeptides that can also match the linear proteome (FIG. 6I). 118 circORFs harboring MS-matched unique tryptic polypeptides (FIG. 6J) were captured, in which 22 circORFs harboring MS-matched tryptic polypeptides spanning across the circRNA back-splicing junction (BSJ) (FIG. 6K). In addition to the transformed cell lines, circORFs in the peptidomics of normal human tissues were captured (Jiang et al., 2020), suggesting that these circORFs are expressed in normal human cells. Moreover, parallel reaction monitoring-MS (PRM-MS) was performed to provide high resolution validation of the circORF expression in K562 and U20S. Specifically, the heavy isotope-labeled reference polypeptides of the unique region of the circORFs identified from the K562 and U20S MS/MS peptidomics were designed and synthesized, the labeled reference polypeptides were spiked in to the tryptic polypeptide samples, and precursor and transition ions detection was performed according to the labeled reference polypeptides (FIG. 6L, SEQ ID NO: 32954-33911, and Tables 7A and 7B). The PRM-MS further validates the existence of 6 out of 8 targeted circORFs (FIG. 6L, SEQ ID NO: 32954-33911, and Tables 7A and 7B). The MS/MS and the PRM-MS peptidomics provide strong evidence demonstrating the circORFs are indeed expressed endogenously. As a complementary approach, the ribosome footprinting (RFP) data was examined in human iPSCs (Chen et al., Science (2020) 367(6482):1140-1146), and it was found that 7 MS/MS detected circORFs contain at least one RFP fragment overlapping uniquely with the circRNA back-splicing junction (FIG. 16J). Together, these results suggest that it is possible to build a putative circORF list using the circRNA IRES screening assay which can be validated by genomic and peptidomic analyses.

To further examine if the circORFs are involved in antigen presentation, the human leukocyte antigen I (HLA1)-associated peptidomics was analyzed (Bassani-Sternberg et al., 2015). Two HLA1-associated circORFs were identified (FIG. 6J). In silico HLA1 binding predictor NetMHC4.1 analysis (Reynisson et al., 2020) suggests that these two circORFs are indeed strong HLA1 binder to the HLA1 variants expressed in the cell line used in HLA1 peptidomics (HLA-A03:01 for circORF_674 in fibroblast; HLA-C07:02 for circORF_917 in JY) (Tables 7A and 7B). The result indicates a new functional role of circORFs that some of the circORFs may enter the HLA-I presentation pathway and contribute to the antigen repertoire.

Figure 16K:
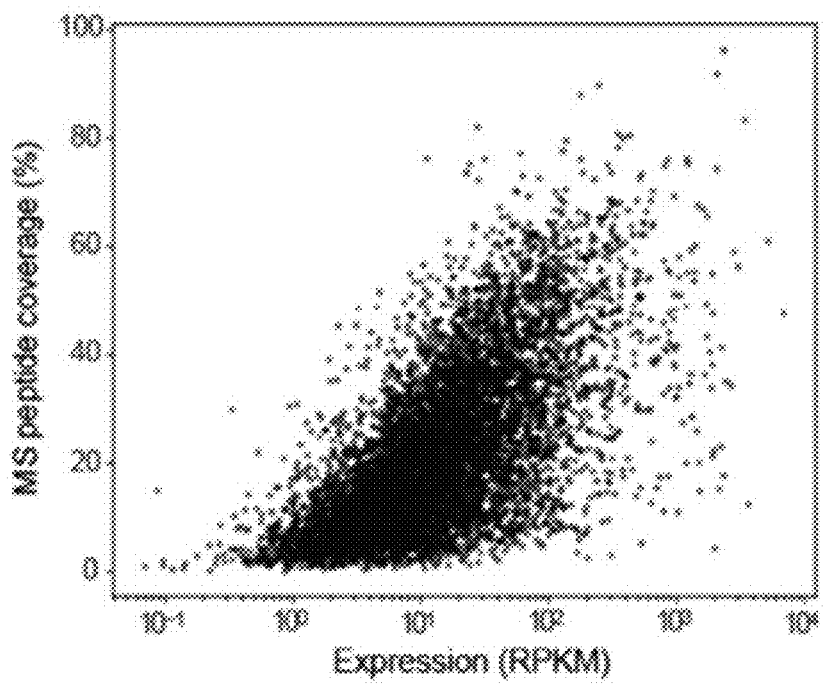
Figure 16L:
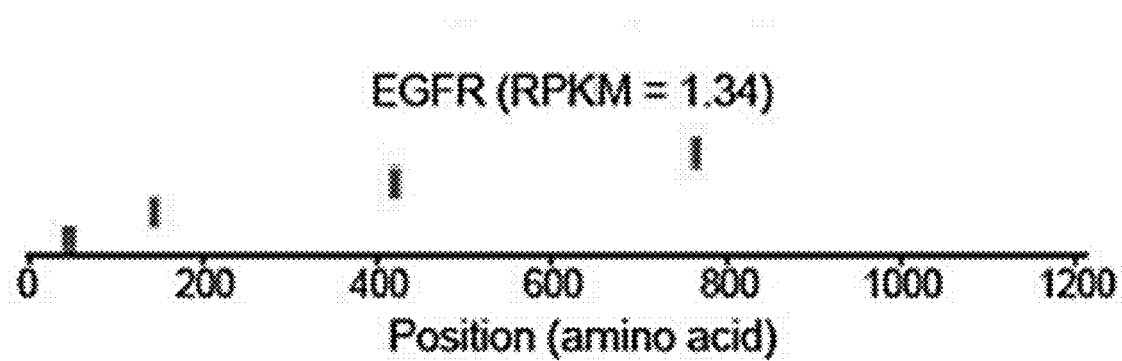

Notably, circORF detection by MS-based peptidomics is limited by (i) insufficient power to capture low abundance circORFs arising from low circRNA expression level in general, (ii) potential instability of circRNA-encoded polypeptides, (iii) the intrinsic difficulties to detect generally short circORFs, (iv) the number of cell lines/types of peptidomic datasets available, and (v) the narrow reference space of circORF unique polypeptides since all the regions that are shared by circORF and the linear proteome were excluded. Given the limitations of circORF peptidomics, identification of circORFs was interpreted as positive validation; the absence of detection in MS proteomic data does not rule out the translational potential for circRNA candidates. In line with the limitations above, when the same limitations were applied to proteins encoded by known mRNAs, matching for expression level and the cell line examined, and down-sampled reference space, it was found that current peptidomic data can only recover ~5% polypeptides of the protein encoded by the mRNA with the same RPKM as the mean circRNA RPKM (FIGS. 16K and 16L). Moreover, the expected discovery rate of circORFs is estimated to be ~4% since, since only the circORF unique regions are searched. The fact that it is possible to validate ~12.3% (118 out of 958) circORFs with peptidomics, which is much higher than the expected discovery rate for circORFs, further highlights that the approach disclosed herein can efficiently identify candidate endogenous circORFs, and supports the contention that circRNAs widely encode polypeptides similar to moderately expressed mRNAs.

Example 9

This example demonstrates that circFGFR1p suppresses cell proliferation under stress conditions through a dominant-negative regulation.

To evaluate the potential functions of the expanded circRNA proteome, an example of a potential protein-coding circRNA, hsa_circ_0084007, was chosen, and the function of its encoded protein was further examined. The circRNA is generated from the back-splicing of the exon 2 and the exon 7 of the human Fibroblast Growth Factor Receptor 1 (FGFR1) transcript; hence the names circFGFR1 and circFGFR1p were used to refer to this circRNA and its encoded protein, respectively. Down-regulation of circFGFR1 has been observed in clinical cancer patient samples, which may suggest its role in regulating important biological processes. CircFGFR1 harbors an IRES showing strong eGFP expression in the screening assay (top 2%), located in the 5' UTR region of FGFR1 followed immediately by an annotated AUG translation start codon (FIG. 7A). ORF analysis using the immediate downstream AUG revealed that the back-splicing generates a de novo stop codon within the IRES of circFGFR1, resulting in an ORF that partially overlaps with the IRES (circORF_949) (FIG. 7A). To better characterize the phenotype and the function regulated by circFGFR1, a non-transformed human cell line, BJ fibroblasts, was utilized for subsequent analysis. This cell line has a diploid genome for better phenotypic analysis and high FGFR1 expression. First, it was checked whether circFGFR1 expression can be detected in BJ cell by reverse transcriptase PCR (RT-PCR) and Sanger sequencing using the divergent primers flanking the back-splicing junction of the exon 2 and the exon 7 on circFGFR1 (FIG. 7B). The results demonstrated that circFGFR1 expression in BJ cells can successfully be detected.

Figure 17A:
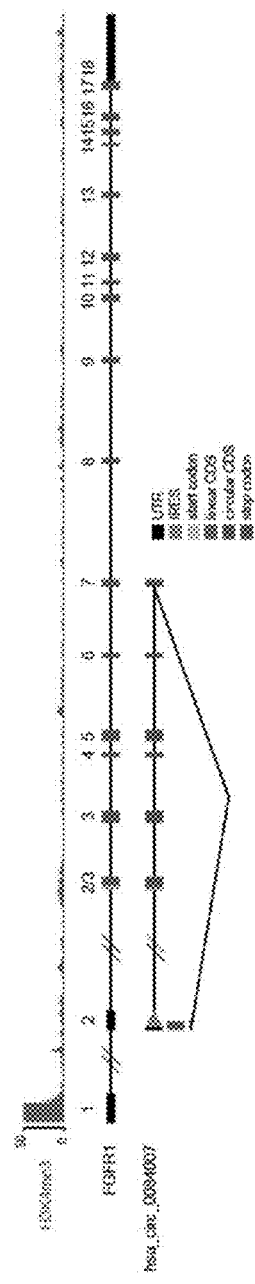
FIG. 17A-17I show that circRNA-encoded circFGFR1p suppresses cell growth under stress conditions.

Analysis of the predicted protein sequence indicated that circFGFR1p encodes a truncated form of FGFR1, which has an intact extracellular fibroblast growth factor 1 (FGF1) ligand-binding site, part of the dimerization domain (IgI, IgII, and partial N' terminus of IgIII) but lacks the intracellular FGFR1 tyrosine kinase domain (FIG. 7C). CircFGFR1p also harbor a unique region due to circFGFR1 back-splicing, where the polypeptide sequence of this region does not present in the linear proteome (UniProt) database (FIG. 7C). Western blotting using an antibody against the common region of circFGFR1p and FGFR1 (Ab-both) showed signals at the corresponding size of circFGFR1p (~38 kDa) and FGFR1 (70-90 kDa) (FIG. 7K). ENCODE data demonstrated an absence of chromatin signature of promoters (H3K4me3) near circFGFR1p IRES (FIG. 17A), suggesting the protein was not generated from the truncated linear transcript due to hidden promoters located in the exon 2 of FGFR1. In line with the observation above, the circFGFR1 IRES identified (oligo index: 8228) does not display promoter activity from the linear RNA IRES reporter screens (score=0) (Weingarten-Gabbay et al., 2016).

Figure 7D:
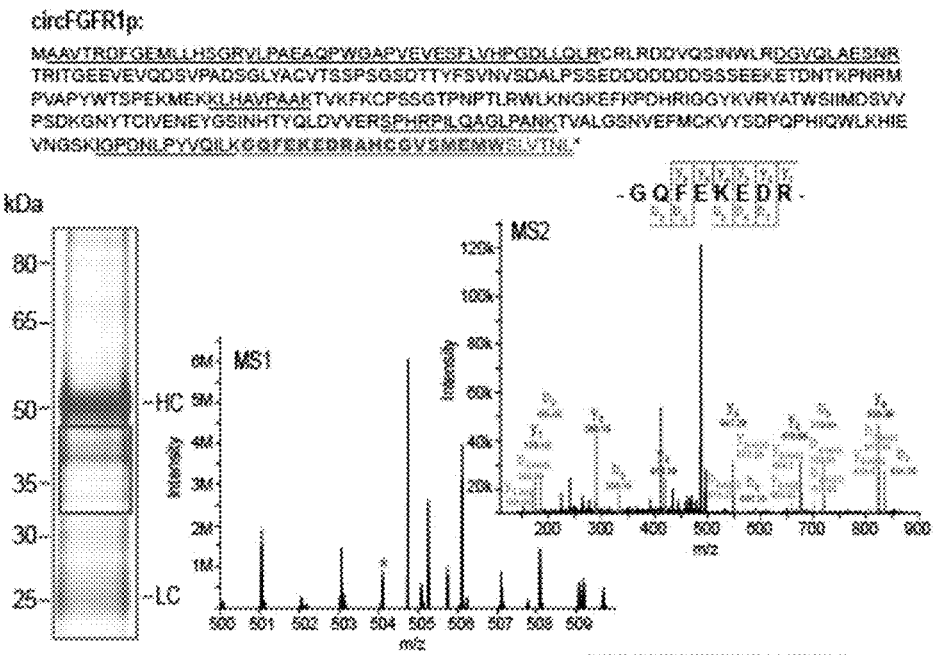
Figure 7E:
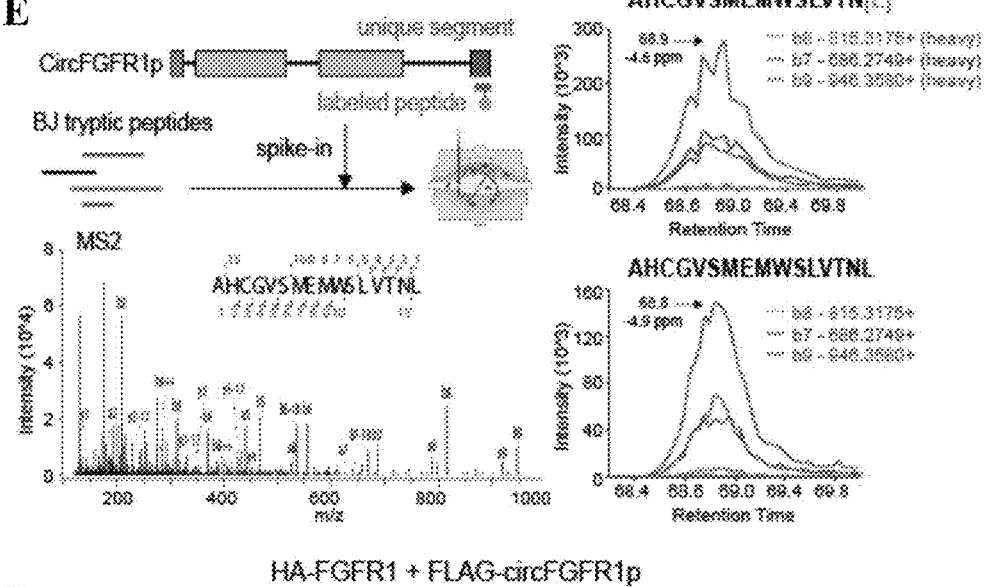

To validate endogenous circFGFR1p expression, a custom antibody against the unique region of circFGFR1p was generated. circFGFR1p was isolated by immunoprecipitation (IP) using the custom antibody, and proteins (size selected ~30-45 kDa on a polyacrylamide gel to separate circFGFR1p from FGFR1) were subjected to liquid chromatography with tandem mass spectrometry (LC-MS/MS) (FIG. 7D). While no circFGFR1p polypeptides were detected in the IgG control sample, it was possible to detect the tryptic polypeptides of the unique region of circFGFR1p as well as the tryptic polypeptides overlapped with the linear FGFR1 in the IP-LC-MS/MS sample (FIG. 7D). The result suggests that circFGFR1p is indeed expressed and can be captured by the circFGFR1p antibody. To further confirm circFGFR1p expression in high resolution, PRM-MS was performed using a synthetic heavy isotope-labeled reference polypeptide of the circFGFR1p unique region. It was possible to identify the corresponding precursor and transition ions of the labeled reference polypeptide and the sampling tryptic polypeptide from BJ cells, respectively (FIG. 7E). Collectively, the IP-MS and the PRM-MS provide the strong evidence demonstrating endogenous circFGFR1p expression.

Figure 7F:
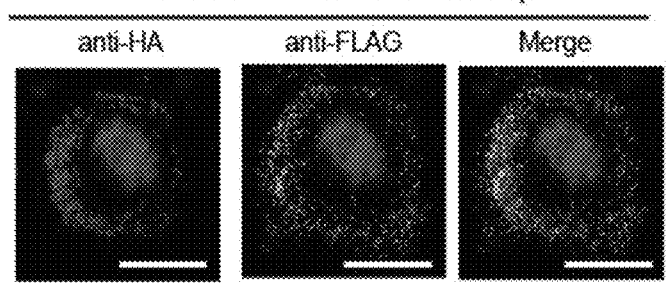
Figure 7J:
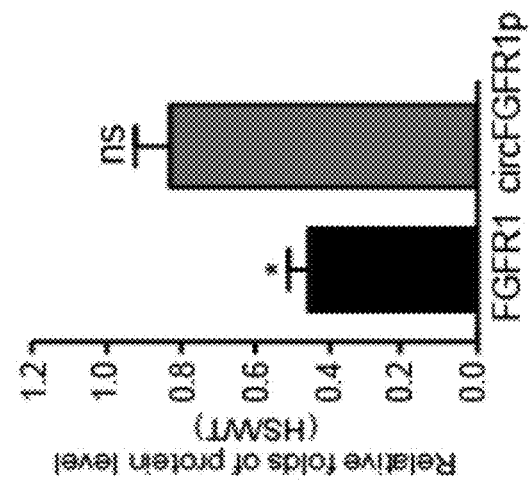
Figure 7K:
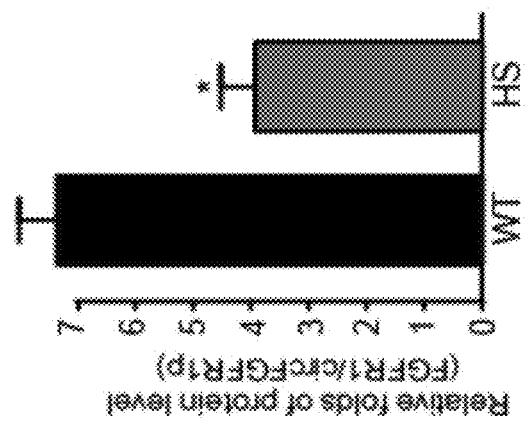
Figure 7L:
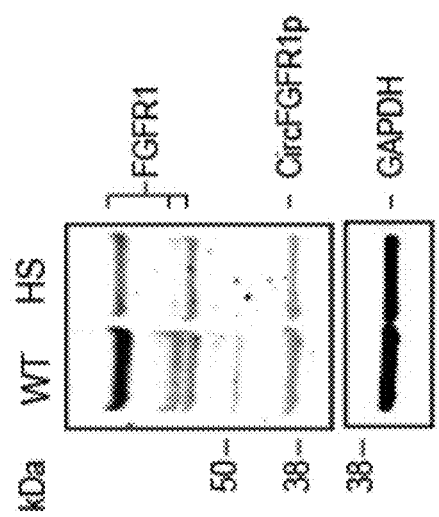
Figure 17B:
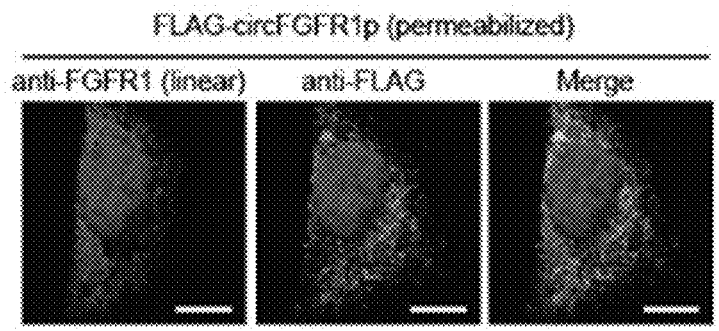
Figure 17C:
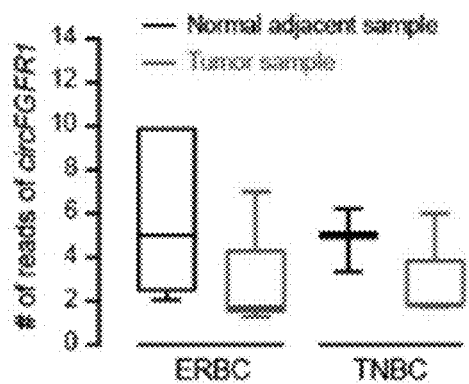
Figure 17D:
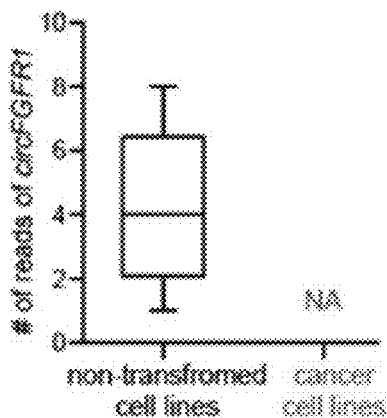

Upon binding to FGF, full-length FGFR1 dimerizes and autophosphorylates the kinase domain, which further triggers the downstream signaling pathway and facilitates cell proliferation. By co-expressing HA-tagged FGFR1 and FLAG-tagged circFGFR1p in HEK-293T cells and co-staining HA- and FLAG-tag to label FGFR1 and circFGFR1p respectively, it was confirmed that circFGFR1p is localized at the cell membrane in patchy domains and endosomes similarly to FGFR1 (FIG. 7F and FIG. 17B). CircFGFR1 contains the FGFR1 dimerization/ligand-binding domain but lacks the kinase domain, suggesting circFGFR1p may function as a dominant-negative regulator of FGFR1 that suppresses cell proliferation. Moreover, lower circFGFR1 expression level was found in the tumor samples of different subtypes of breast cancer in comparison to the normal adjacent samples from studies analyzing the RNA-sequencing data from The Cancer Genome Atlas (TCGA) (FIG. 17C). In addition, circFGFR1 expression was detected specifically in the non-transformed cell lines (n=5 unique non-transformed cell types out of 141 non-transformed cell line samples), but not in the cancer cell lines (n=87 cancer cell lines out of 87 cancer cell line samples) on the CSCD database (Xia et al., 2018) (FIG. 17D). These studies suggest that reduced circFGFR1 expression level may be associated with cancer progression by upregulating cell proliferation. Thus, circFGFR1p appears to function as a negative regulator of FGFR1 through a dominant-negative mechanism that suppresses cell proliferation.

To test this hypothesis, circFGFR1 was first knocked down specifically with siRNAs targeting the back-splicing junction of circFGFR1 (FIG. 7G). It was discovered that knockdown of circFGFR1 can indeed facilitate cell proliferation upon FGF addition (FIG. 7H), suggesting that circFGFR1 negatively regulates FGFR1 function of facilitating cell proliferation. To confirm that the cell proliferation phenotype that was observed resulted from the downregulation of circFGFR1p protein rather than circFGFR1 RNA, the cell proliferation phenotype was further examined upon downregulating circFGFR1p protein specifically by disrupting the cap-independent translation of circFGFR1p IRES. Since the translation initiation is typically the rate limiting step of translation, the anti-sense LNA targeting the 18S rRNA complementary sequence on the circFGFR1 IRES (LNA-18S of IRES-8228) was utilized, which was found to effectively blocks circFGFR1p translation initiation (FIGS. 5B and 5D), to knock down circFGFR1p specifically without altering the level of circFGFR1 or FGFR1 RNA (FIG. 7G). LNA-mediated inhibition of circFGFR1 IRES caused a lower expression level of circFGFR1p and a higher level of phosphorylated FGFR1 (FIG. 7G), suggesting that knocking down circFGFR1p, but not circFGFR1 RNA, can indeed lead to an increase in FGFR1 phosphorylation, leading to a higher level of active FGFR1 (phosphorylated FGFR1). It is also in line with the observation that knocking down circFGFR1p leads to a higher cell proliferation rate (FIG. 7H). Interestingly, the depletion of circFGFR1p also leads to a higher level of total FGFR1 protein (FIG. 7G). The result suggests that circFGFR1p functions not solely as a dominant-negative of FGFR1 signal transduction, but circFGF1p also somehow inhibits full-length FGFR1 accumulation, perhaps by increasing FGFR1 turnover or degradation. A similar FGFR1 degradation phenotype has also been observed when dominant-negative variants of FGFR1 are expressed in vivo. Conversely, it was checked if circFGFR1 overexpression in cells can suppress cell proliferation by encoding circFGFR1p with a FLAG epitope tag. Then, it was cloned it into a linear mRNA expression plasmid driven by CMV promoter to effectively overexpress circFGFR1p, and the circFGFR1p expression plasmid was transfected into BJ cells (FIG. 7I). The results demonstrated that circFGFR1p overexpression (circFGFR1pOE) can indeed suppress cell proliferation (FIG. 7I). In addition, when FGFR1 and circFGFR1p were co-overexpressed in cells (FGFR1OE+circFGFR1pOE), the phenotype of cell proliferation suspension was partially rescued (FIG. 7I), which further suggests the antagonistic function of circFGFR1p for FGFR1. These results suggest that circRNA-encoded circFGFR1p can suppress cell growth by interacting with FGFR1 through a dominant-negative mechanism.

Figure 17E:
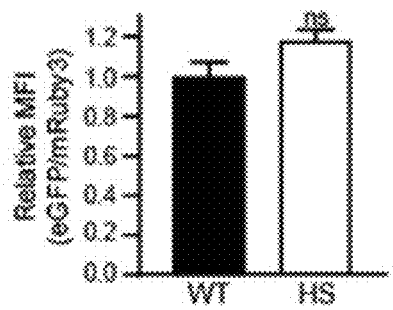
Figure 17F:
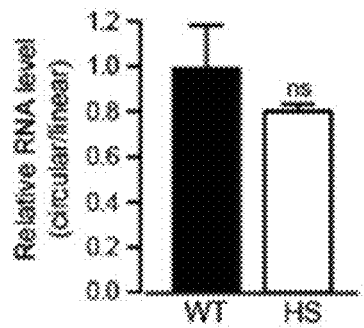
Figure 17G:
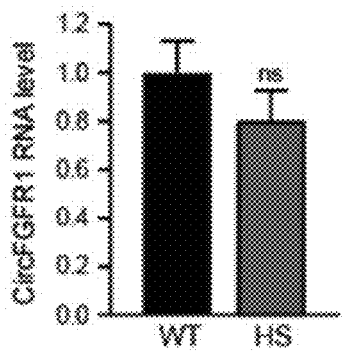
Figure 17H:
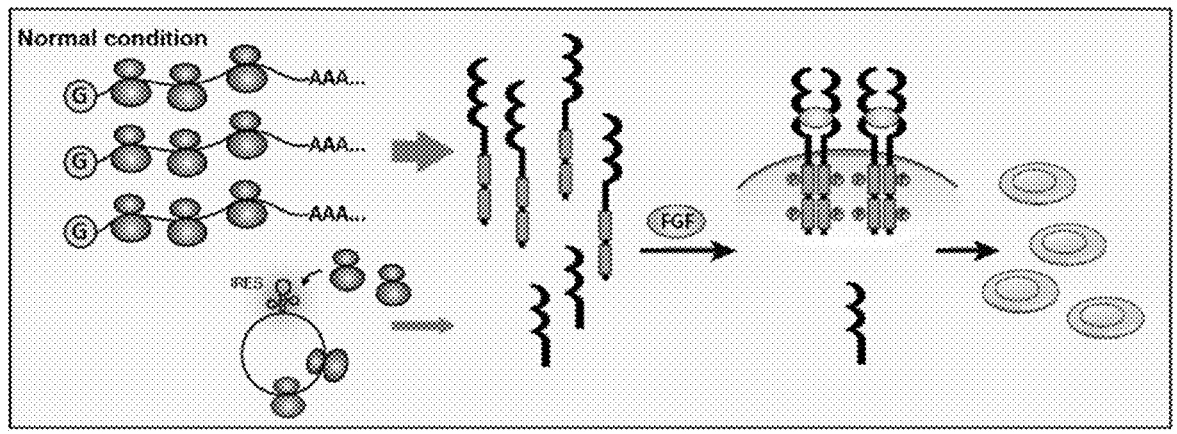
Figure 17I:
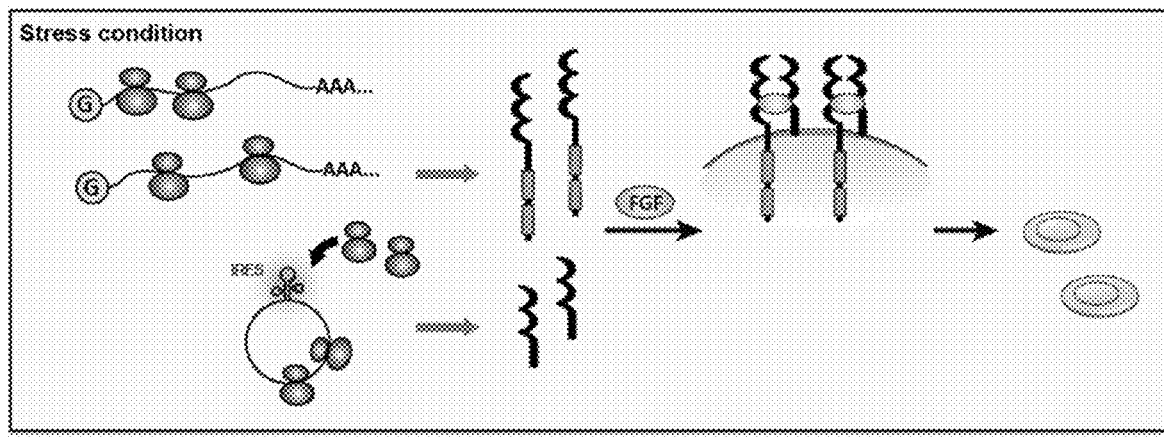
Figure 18A:
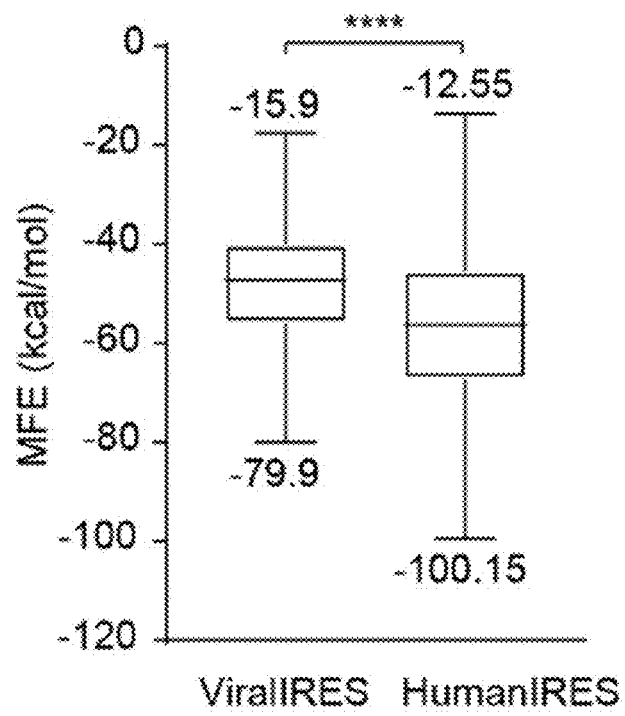
FIG. 18A-18B shows mean free energies (MFE) of various IRES identified and/or tested in the screen described herein.
Figure 18B:
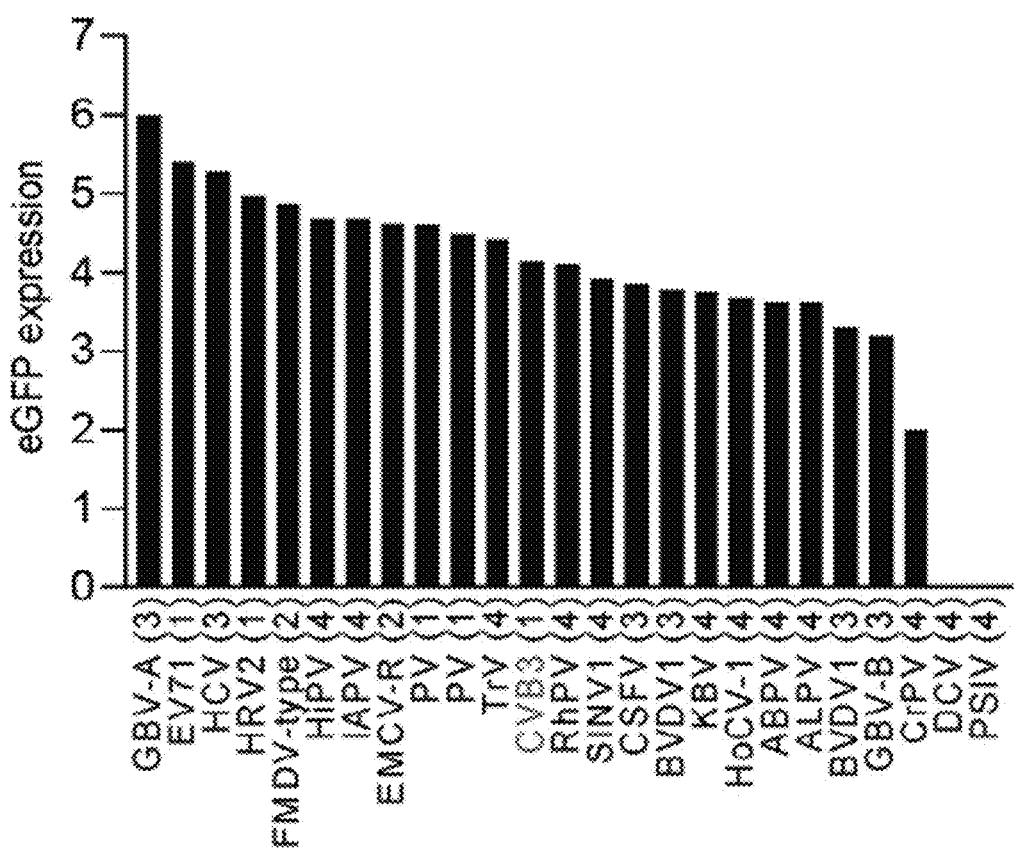

In comparison to FGFR1, the expression level of circFGFR1p is relatively low (FIGS. 7J and 7K), which indicates that circFGFR1p may not be a strong regulator under normal conditions. Nevertheless, many IRESs have been reported to have steady cap-independent translation activity under stress conditions, including the IRES of some endogenous protein-coding circRNAs, such as circZNF-609. Thus, the cap-independent translation activity of circFGFR1 IRES under stress conditions, such as under heat-shock, was further examined. First, cells were transfected with oligo-split-eGFP-circRNA reporter construct driven by circFGFR1 IRES and quantified the circFGFR1 IRES activity with or without the heat-shock. The results demonstrated that the cap-independent translation activity of 15 FGFR1 IRES remains steady during the heat-shock (FIG. 17E). Then, the FGFR1 and circFGFR1p protein levels were examined under the heat-shock condition. It was observed that FGFR1 protein level was downregulated after the heat-shock (FIGS. 7J and 7L), which is likely due to the global reduction in cap-dependent translation caused by the changes in the phosphorylation states of many eukaryotic initiation factors and the sequestration of eIF4G by Hsc70 during the heat-shock. On the other hand, the circFGFR1p level, which is regulated by cap-independent translation, remained steady after the heat-shock (FIG. 7J, 7L and FIGS. 17F and 17G). The result suggests that during heat shock although the global FGFR1 cap-dependent translation reduction is not directly caused by the circFGFR1p level, the reduced FGFR1 level and stable circFGFR1p level enhances the circFGFR1p dominant negative effect and further lower the cell growth rate. Moreover, FGFR1 has been shown to form homomultimers when induced by cell adhesion molecules. The nature of FGFR1 oligomerization may further enhance the dominant-negative effect of circFGFR1p because one circFGFR1p can join and "poison" the signaling ability or lead to degradation of more FGFR1 molecules. These phenomena may explain how lowly expressed circFGFR1p can effectively regulate highly expressed FGFR1 and suppress cell proliferation under heat shock or other forms of cell stress conditions (FIGS. 17H and 17I).

Interestingly, while the circFGFR1 IRES (oligo index: 8228) displayed strong cap-independent translation activity on the circRNA (top 2%), the same IRES showed very weak cap-independent translation activity on the linear RNA (bottom 10%) (Weingarten-Gabbay et al., 2016). This observation suggests that the cap-independent translation activity of circFGFR1 IRES is preferentially activated on circFGFR1 rather than the linear FGFR1 transcripts. This circRNA-5 biased IRES activity of circFGFR1 IRES may also explain how under the heat-shock condition circFGFR1 IRES can selectively produce the steady amount of circFGFR1p without increasing the level of FGFR1 protein isoforms produced from the cap-independent activity of circFGFR1 IRES on the linear FGFR1 transcripts, allowing circFGFR1p to regulate FGFR1 functions more effectively. In sum, the findings presented above demonstrated that with the disclosed methods, not a novel circRNA-encoded protein, circFGFR1p, was discovered that negatively regulates FGFR1 and suppresses cell proliferation through a dominant-negative mechanism under stress conditions. This study also reveals an important regulatory mechanism of circRNAs and their encoded proteins.

Various embodiments of this invention are described herein, including the best mode known to the inventors for carrying out the invention. Variations of these embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

INCORPORATION BY REFERENCE

All references, including publications, patent applications, and patents, cited herein are hereby incorporated by reference to the same extent as if each reference were individually and specifically indicated to be incorporated by reference and were set forth in its entirety herein.

NUMBERED EMBODIMENTS

Notwithstanding the appended claims, the following numbered embodiments also form part of the instant disclosure.

1. A polynucleotide sequence encoding a circular RNA molecule; wherein the circular RNA molecule comprises a protein-coding nucleic acid sequence region and an internal ribosome entry site (IRES) sequence region operably linked to the protein-coding nucleic acid sequence, wherein the IRES sequence region comprises: at least one sequence region having an RNA secondary structure element; and a sequence region that is complementary to an 18S ribosomal RNA (rRNA); wherein the IRES sequence region has a minimum free energy (MFE) of less than −18.9 kJ/mol and a melting temperature of at least 35.0° C.; and wherein the RNA secondary structure element is formed from the nucleotides at about position 40 to about position 60 of the IRES, wherein the first nucleic acid at the 5' end of the IRES is considered to be position 1.

2. The polynucleotide sequence of embodiment 1, wherein the protein coding nucleic acid sequence region is operably linked to the IRES sequence region in a non-native configuration.

3. The polynucleotide sequence of embodiment 1 or 2, wherein the polynucleotide sequence is a DNA sequence.

4. The polynucleotide sequence of any one of embodiments 1-3, wherein the sequence that is complementary to an 18S rRNA is any one SEQ ID NO: 28977-28983.

5. The polynucleotide sequence of any one of embodiments 1-4, wherein the at least one RNA secondary structure element is located 5' to the sequence region that is complementary to an 18S rRNA.

6. The polynucleotide sequence of any one of embodiments 1-4, wherein the at least one RNA secondary structure element is located 3' to the sequence region that is complementary to an 18S rRNA.

7. The polynucleotide sequence of any one of embodiments 1-6, wherein the at least one RNA secondary structure element is a stem-loop.

8. The polynucleotide sequence of any one of embodiments 1-7, wherein the at least one RNA secondary structure element comprises any one of the nucleic acid sequences listed in Table 2.

9. The polynucleotide sequence of any one of embodiments 1-8, wherein the IRES sequence region is about 100 to about 1000 nucleotides in length.

10. The polynucleotide sequence of any one of embodiments 1-8, wherein the IRES sequence region is about 200 to about 800 nucleotides in length.

11. The polynucleotide sequence of any one of embodiments 1-8, wherein the IRES sequence is between 150-200 nucleotides, between 160-180 nucleotides, or between 200-210 nucleotides in length.

12. The polynucleotide sequence of any one of embodiments 1-11, comprising at least one non-coding functional sequence.

13. The polynucleotide sequence of embodiment 12, wherein the non-coding functional sequence comprises one or more (a) microRNA binding sites or (b) RNA binding protein binding sites.

14. The polynucleotide sequence of any one of embodiments 1-11, wherein the DNA sequence comprises an aptamer.

15. A recombinant circular RNA molecule encoded by the polynucleotide sequence of any one of embodiments 1-14.

16. A DNA sequence encoding a circular RNA molecule; wherein the circular RNA molecule comprises a protein-coding nucleic acid sequence region and an internal ribosome entry site (IRES) sequence region operably linked to the protein-coding nucleic acid sequence; wherein the IRES sequence region comprises any one of the nucleic acid sequences listed in SEQ ID NO: 1-228 or SEQ ID NO: 229-17201, or a nucleic acid sequence having at least 90% or at least 95% identity or homology thereto.

17. The DNA sequence of embodiment 16, wherein the protein-coding nucleic acid sequence is operably linked to the IRES sequence region in a non-native configuration.

18. The DNA sequence of any one of embodiments 16-17, wherein the IRES sequence region has a G-C content of at least 25%.

19. The DNA sequence of any one of embodiments 16-18, wherein the IRES sequence region comprises any one of the nucleic acid sequences of SEQ ID NO: 1-228.

20. The DNA sequence of any one of embodiments 16-18, wherein the IRES sequence region comprises any one of the nucleic acid sequences of SEQ ID NO: 229-17201.

21. The DNA sequence of any one of embodiments 16-20, wherein the IRES sequence region comprises the nucleic acid sequence of any one of SEQ ID NOs: 531, 2270, 2602, 3042, 3244, and 33948.

22. The DNA sequence of any one of embodiments 16-21, wherein the IRES sequence region comprises a human IRES.

23. The DNA sequence of any one of embodiments 16-22, wherein the protein coding-nucleic acid sequence region encodes a therapeutic peptide or protein.

24. The DNA sequence of any one of embodiments 16-23, wherein the circular RNA molecule comprises between about 200 nucleotides and about 10,000 nucleotides.

25. The DNA sequence of any one of embodiments 13-24, wherein the circular RNA molecule comprises a spacer between the IRES sequence region and a start codon of the protein-coding nucleic acid sequence region.

26. The DNA sequence of embodiment 25, wherein the length of the spacer is selected to increase translation of the protein-coding nucleic acid sequence region relative to translation of a circular RNA having either no spacer or a spacer that differs from the selected spacer.

27. The DNA sequence of any one of embodiments 16-26, wherein the IRES sequence region is configured to promote rolling circle translation.

28. The DNA sequence of any one of embodiments 16-26, wherein the protein-coding nucleic acid sequence region lacks a stop codon.

29. The DNA sequence of any one of embodiments 16-26, wherein (i) the IRES sequence region is configured to promote rolling circle translation, and (ii) the protein-coding nucleic acid sequence region lacks a stop codon.

30. A recombinant circular RNA molecule encoded by the DNA sequence of any one of embodiments 16-29.

31. A viral vector comprising the polynucleotide of any one of embodiments 1-14 or the DNA sequence of any one of embodiments 16-29.

32. The viral vector of embodiment 31, which is selected from the group consisting of an adeno-associated virus (AAV) vector, an adenovirus vector, a retrovirus vector, a lentivirus vector, a vaccinia and a herpesvirus vector.

33. The viral vector of embodiment 31 or 32, wherein the viral vector is an AAV.

34. The viral vector of embodiment 33, wherein the AAV serotype is selected from the group consisting of AAV1, AAV2, AAV3, AAV4, AAV5, AAV6, AAV8, AAV9, AAVrh10 or any variant thereof having substantially the same tropism.

35. A viral-like particle comprising the polynucleotide of any one of embodiments 1-14 or the DNA sequence of any one of embodiments 16-29.

36. A nonviral-like particle comprising the polynucleotide of any one of embodiments 1-14 or the DNA sequence of any one of embodiments 16-29.

37. A closed-ended DNA sequence comprising the polynucleotide of any one of embodiments 1-14 or the DNA sequence of any one of embodiments 16-29.

38. A plasmid comprising the polynucleotide of any one of embodiments 1-14 or the DNA sequence of any one of embodiments 16-29.

39. A mini-intronic plasmid vector comprising the polynucleotide of any one of embodiments 1-14 or the DNA sequence of any one of embodiments 16-29.

40. A composition comprising the polynucleotide of any one of embodiments 1-14, the DNA sequence of any one of embodiments 16-29, or a recombinant circular RNA molecule of embodiment 15 or 30.

41. The composition of embodiment 40, wherein the lipid nanoparticle is decorated.

42. A host cell comprising the polynucleotide of any one of embodiments 1-14, the DNA sequence of any one of embodiments 16-29, or a recombinant circular RNA molecule of embodiment 15 or 30.

43. A method of producing a protein in a cell, the method comprising contacting a cell with (a) the polynucleotide of any one of embodiments 1-14, (b) the DNA sequence of any one of embodiments 16-29, (c) the circular RNA molecule of any one of embodiments 15 or 30, (d) the viral vector of any one of embodiments 31-34, (e) the viral like particle of embodiment 35, (f) the nonviral-like particle of embodiment 36, (g) the closed-end DNA sequence of embodiment 37, (h) the plasmid of embodiment 38, (i) the mini-intronic plasmid vector of embodiment 39, or (j) the composition of any one of embodiments 40-41 under conditions whereby the protein-coding nucleic acid sequence of the circular RNA is translated and the protein is produced in the cell.

44. The method of embodiment 43, wherein 5' cap-dependent translation in the cell is impaired or nonexistent.

45. The method of embodiment 43 or 44, wherein the cell is in vivo.

46. The method of embodiment 45, wherein the cell is a mammalian cell.

47. The method of embodiment 46, wherein the mammalian cell is derived from a human.

48. The method of any one of embodiments 45-46, wherein production of the protein is tissue-specific.

49. The method of embodiment 48, wherein the tissue specificity is localized to a tissues selected from the group consisting of muscle, liver, kidney, brain, lung, skin, pancreas, blood, and heart.

50. The method of embodiment 43 or 44, wherein the cell is in vitro.

51. The method of any one of embodiments 43-48, wherein the protein is expressed recursively in the cell.

52. The method of any one of embodiments 43-51, wherein the half-life of the circular RNA in the cell is about 1 to about 7 days.

53. The method of any one of embodiments 43-55, wherein the protein is produced in the cell for at least about 10%, at least about 20%, or at least about 30% longer than if the protein-coding nucleic acid sequence is provided to the cell in a linear format RNA or encoded for transcription as a linear RNA.

54. A protein produced by the method of any one of embodiments 43-53.

55. A recombinant circular RNA molecule comprising a protein-coding nucleic acid sequence and an internal ribosome entry site (IRES) operably linked to the protein-coding nucleic acid sequence, wherein the IRES comprises: at least one RNA secondary structure; and a sequence that is complementary to an 18S ribosomal RNA (rRNA); wherein the IRES has a minimum free energy (MFE) of less than −18.9 kJ/mol and a melting temperature of at least 35.0° C.

56. The recombinant circular RNA molecule of embodiment 55, wherein the protein-coding nucleic acid sequence is operably linked to the IRES in a non-native configuration.

57. The recombinant circular RNA molecule of embodiment 55 or 56, wherein the sequence that is complementary to an 18S rRNA is encoded by any one of SEQ ID NO: 28977-28983.

58. The recombinant circular RNA molecule of any one of embodiments 55-57, wherein the at least one RNA secondary structure is located 5' to the sequence that is complementary to an 18S rRNA.

59. The recombinant circular RNA molecule of any one of embodiments 55-57, wherein the at least one RNA secondary structure is located 3' to the sequence that is complementary to an 18S rRNA.

60. The recombinant circular RNA molecule of any one of embodiments 55-59, wherein the at least one RNA secondary structure is a stem-loop.

61. The recombinant circular RNA molecule of any one of embodiments 55-59, wherein the at least one RNA secondary structure comprises a sequence encoded by any one of the DNA sequences listed in Table 2.

62. The recombinant circular RNA of any one of embodiments 55-61, wherein the IRES is about 100 to about 1000 nucleotides in length.

63. The recombinant circular RNA of any one of embodiments 55-61, wherein the IRES is about 200 to about 200 nucleotides in length.

64. The recombinant circular RNA of any one of embodiments 55-61, wherein the IRES sequence is between 150-200 nucleotides, between 160-180 nucleotides, or between 200-210 nucleotides in length.

65. The recombinant circular RNA of any one of embodiments 62-64, wherein the RNA secondary structure is formed from the nucleotides at about position 40 to about position 60 of the IRES, relative to the 5' end thereof.

66. The recombinant circular RNA of any one of embodiments 55-65, comprising at least one non-coding functional sequence.

67. The recombinant circular RNA of embodiment 66, wherein the non-coding functional sequence comprises one or more (a) microRNA binding sites or (b) RNA binding protein binding sites.

68. The recombinant circular RNA of any one of embodiments 55-65, wherein the circular RNA comprises an aptamer.

69. A recombinant circular RNA molecule comprising a protein-coding nucleic acid sequence and an internal ribosome entry site (IRES) operably linked to the protein-coding nucleic acid sequence; wherein the IRES is encoded by any one of the DNA sequences listed in SEQ ID NO: 1-228 or SEQ ID NO: 229-17201, or a DNA sequence having at least 90% or at least 95% identity or homology thereto.

70. The recombinant circular RNA molecule of embodiment 69, wherein the protein-coding nucleic acid sequence is operably linked to the IRES in a non-native configuration.

71. The recombinant circular RNA of any one of embodiments 55-70, wherein the recombinant circular RNA comprises a back-splice junction, and wherein the IRES is located within about 100 to about 200 nucleotides of the back-splice junction.

72. The recombinant circular RNA molecule of any one of embodiments 55-71, wherein the IRES has a G-C content of at least 25%.

73. The recombinant circular RNA molecule of any one of embodiments 55-72, wherein the IRES is encoded by any of the DNA sequences of SEQ ID NO: 1-228.

74. The recombinant circular RNA molecule of any one of embodiments 55-72, wherein the IRES is encoded by any one of the DNA sequences of SEQ ID NO: 229-17201.

75. The recombinant circular RNA molecule of embodiment 74, wherein the IRES is encoded by any one of the DNA sequences shown in SEQ ID NO: 531, 2270, 2602, 3042, 3244, 33948.

76. The recombinant circular RNA molecule of any one of embodiments 55-75, wherein the IRES is a human IRES.

77. The recombinant circular RNA molecule of any one of embodiments 55-76, wherein the protein coding-nucleic acid sequence encodes a therapeutic peptide or protein.

78. The recombinant circular RNA molecule of any one of embodiments 55-77, wherein the circular RNA comprises between about 200 nucleotides and about 10,000 nucleotides.

79. The recombinant circular RNA molecule of any one of embodiments 55-78, wherein the circular RNA molecule comprises a spacer between the IRES sequence region and a start codon of the protein-coding nucleic acid sequence region.

80. The recombinant circular RNA molecule of embodiment 79, wherein the length of the spacer is selected to increase translation of the protein-coding nucleic acid sequence region relative to translation of a circular RNA having either no spacer or a spacer that differs from the selected spacer.

81. The recombinant circular RNA molecule of any one of embodiments 55-78, wherein the IRES sequence region is configured to promote rolling circle translation.

82. The recombinant circular RNA molecule of any one of embodiments 55-78, wherein the protein-coding nucleic acid sequence region lacks a stop codon.

83. The recombinant circular RNA molecule of any one of embodiments 55-78, wherein (i) the IRES sequence region is configured to promote rolling circle translation, and (ii) the protein-coding nucleic acid sequence region lacks a stop codon.

84. A composition comprising the recombinant circular RNA molecule of any one of embodiments 55-83.

85. A host cell comprising the recombinant circular RNA molecule of any one of embodiments 55-83 or the composition of embodiment 84.

86. A method of producing a protein in a cell, the method comprising contacting a cell with the recombinant circular RNA molecule of any one of embodiments 55-83, or the composition of embodiment 84 under conditions whereby the protein-coding nucleic acid sequence is translated and the protein is produced in the cell.

87. The method of embodiment 86, wherein 5' cap-dependent translation in the cell is impaired or nonexistent.

88. The method of embodiment 86 or 87, wherein the cell is in vivo.

89. The method of embodiment 86 or 87, wherein the cell is a mammalian cell.

90. The method of embodiment 89, wherein the mammalian cell is derived from a human.

91. The method of any one of embodiments 55-90, wherein production of the protein is tissue-specific.

92. The method of embodiment 91, wherein the tissue specificity is localized to a tissues selected from the group consisting of muscle, liver, kidney, brain, lung, skin, pancreas, blood, and heart.

93 The method of embodiment 86 or 87, wherein the cell is in vitro.

94. The method of any one of embodiments 86-93, wherein the protein is expressed recursively in the cell.

95. The method of any one of embodiments 86-94, wherein the half-life of the circular RNA in the cell is about 1 to about 7 days.

96. The method of any one of embodiments 86-94, wherein the protein is produced in the cell for at least about 10%, at least about 20%, or at least about 30% longer than if the protein-coding nucleic acid sequence is provided to the cell in a linear format RNA or encoded for transcription as a linear RNA.

97. A protein produced by the method of any one of embodiments 86-96.

98. An oligonucleotide molecule comprising a nucleic acid sequence that hybridizes to an internal ribosome entry site (IRES) present on a circular RNA molecule and inhibits translation of the circular RNA molecule.

99. The oligonucleotide molecule of embodiment 98, wherein the circular RNA is a recombinant circular RNA.

100. The oligonucleotide molecule of embodiment 98, wherein the recombinant circular RNA is the recombinant circular RNA of any one of embodiments 55-83.

101. The oligonucleotide molecule of embodiment 98, wherein the circular RNA is a naturally occurring circular RNA.

102. The oligonucleotide molecule of any one of embodiments 98-101, wherein the oligonucleotide is an antisense oligonucleotide.

103. The oligonucleotide of embodiment 102, wherein the antisense oligonucleotide is a locked nucleic acid oligonucleotide (LNA).

104. The oligonucleotide of any one of embodiments 98-103, wherein the oligonucleotides is chemically modified at its 5' and/or its 3' end.

105. A method of inhibiting translation of a protein-coding nucleic acid sequence present on a circular RNA molecule, which method comprises contacting the circular RNA molecule with an oligonucleotide molecule of any one of embodiments 98-104, whereby the oligonucleotide molecule hybridizes to the RNA secondary structure and/or the nucleic acid sequence complementary to 18S rRNA present on the IRES of the circular RNA molecule and inhibits translation of the circular RNA molecule.

106. The method of embodiment 105, wherein the oligonucleotide hybridizes to the RNA secondary structure or the nucleic acid sequence that is complementary to 18S rRNA.

107. The method of embodiment 105, wherein the oligonucleotide hybridizes to the RNA secondary structure and the nucleic acid sequence that is complementary to 18S rRNA.

108. The method of embodiment 105, wherein a first oligonucleotide hybridizes to the RNA secondary structure and a second oligonucleotide hybridizes to the nucleic acid sequence that is complementary to 18S rRNA.

Lengthy table referenced here

US11560567-20230124-T00001

Please refer to the end of the specification for access instructions.

Lengthy table referenced here

US11560567-20230124-T00002

Please refer to the end of the specification for access instructions.

Lengthy table referenced here

US11560567-20230124-T00003

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US11560567B2). An electronic copy of the table will also be available from the USPTO upon request and payment of the fee set forth in 37 CFR 1.19(b)(3).

SEQUENCE LISTING (34039 sequences)

SEQ ID NO: 1 - DNA, 203 bp, Unknown
  IRES fragment
ggcgcgccagtcctccgggaacccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 2 - DNA, 203 bp, Unknown
  IRES fragment
ggcgcgccagtccttgctccggctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 3 - DNA, 203 bp, Unknown
  IRES fragment
ggcgcgccagtcctctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 4 - DNA, 203 bp, Unknown
  IRES fragment
ggcgcgccagtccttttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 5 - DNA, 203 bp, Unknown
  IRES fragment
ggcgcgccagtcctaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 6 - DNA, 203 bp, Unknown
  IRES fragment
ggcgcgccagtcctgggacctggaagcgccccagccccgcagcgatcgcagattcggctttcaaacaaaagaggcgccccggggggtgggaccgggacctcacccggtcctcgcagagttgcggccgcccgccccttcagccccggctctccgtatgcgcatgagcagaggcgcctccctctgttcctcgactcggaccgatg

SEQ ID NO: 7 - DNA, 203 bp, Unknown
  IRES fragment
ggcgcgccagtcctttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttcgactcggaccgatg

SEQ ID NO: 8 - DNA, 203 bp, Unknown
  IRES fragment
ggcgcgccagtcctttaaaacagctctggggttgttcccaccccagaggcccacgtggcggctagtacactggtatcacggtacctttgtacgcctgttttatactccctcccccgcaacttagaagcatacaattcaagctcaataggagggggtgcaagccagcgcctccgtgggcaagcactactcgactcggaccgatg

SEQ ID NO: 9 - DNA, 203 bp, Unknown
  IRES fragment
ggcgcgccagtcctgataaaagaacctataatcccttcgcacaccgcgtcacaccgcgctatatgctgctcattaggaattacggctccttttttgtggatacaatctcttgtatacgatatacttattgttaatttcattgacctttacgcaatcctgcgtaaatgctggtatagggtgtacttcggcgactcggaccgatg

SEQ ID NO: 10 - DNA, 203 bp, Unknown
  IRES fragment
ggcgcgccagtcctcaaaattgcgtgcgagaaagcacgcaaatcaaagtctagtgcgtaattcactcactaccggcgtaatttgtggttatgctattgcgttgagagtgttgtgggcgtagtacgggggcttttggtttgtgtgtgattaatatgcattcccagttttgtttagttttagattactgacgactcggaccgatg

SEQ ID NO: 11 - DNA, 203 bp, Unknown
  IRES fragment
ggcgcgccagtcctcttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaacttcgactcggaccgatg

SEQ ID NO: 12 - DNA, 203 bp, Unknown
  IRES fragment
ggcgcgccagtcctttctccttggcctgcgttggaccttcctttttttgttgtttttttttgtttttcccctttcttccttttgaattaactggcttcttggctggatgttttcaacttctttcctggctgcgaacttttccccaattgttttccttttacaacagggggagaaagtgctctgtggtccgactcggaccgatg

SEQ ID NO: 13 - DNA, 203 bp, Unknown
  IRES fragment
ggcgcgccagtcctaacttctttcctggctgcgaacttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcgcgactcggaccgatg

SEQ ID NO: 14 - DNA, 203 bp, Unknown
  IRES fragment
ggcgcgccagtcctcgtggcagtgtgcgtggcaggatgtgcgtgcgtgtgtaacccgagccgcccgatctgtttcgatctgcgccgcggagccctccctcaaggcccgctccacctgctgcggttacgcggcgctcgtgggtgttcgtgcctcggagcagctaaccggcgggtgctgggcgacggtggcgactcggaccgatg

SEQ ID NO: 15 - DNA, 203 bp, Unknown
  IRES fragment
ggcgcgccagtcctgtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgcgactcggaccgatg

SEQ ID NO: 16 - DNA, 203 bp, Unknown
  IRES fragment
ggcgcgccagtcctatgtgggagagctgtagaaccctgagtgtcatcgactgggccttcttatgattgttgttttaagattagctgaagatctctgaaacgctgaattttctgcactgagcgttttgacagaattcattgagagaacagagaacatgacaagtacttctagctcagcactgctccaaccgactcggaccgatg

SEQ ID NO: 17 - DNA, 203 bp, Unknown
  IRES fragment
ggcgcgccagtcctcttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagcgactcggaccgatg

SEQ ID NO: 18 - DNA, 203 bp, Unknown
  IRES fragment
ggcgcgccagtccttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactgcgactcggaccgatg

SEQ ID NO: 19 - DNA, 203 bp, Unknown
  IRES fragment
ggcgcgccagtcctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatatcgactcggaccgatg

SEQ ID NO: 20 - DNA, 203 bp, Unknown
  IRES fragment
ggcgcgccagtcctaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactcgactcggaccgatg

SEQ ID NO: 21 - DNA, 203 bp, Unknown
  IRES fragment
ggcgcgccagtcctttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttacgactcggaccgatg

SEQ ID NO: 22 - DNA, 203 bp, Unknown
  IRES fragment
ggcgcgccagtcctgggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatccgactcggaccgatg

SEQ ID NO: 23 - DNA, 203 bp, Unknown
  IRES fragment
ggcgcgccagtcctccacacacagcgcgggcttctagcgctcggcaccggcgggccaggcgcgtcctgccttcatttatccagcagcttttcggaaaatgcatttgctgttcggagtttaatcagaagacgattcctgcctccgtccccggctccttcatcgtcccatctcccctgtctctctcctggcgactcggaccgatg

SEQ ID NO: 24 - DNA, 203 bp, Unknown
  IRES fragment
ggcgcgccagtcctcctgccttcatttatccagcagcttttcggaaaatgcatttgctgttcggagtttaatcagaagacgattcctgcctccgtccccggctccttcatcgtcccatctcccctgtctctctcctggggaggcgtgaagcggtcccgtggatagagattcatgcctgtgtccgcgcgcgactcggaccgatg

SEQ ID NO: 25 - DNA, 203 bp, Unknown
  IRES fragment
ggcgcgccagtccttcgatctggaaatcctcctaatttttactccctctccccccgactcctgattcattgggaagtttcaaatcagctataactggagagtgctgaagattgatgggatcgttgccttatgcatttgttttggttttacaaaaaggaaacttgacagaggatcatgctgtacttaaacgactcggaccgatg

SEQ ID NO: 26 - DNA, 203 bp, Unknown
  IRES fragment
ggcgcgccagtcctaaacgcacctgattttttacttattagtttgttttttctttaacctttcagcatcacagaggaagtagactgatattaacaatacttactaataataacgtgcctcatgaaataaagatccgaaaggaattggaataaaaatttcctgcgtctcatgccaagagggaaacaccacgactcggaccgatg

SEQ ID NO: 27 - DNA, 203 bp, Unknown
  IRES fragment
ggcgcgccagtccttgcctcatgaaataaagatccgaaaggaattggaataaaaatttcctgcgtctcatgccaagagggaaacaccagaatcaagtgttccgcgtgattgaagacaccccctcgtccaagaatgcaaagcacatccaataaaatagctggattataactcctcttctttctctggggcgactcggaccgatg

SEQ ID NO: 28 - DNA, 203 bp, Unknown
  IRES fragment
ggcgcgccagtcctaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 29 - DNA, 203 bp, Unknown
  IRES fragment
ggcgcgccagtcctgccaggggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaacgactcggaccgatg

SEQ ID NO: 30 - DNA, 203 bp, Unknown
  IRES fragment
ggcgcgccagtcctcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaacgactcggaccgatg

SEQ ID NO: 31 - DNA, 203 bp, Unknown
  IRES fragment
ggcgcgccagtcctggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 32 - DNA, 203 bp, Unknown
  IRES fragment
ggcgcgccagtcctcctcccccttccctcccccttttttttgttttccgttcccctttcccctcccttccctatccccgacgaccggatcctgaggaggcagctgcggtggcagctgctgagttctcggtgaaggtatttcatttctcctgtcccctcccctccccaccccatctattaatattattccgactcggaccgatg

SEQ ID NO: 33 - DNA, 203 bp, Unknown
  IRES fragment
ggcgcgccagtccttctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaacgactcggaccgatg

SEQ ID NO: 34 - DNA, 203 bp, Unknown
  IRES fragment
ggcgcgccagtcctatgtatgcatgtgtatgtatgtatatgcatgtatgtgtatgtgtatatatgtatgtgtgtgtatgtatatgtgtgtgtatgtgtatgtgtgtgtgtatgtgtgtgtgtatgtatgtatgtatgtatatgtattatacacatatacacatattggtttttttaatcatttgagagcgactcggaccgatg

SEQ ID NO: 35 - DNA, 203 bp, Unknown
  IRES fragment
ggcgcgccagtcctcccactcggcagccttcctctccaggatccccaaggctaggaggccaacctactaacaggtgggtgggtatggtgtgtggtttcactcagttcttctcatggggtttctctgagctccattcataccagaaagggagcaggagagagaggacaagtggatccaacagccttcgccgactcggaccgatg

SEQ ID NO: 36 - DNA, 203 bp, Unknown
  IRES fragment
ggcgcgccagtccttactaacaggtgggtgggtatggtgtgtggtttcactcagttcttctcatggggtttctctgagctccattcataccagaaagggagcaggagagagaggacaagtggatccaacagccttcgctccaggggaatcagggcatcgcctccttttctgggaggacactcccttctcgactcggaccgatg

SEQ ID NO: 37 - DNA, 203 bp, Unknown
  IRES fragment
ggcgcgccagtcctggggtttctctgagctccattcataccagaaagggagcaggagagagaggacaagtggatccaacagccttcgctccaggggaatcagggcatcgcctccttttctgggaggacactcccttctgatggtgaatgggaactcccttcctcctgcagcagcctgcctgcagctgtcgactcggaccgatg

SEQ ID NO: 38 - DNA, 203 bp, Unknown
  IRES fragment
ggcgcgccagtcctacaagtggatccaacagccttcgctccaggggaatcagggcatcgcctccttttctgggaggacactcccttctgatggtgaatgggaactcccttcctcctgcagcagcctgcctgcagctgtcctggtagaacagtgtggacattgcagaagctgtcactgccccagaaagacgactcggaccgatg

SEQ ID NO: 39 - DNA, 203 bp, Unknown
  IRES fragment
ggcgcgccagtcctggctggcgtgtgaccccgttttgagtcaggtggacagagggctggccaccttcggaaccatgggtgcaatacggagtcagacctcaatacaagcccactctttcacatatttgaacttttttcacatatcaactttttttgttcactgtgcagggattgttcattgctgctggacgactcggaccgatg

SEQ ID NO: 40 - DNA, 203 bp, Unknown
  IRES fragment
ggcgcgccagtccttttcacatatttgaacttttttcacatatcaactttttttgttcactgtgcagggattgttcattgctgctggaggaagatcatggactgtcgcgggaaactgaagtggttgagtatccactagtcgtggatgagggcagtgacttcgcagttttttgcgaattacacatctctcgactcggaccgatg

SEQ ID NO: 41 - DNA, 203 bp, Unknown
  IRES fragment
ggcgcgccagtcctcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagtcatttagtgtttgggatcgactcggaccgatg

SEQ ID NO: 42 - DNA, 203 bp, Unknown
  IRES fragment
ggcgcgccagtcctggagaacttcacagttgctactcctgtgataggtttatcttagtttcattgtggtataaatggaatagcaggtgttgtcaggtacaaggtttgtagcttgccaatatgttcattaccaacactgcagattcccattgagttggtgggggttttgttacctttgttttttttctccgactcggaccgatg

SEQ ID NO: 43 - DNA, 203 bp, Unknown
  IRES fragment
ggcgcgccagtcctacaaaagaggcgccccggggggtgggaccgggacctcacccggtcctcgcagagttgcggccgcccgccccttcagccccggctctccgtatgcgcatgagcagaggcgcctccctctgttcctcccaaggctaaactttctaattcccttctttgggctcgggggctcccggacgactcggaccgatg

SEQ ID NO: 44 - DNA, 203 bp, Unknown
  IRES fragment
ggcgcgccagtcctgcagaggcgcctccctctgttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgccgactcggaccgatg

SEQ ID NO: 45 - DNA, 203 bp, Unknown
  IRES fragment
ggcgcgccagtcctgccgggcgaactcaaggggcgcagctctttgctttgacagagctggccggcggaggcgtgcagagcggcgagccggcgagccaggctgagaaactcgacccgggaacaaagaggggtcggactgagtgtgtgtgtcggctcgagctccgggagaggcatttgcccgaggccccgcgactcggaccgatg

SEQ ID NO: 46 - DNA, 203 bp, Unknown
  IRES fragment
ggcgcgccagtcctcggaggcgtgcagagcggcgagccggcgagccaggctgagaaactcgacccgggaacaaagaggggtcggactgagtgtgtgtgtcggctcgagctccgggagaggcatttgcccgaggccccgctgtgactccccgagactccgcagtgccctccactgggagtccccgcgctcgactcggaccgatg

SEQ ID NO: 47 - DNA, 203 bp, Unknown
  IRES fragment
ggcgcgccagtcctgagaggcatttgcccgaggccccgctgtgactccccgagactccgcagtgccctccactgggagtccccgcgcttgccggaaaaactttattcttggcaaacttctctttctcttcccctcctcctcggcccccatcttctgctcctcctccttctctagcagattaaatgagccgactcggaccgatg

SEQ ID NO: 48 - DNA, 203 bp, Unknown
  IRES fragment
ggcgcgccagtcctccttctctagcagattaaatgagcctcgagaagaaaaaccgaagcgaaagggaagaaaataagaagatctaaaacggacatctccagcgtgggtggctcctttttctttttctttttttcccacccttcaggaagtggacgtttcgttatcttctgatccttgcaccttcttttcgactcggaccgatg

SEQ ID NO: 49 - DNA, 203 bp, Unknown
  IRES fragment
ggcgcgccagtcctggaagaaaataagaagatctaaaacggacatctccagcgtgggtggctcctttttctttttctttttttcccacccttcaggaagtggacgtttcgttatcttctgatccttgcaccttcttttggggcaaacggggcccttctgcccagatcccctctcttttctcggaaaaccgactcggaccgatg

SEQ ID NO: 50 - DNA, 203 bp, Unknown
  IRES fragment
ggcgcgccagtccttttttctttttctttttttcccacccttcaggaagtggacgtttcgttatcttctgatccttgcaccttcttttggggcaaacggggcccttctgcccagatcccctctcttttctcggaaaacaaactactaagtcggcatccggggtaactacagtggagagggtttccgcgcgactcggaccgatg

SEQ ID NO: 51 - DNA, 203 bp, Unknown
  IRES fragment
ggcgcgccagtcctatcccctctcttttctcggaaaacaaactactaagtcggcatccggggtaactacagtggagagggtttccgcggagacgcgccgccggaccctcctctgcactttggggaggcgtgctccctccagaaccggcgttctccgcgcgcaaatcccggcgacgcggggtcgcggggcgactcggaccgatg

SEQ ID NO: 52 - DNA, 203 bp, Unknown
  IRES fragment
ggcgcgccagtcctcactttggggaggcgtgctccctccagaaccggcgttctccgcgcgcaaatcccggcgacgcggggtcgcggggtggccgccggggcagcctcgtctagcgcgcgccgcgcagacgcccccggagtcgccagctaccgcagccctcgccgcccagtgcccttcggcctcggggccgactcggaccgatg

SEQ ID NO: 53 - DNA, 203 bp, Unknown
  IRES fragment
ggcgcgccagtccttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggcgactcggaccgatg

SEQ ID NO: 54 - DNA, 203 bp, Unknown
  IRES fragment
ggcgcgccagtcctccgtgctcccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 55 - DNA, 203 bp, Unknown
  IRES fragment
ggcgcgccagtcctgcaatccggagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccacttcgactcggaccgatg

SEQ ID NO: 56 - DNA, 203 bp, Unknown
  IRES fragment
ggcgcgccagtcctttgtaagtatcattatgaactaatgaattttcaacatatttgatatatttcaatccattgccatcattgttcttatcgatatttgagttggctcactttgccagtaagagtctattcaaattggcttctgagtccatttgacacaacacctttgatctttgacagtttccttggcgactcggaccgatg

SEQ ID NO: 57 - DNA, 203 bp, Unknown
  IRES fragment
ggcgcgccagtcctcaatccattgccatcattgttcttatcgatatttgagttggctcactttgccagtaagagtctattcaaattggcttctgagtccatttgacacaacacctttgatctttgacagtttccttggttttaggtgctagatgatttctcaggctcaccttagacatttcctgccaccgactcggaccgatg

SEQ ID NO: 58 - DNA, 203 bp, Unknown
  IRES fragment
ggcgcgccagtcctctcaccttagacatttcctgccacagacttagaatcagccatttctctaaggaccctgattccatttcatgagaaatgatagagaccacaatcaaaacaagtcatgaatttatactgatattttcaattcaaattaaagatgaggtttttgctaaatttttttgagtttatattcgactcggaccgatg

SEQ ID NO: 59 - DNA, 203 bp, Unknown
  IRES fragment
ggcgcgccagtccttttcctaattagtaacataattattcatttgatgggtaaatattttagggccgattctttggttttatagccaagataccctgttgataaagtcttgtgggagcaattataagactggcttattttgaagctttttaaaaaagacatccttacctgttttaactgtagattatacgactcggaccgatg

SEQ ID NO: 60 - DNA, 203 bp, Unknown
  IRES fragment
ggcgcgccagtcctgctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtccccgactcggaccgatg

SEQ ID NO: 61 - DNA, 203 bp, Unknown
  IRES fragment
ggcgcgccagtcctatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccacgactcggaccgatg

SEQ ID NO: 62 - DNA, 203 bp, Unknown
  IRES fragment
ggcgcgccagtccttttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgcgactcggaccgatg

SEQ ID NO: 63 - DNA, 203 bp, Unknown
  IRES fragment
ggcgcgccagtcctcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacaccggtagacgcctcggctggcgactcggaccgatg

SEQ ID NO: 64 - DNA, 203 bp, Unknown
  IRES fragment
ggcgcgccagtcctccggcgggcagaggaaaacgcctgtagccggcgagtgaagacgaaccatcgactgccgtgttccttttcctcttggaggttggagtcccctgggcgcccccacaccggtagacgcctcggctggttcgcgacgcagccccccggccgtggatgctcactcgggctcgggatccgcgactcggaccgatg

SEQ ID NO: 65 - DNA, 203 bp, Unknown
  IRES fragment
ggcgcgccagtcctgactgccgtgttccttttcctcttggaggttggagtcccctgggcgcccccacaccggtagacgcctcggctggttcgcgacgcagccccccggccgtggatgctcactcgggctcgggatccgcccaggtagccggctcggacccaggtcctgcgcccaggtcctcccctgcccgactcggaccgatg

SEQ ID NO: 66 - DNA, 203 bp, Unknown
  IRES fragment
ggcgcgccagtcctcacaccggtagacgcctcggctggttcgcgacgcagccccccggccgtggatgctcactcgggctcgggatccgcccaggtagccggctcggacccaggtcctgcgcccaggtcctcccctgccccccagcgacggagccggggccgggggcggcggcgcccgggggccatgcgcgactcggaccgatg

SEQ ID NO: 67 - DNA, 203 bp, Unknown
  IRES fragment
ggcgcgccagtcctcagcctctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgccccgactcggaccgatg

SEQ ID NO: 68 - DNA, 203 bp, Unknown
  IRES fragment
ggcgcgccagtcctcactagcctcctgccccgcggcgctgccgcacgagccccacgagccgctcaccccgccgttctcagcgctgcccgaccccgctcgcgcgccctcccgccgccagtcccggcagcgccctcagttgtcctccgactcgccctcggccttccgcgccagccgcagccacagccgcacgactcggaccgatg

SEQ ID NO: 69 - DNA, 203 bp, Unknown
  IRES fragment
ggcgcgccagtcctccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgactcggaccgatg

SEQ ID NO: 70 - DNA, 203 bp, Unknown
  IRES fragment
ggcgcgccagtcctcatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacaggacatcagcgaccgactcggaccgatg

SEQ ID NO: 71 - DNA, 203 bp, Unknown
  IRES fragment
ggcgcgccagtcctacggccggaagccagtaaaagaagagaaaatggaagaaagggacctgctgtccgacttacaggacatcagcgacagcgagaggaagaccagctcggccgagtcctcgtcagcagaatcaggctcaggttctgaggaagaagaggaggaggaggaagaggaggaggaggaagggacgactcggaccgatg

SEQ ID NO: 72 - DNA, 203 bp, Unknown
  IRES fragment
ggcgcgccagtccttcagcagaatcaggctcaggttctgaggaagaagaggaggaggaggaagaggaggaggaggaagggagcaccagtgaagaatcagaggaggaagaggaagaggaggaggaggagaccggcagcaactctgaggaggcatcagagcagtctgccgaagaagtaagtgaggaagaacgactcggaccgatg

SEQ ID NO: 73 - DNA, 203 bp, Unknown
  IRES fragment
ggcgcgccagtcctgtttacatatttatgtaaaataagcatttaaaaattattagttttattctgcctgcttaaatattactttcctcaaaaagagaaaacaaaaatgctagattttactttatgacttgaatgatgtggtaatgtcgaactctagtatttagaattagaatgtttcttagcggtcgtcgactcggaccgatg

SEQ ID NO: 74 - DNA, 203 bp, Unknown
  IRES fragment
ggcgcgccagtccttttactttatgacttgaatgatgtggtaatgtcgaactctagtatttagaattagaatgtttcttagcggtcgtgtagttatttttatgtcataagtggataatttgttagctcctataacaaaagtctgttgcttgtgtttcacattttggatttcctaatataatgttctctcgactcggaccgatg

SEQ ID NO: 75 - DNA, 203 bp, Unknown
  IRES fragment
ggcgcgccagtcctatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcagcgactcggaccgatg

SEQ ID NO: 76 - DNA, 203 bp, Unknown
  IRES fragment
ggcgcgccagtcctacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatctcgactcggaccgatg

SEQ ID NO: 77 - DNA, 203 bp, Unknown
  IRES fragment
ggcgcgccagtcctggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggaccgactcggaccgatg

SEQ ID NO: 78 - DNA, 203 bp, Unknown
  IRES fragment
ggcgcgccagtcctatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggcccgactcggaccgatg

SEQ ID NO: 79 - DNA, 203 bp, Unknown
  IRES fragment
ggcgcgccagtcctctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctcgactcggaccgatg

SEQ ID NO: 80 - DNA, 203 bp, Unknown
  IRES fragment
ggcgcgccagtcctagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccacgactcggaccgatg

SEQ ID NO: 81 - DNA, 203 bp, Unknown
  IRES fragment
ggcgcgccagtcctacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctccgactcggaccgatg

SEQ ID NO: 82 - DNA, 203 bp, Unknown
  IRES fragment
ggcgcgccagtcctcggcttgaggcagagaccaggaggcagctagaggagcagacgtctcactccgctcgcggaagggtgtgagaggggtgtgtgggggtcggcagcgaggggtgtgtgccatcagccaccggcgacgatctgagacagtcgcagcggctttccgagcggcgtccgcttcccgcccggcgactcggaccgatg

SEQ ID NO: 83 - DNA, 203 bp, Unknown
  IRES fragment
ggcgcgccagtcctcgctcgcggaagggtgtgagaggggtgtgtgggggtcggcagcgaggggtgtgtgccatcagccaccggcgacgatctgagacagtcgcagcggctttccgagcggcgtccgcttcccgcccgggcagctcccgccagaggggtgaagcggcgactggagtggccgtgcttttgcgactcggaccgatg

SEQ ID NO: 84 - DNA, 203 bp, Unknown
  IRES fragment
ggcgcgccagtcctgagcggcgtccgcttcccgcccgggcagctcccgccagaggggtgaagcggcgactggagtggccgtgcttttgtgccctgggtcccggtaccctcccctggtgcggcccgaggcaagcccaccgaggtgaccacccctcgacgccgcttggagatcccgggcatccaccctgccgactcggaccgatg

SEQ ID NO: 85 - DNA, 203 bp, Unknown
  IRES fragment
ggcgcgccagtcctggtgcggcccgaggcaagcccaccgaggtgaccacccctcgacgccgcttggagatcccgggcatccaccctgcgccccgagcagctgatacccagggaggtgtcaggacctgcccggggcgcggggtcgccggaagccaggcgggagccccggctgctttctggcaatctagtcgactcggaccgatg

SEQ ID NO: 86 - DNA, 203 bp, Unknown
  IRES fragment
ggcgcgccagtcctatgaaaccggctcggattccgcccgcgtgcgccatcccctcagctagcaggtgtgagcggctttctgcccgcagtctctacacagctcagcatcctgacgcctcctccccttgcaggggcgtgaagctacttcagactctgctgtgacgacttggccgccaggcaccgatcctccgactcggaccgatg

SEQ ID NO: 87 - DNA, 203 bp, Unknown
  IRES fragment
ggcgcgccagtcctaccttggggcgtccccaatctccacctctgggctccagtaacgaggactctgcaataccccctagccccctggccaagacaaccgaacttgttccgtggatatttgggatcctccacctgccaaacctgagcgattttttttgtactgcgcccccacccccaatgattctgccccgactcggaccgatg

SEQ ID NO: 88 - DNA, 203 bp, Unknown
  IRES fragment
ggcgcgccagtccttgcaataccccctagccccctggccaagacaaccgaacttgttccgtggatatttgggatcctccacctgccaaacctgagcgattttttttgtactgcgcccccacccccaatgattctgcccctcctccagctgttgcagcgtggaaaaggggaaacaaatcaccgggggggcgactcggaccgatg

SEQ ID NO: 89 - DNA, 203 bp, Unknown
  IRES fragment
ggcgcgccagtcctaggggaaacaaatcaccgggggggatttttttcgtctatttttatttttcgcacttgctgggaatggtgaagtgcttcttgtgaatgattctagccaaaggatgctcttcatttcctgctttctatggagacctcagtgttgagtttgcctctgctggaactgcgtctaccacccgactcggaccgatg

SEQ ID NO: 90 - DNA, 203 bp, Unknown
  IRES fragment
ggcgcgccagtcctgatgctcttcatttcctgctttctatggagacctcagtgttgagtttgcctctgctggaactgcgtctaccaccttctctaccttccaaggtctttgcctctatctacaacctggcattgtctgtgggtccatgaaggcttggatgaccttagagggaaggtctgggagtccaccgactcggaccgatg

SEQ ID NO: 91 - DNA, 203 bp, Unknown
  IRES fragment
ggcgcgccagtccttagagggaaggtctgggagtccaccctcatagactaagcagcaatggctgggcatattttaagccgcattttaacatgggtcaagccatcagtagaaggcaagtgctaagactaaagacttatttgaattttatttaaattagatggactgggccttggccaatttccatgcaacgactcggaccgatg

SEQ ID NO: 92 - DNA, 203 bp, Unknown
  IRES fragment
ggcgcgccagtcctgggccttggccaatttccatgcaagaaaaagtatatttcattttctaggcacaacttctgagtgtcagatacttgctgtctttgagtcttgtggcgtcatcaccggacagcatcccagacagacttccagatttgaacatctaccccccaacacgtaggtgtatgggagaccaccgactcggaccgatg

SEQ ID NO: 93 - DNA, 203 bp, Unknown
  IRES fragment
ggcgcgccagtcctacaacttctgagtgtcagatacttgctgtctttgagtcttgtggcgtcatcaccggacagcatcccagacagacttccagatttgaacatctaccccccaacacgtaggtgtatgggagaccacatcatttcatgacttatgtttgaggaacactaggctgttgtctagacgagcgactcggaccgatg

SEQ ID NO: 94 - DNA, 203 bp, Unknown
  IRES fragment
ggcgcgccagtcctacacgtaggtgtatgggagaccacatcatttcatgacttatgtttgaggaacactaggctgttgtctagacgaggcaagctctggaaagcaacgccgagtctctgagaagagggagcataggctgtgctgatttaaaaacagaaaatgcaaagttggactgaaaatatcccacgcgactcggaccgatg

SEQ ID NO: 95 - DNA, 203 bp, Unknown
  IRES fragment
ggcgcgccagtcctacactaggctgttgtctagacgaggcaagctctggaaagcaacgccgagtctctgagaagagggagcataggctgtgctgatttaaaaacagaaaatgcaaagttggactgaaaatatcccacgtcttctaagcaatctgcttaaggcttccaaacttaccttaatttggtaagcgactcggaccgatg

SEQ ID NO: 96 - DNA, 203 bp, Unknown
  IRES fragment
ggcgcgccagtccttgtgctgatttaaaaacagaaaatgcaaagttggactgaaaatatcccacgtcttctaagcaatctgcttaaggcttccaaacttaccttaatttggtaagaaaataagctgccctatttttctttcttcttctcttacaactggaagcagccatttccccaaaccaccaccatcgactcggaccgatg

SEQ ID NO: 97 - DNA, 203 bp, Unknown
  IRES fragment
ggcgcgccagtcctccctggcgtcccggccgaggcagcatcccagcctttaccctgtgggcccaacgtgaggagtgtgaggagcggcatgcggcgccccctggctggttcggtgtcttttgacctgctgttgactgctcccagggggccctgacgccctggggcacttttgctctgcacaggaccacgcgactcggaccgatg

SEQ ID NO: 98 - DNA, 203 bp, Unknown
  IRES fragment
ggcgcgccagtcctgggtgtagaggaaggaaggagcaagaccagcctgtagactgtgcccctggctgggcaaaagggccaggggcccggagccttccctccactgccctcgaacgcctcacttcctaagtctctgcatttctcagtcagtggacagcttttgggactcttgtgtgaggactttgggggcgactcggaccgatg

SEQ ID NO: 99 - DNA, 203 bp, Unknown
  IRES fragment
ggcgcgccagtcctctggctgggcaaaagggccaggggcccggagccttccctccactgccctcgaacgcctcacttcctaagtctctgcatttctcagtcagtggacagcttttgggactcttgtgtgaggactttgggggaccaggccaggctgggcctctgctgattgagatcttgggatccagacgactcggaccgatg

SEQ ID NO: 100 - DNA, 203 bp, Unknown
  IRES fragment
ggcgcgccagtccttgccacccggcgtggaggacggggtccaccctggtgggctgagcgcgaggccggagggctgggaggctgcggctgggctgagcactgcggagggccgtcggcttatcccaggtcccggtcacgcagcggccacgctcggggagcgcgcggacctgagcgggcaccacgagccgccgactcggaccgatg

SEQ ID NO: 101 - DNA, 203 bp, Unknown
  IRES fragment
ggcgcgccagtcctggacgcggcagggcccggggacagcggggacgccgcccactccaccgggtatgaagctaaaatacagtggttacaacacaggaggttgacaggcctgacctttgaatcccagttcatccacaaacggagctttgtaatctcggattgtaagggccaagcttgtggactttagtgcgactcggaccgatg

SEQ ID NO: 102 - DNA, 203 bp, Unknown
  IRES fragment
ggcgcgccagtcctgggccaagcttgtggactttagtgacttctgatctaagaacctccaccagggctgagggagctcaagtttcagcctgaggcatgggccaggaggccatggtgacctgagacccgtggattctgtccagtacaccctgttgctccttctgcctcccctctcctgtattgaaagcgcgactcggaccgatg

SEQ ID NO: 103 - DNA, 203 bp, Unknown
  IRES fragment
ggcgcgccagtcctggctgagggagctcaagtttcagcctgaggcatgggccaggaggccatggtgacctgagacccgtggattctgtccagtacaccctgttgctccttctgcctcccctctcctgtattgaaagcgtttgtgttcatcttatcagggacctgaccctaagagaatccttcccctgccgactcggaccgatg

SEQ ID NO: 104 - DNA, 203 bp, Unknown
  IRES fragment
ggcgcgccagtccttgacctgagacccgtggattctgtccagtacaccctgttgctccttctgcctcccctctcctgtattgaaagcgtttgtgttcatcttatcagggacctgaccctaagagaatccttcccctgccaaggcagttccagcccccagaactcatcaccccatctcctgaggtggttcgactcggaccgatg

SEQ ID NO: 105 - DNA, 203 bp, Unknown
  IRES fragment
ggcgcgccagtcctgaaaagaccgactccagctaagcaagaggcacagcagcagtggcagaagcagacaggagcagctggtattccggtgattaaatagttctcatagcctttttgctgtacccggtctgctccctggggtaaggcctcgtgtccgagaaggaagctgcattttaacggtgtgctgaacgactcggaccgatg

SEQ ID NO: 106 - DNA, 203 bp, Unknown
  IRES fragment
ggcgcgccagtcctgctgcattttaacggtgtgctgaacagaggtctgaatcattccagctggctgcttgttttgaaaaggacaatgtgtgtataaataaaaagactgctggaagggtccagacaccggcaccggagctgaggagtgctctcagaatcctgttgaggcagatggcacgaactgaaagccgactcggaccgatg

SEQ ID NO: 107 - DNA, 203 bp, Unknown
  IRES fragment
ggcgcgccagtcctgccacctccggtcggcgactgcggcgggctcgacgaggcggctgacggggcggcggcgggaagacggccgggtgcgccttggggtttagtggcggcttctccatgggtccagccagccgcttccctgtgctgtgagtgtttccaccactccaggagacagcattcagagttgaccgactcggaccgatg

SEQ ID NO: 108 - DNA, 203 bp, Unknown
  IRES fragment
ggcgcgccagtcctcggcggcgggaagacggccgggtgcgccttggggtttagtggcggcttctccatgggtccagccagccgcttccctgtgctgtgagtgtttccaccactccaggagacagcattcagagttgaccttgtgagagctggccataatttaattccatctctaggttttctgtcttacgactcggaccgatg

SEQ ID NO: 109 - DNA, 203 bp, Unknown
  IRES fragment
ggcgcgccagtcctttgtggagtcgcccttcccccgaggaggggagcgggcagcgccgggcgcgggatttctcccgcccagggccgaggaggagccctgggctcctcaaccgatcgggccacctccgggagcggcgccccttttctttcgggtcattcctgcagagggaaaactcctgcgtgcgcctgcgactcggaccgatg

SEQ ID NO: 110 - DNA, 203 bp, Unknown
  IRES fragment
ggcgcgccagtcctcgggccacctccgggagcggcgccccttttctttcgggtcattcctgcagagggaaaactcctgcgtgcgcctgcccccaggctagcgtttggactgttttgtttttggcggaactaccgggcaggaagattgcacaagtcagggggcgtttccaatcgggtgtcaattttggacgactcggaccgatg

SEQ ID NO: 111 - DNA, 203 bp, Unknown
  IRES fragment
ggcgcgccagtcctttccaatcgggtgtcaattttggatctccccccccccacccccctttggatcttgtcgggctttccacgtttcacttaaaaaaaattcttgtaacgtccaaggcaagctccccacgacccgaacacgcccagaggaaccttggggcctctggggacttggctagcaggtattcacgactcggaccgatg

SEQ ID NO: 112 - DNA, 203 bp, Unknown
  IRES fragment
ggcgcgccagtcctgtcccgcgaagaaaaagataaagacatctcgtagaaatattaaaataaattcctaaagtcgttggtttctcgttcactttcgctgcctgctcaggacgagggccacaccaagaggcaagagaaacaaaaagagggaacataggaacaggaaccagataatagtgacataagcgacgactcggaccgatg

SEQ ID NO: 113 - DNA, 203 bp, Unknown
  IRES fragment
ggcgcgccagtccttcctaaagtcgttggtttctcgttcactttcgctgcctgctcaggacgagggccacaccaagaggcaagagaaacaaaaagagggaacataggaacaggaaccagataatagtgacataagcgaccctttcgcaaatattttggcgcaaaatgagcgggcgccaagtgccgcgtcgactcggaccgatg

SEQ ID NO: 114 - DNA, 203 bp, Unknown
  IRES fragment
ggcgcgccagtcctatgagcgggcgccaagtgccgcgtggtggagccgcctgaaaatgacatggaaaattcgccgaaaatcgcgcgttttggcagcatcaatcccaaagcacaaaattaatttctatcataatttctgggtgcaacacggacccataattgaatcgaatatagggcttatctgatagccgactcggaccgatg

SEQ ID NO: 115 - DNA, 203 bp, Unknown
  IRES fragment
ggcgcgccagtcctaaaattcgccgaaaatcgcgcgttttggcagcatcaatcccaaagcacaaaattaatttctatcataatttctgggtgcaacacggacccataattgaatcgaatatagggcttatctgatagcccggcagcaacattgaactttccggctgcaaaggagacgacaccgagatccgactcggaccgatg

SEQ ID NO: 116 - DNA, 203 bp, Unknown
  IRES fragment
ggcgcgccagtcctgggctccggcgataagaaatccatgctgataaggacaggaggacggtctgcggcaaattgaattcgattctgacctgtatgaaagccagcggagatacggatacctctgggtttatgggtagaaaacgcagagcgtcgcgccaacatcgaaattatttgcgtttgcatcttctccgactcggaccgatg

SEQ ID NO: 117 - DNA, 203 bp, Unknown
  IRES fragment
ggcgcgccagtcctcggcaaattgaattcgattctgacctgtatgaaagccagcggagatacggatacctctgggtttatgggtagaaaacgcagagcgtcgcgccaacatcgaaattatttgcgtttgcatcttctcgtcctttcgtttatcgttctgattgccatcgtggtggcgcggtttctattcgactcggaccgatg

SEQ ID NO: 118 - DNA, 203 bp, Unknown
  IRES fragment
ggcgcgccagtcctcatcgtggtggcgcggtttctattaattttgcttctgtatcgtttgcaaaatctcaaaagattcaaaaagttcgtcatcagcagccgcaacacaaaaaccaacgagtgtaaagccgagcatacaaatatcaataaaaacataaacatttacccaatctcaatctcaaaacattccgactcggaccgatg

SEQ ID NO: 119 - DNA, 203 bp, Unknown
  IRES fragment
ggcgcgccagtcctaactagaggataaggctacttaaggatcaaaaaacaccaaggagacgagattttctaccaaatcgagagacgaggggcaggttaatttcgtcatttttggccaagacagcaaatagaggaacagcaaagcgaaaatcattttatacctcacacaacaactacacactaactaagcgactcggaccgatg

SEQ ID NO: 120 - DNA, 203 bp, Unknown
  IRES fragment
ggcgcgccagtcctcttaagtgttcaaagtatatttagtttactttgtatataagaaaagtagctaaaagcacgcggacagggaggcaggagcaccacagtcactagccactaagcagagtcacagtcacgatcacgttcactccaggatcaggactcggggcgggatcagcagacgctgaggaagctcgactcggaccgatg

SEQ ID NO: 121 - DNA, 203 bp, Unknown
  IRES fragment
ggcgcgccagtccttgttcaaagtatatttagtttactttgtatataagaaaagtagctaaaagcacgcggacagggaggcaggagcaccacagtcactagccactaagcagagtcacagtcacgatcacgttcactccaggatcaggactcggggcgggatcagcagacgctgaggaagctgccacgcgactcggaccgatg

SEQ ID NO: 122 - DNA, 203 bp, Unknown
  IRES fragment
ggcgcgccagtcctctttaccgacaacgtccagcggtccagtcgagaagtaagtagtccgcgctgcgagcataactctaccagagaaacgcgcactttattggtcaagacagacggaagccggcggttggacgcaaaggttgactcggaagctgagagattgttgagtaacacgcagaagtcttgaaacgactcggaccgatg

SEQ ID NO: 123 - DNA, 203 bp, Unknown
  IRES fragment
ggcgcgccagtcctttgttgagtaacacgcagaagtcttgaaagtatcaagtattgaacatatttcaagggacttggtttcggtgaagtcgtcaattccttttatcgtcaacgtttccacagccctcagaatagaaatttccaacaagccaaagcctacgtaatgaagcgccccaataaccggccgaccgactcggaccgatg

SEQ ID NO: 124 - DNA, 203 bp, Unknown
  IRES fragment
ggcgcgccagtccttcactccagcaacaacaacaacaacggcagcagcagcaataacgacaacaacagcaacgacgacgcagcaagtagcagcaacagcaaaaacaacaacaccagcaacgagagcagccacagcaacaacaatactagtagcataattgcagaggcggccgccaagtttctactgaacgactcggaccgatg

SEQ ID NO: 125 - DNA, 203 bp, Unknown
  IRES fragment
ggcgcgccagtcctggcggccgccaagtttctactgaaaaatggcctaaacggcagtagcagcaccagctacccccctctgccaccgcctctgcccgccaacttaagcaggacgaccacgcccacgacaacgacaacgccctcatcctccagctccaccgcctcaaatggctttttgccgcatgccaacgactcggaccgatg

SEQ ID NO: 126 - DNA, 203 bp, Unknown
  IRES fragment
ggcgcgccagtccttaaaccccagttttatatcgtatatgctatctacaggtccactttacacttaataatataaaaatactactataaaggaaccagaaaaataaaaaagggtcattatttatttgagcagatcattatcaaacgcataggaagagaaaaaacacagttttattttttttccacacacgactcggaccgatg

SEQ ID NO: 127 - DNA, 203 bp, Unknown
  IRES fragment
ggcgcgccagtcctttttgtgactctccctctttgtactattgctctctcactctgtcacacagtaaacggcgcactgttctcgttgcttcgagagagcgcgcctcgaatgttcgcgaaaagagcgccggagtataaatagaggagcttcgtcgacggagagtcaattctattcaaacaagtaaagtgcgactcggaccgatg

SEQ ID NO: 128 - DNA, 203 bp, Unknown
  IRES fragment
ggcgcgccagtcctacgttcgttcgatggcaacggattggataacaggcgcgcgctttgttttattatccacattatcagctgcattattgttattattggccctcagcgctttaccgctcgcccacgcgtccgcccgtgaatgccgcgcggaaaagtcgctttccactagattggcgtccagattcgcgactcggaccgatg

SEQ ID NO: 129 - DNA, 203 bp, Unknown
  IRES fragment
ggcgcgccagtcctttatccacattatcagctgcattattgttattattggccctcagcgctttaccgctcgcccacgcgtccgcccgtgaatgccgcgcggaaaagtcgctttccactagattggcgtccagattcgaggaaatccgtcagcagacgcattcgcgcccgttcggtcagcactatggccgactcggaccgatg

SEQ ID NO: 130 - DNA, 203 bp, Unknown
  IRES fragment
ggcgcgccagtcctaaatccaaaggaggcaaaggaacagcacagaaagcgaggaaacactcaaataaaatccgccaaaaatcgcagatccctggaaaccaattcgtgtgaaatcggtcaagcccccaacgacttttagcccgtctcagacggagcaccgccaagattcttaccgccagcagcgcaatgcgactcggaccgatg

SEQ ID NO: 131 - DNA, 203 bp, Unknown
  IRES fragment
ggcgcgccagtcctcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagacgactcggaccgatg

SEQ ID NO: 132 - DNA, 203 bp, Unknown
  IRES fragment
ggcgcgccagtcctcagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatcgactcggaccgatg

SEQ ID NO: 133 - DNA, 203 bp, Unknown
  IRES fragment
ggcgcgccagtccttaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcccgactcggaccgatg

SEQ ID NO: 134 - DNA, 203 bp, Unknown
  IRES fragment
ggcgcgccagtcctctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcgactcggaccgatg

SEQ ID NO: 135 - DNA, 203 bp, Unknown
  IRES fragment
ggcgcgccagtcctaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctccgactcggaccgatg

SEQ ID NO: 136 - DNA, 203 bp, Unknown
  IRES fragment
ggcgcgccagtccttcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcgactcggaccgatg

SEQ ID NO: 137 - DNA, 203 bp, Unknown
  IRES fragment
ggcgcgccagtccttctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaagcgactcggaccgatg

SEQ ID NO: 138 - DNA, 203 bp, Unknown
  IRES fragment
ggcgcgccagtcctccagtcataccttgatcaagcacttctgtttccccggactgagtatcaataggctgctcgcgcggctgaaggagaaaacgttcgttacccgaccaactacttcgagaagcttagtaccaccatgaacgaggcagggtgtttcgctcagcacaaccccagtgtagatcaggctgacgactcggaccgatg

SEQ ID NO: 139 - DNA, 203 bp, Unknown
  IRES fragment
ggcgcgccagtcctttcgagaagcttagtaccaccatgaacgaggcagggtgtttcgctcagcacaaccccagtgtagatcaggctgatgagtcactgcaacccccatgggcgaccatggcagtggctgcgttggcggcctgcccatggagaaatccatgggacgctctaattctgacatggtgtgaacgactcggaccgatg

SEQ ID NO: 140 - DNA, 203 bp, Unknown
  IRES fragment
ggcgcgccagtccttccggcccctgaatgcggctaatcctaactgcggagcacatgctcacaaaccagtgggtggtgtgtcgtaacgggcaactctgcagcggaaccgactactttgggtgtccgtgtttccttttattcctatattggctgcttatggtgacaatcaaaaagttgttaccatatagccgactcggaccgatg

SEQ ID NO: 141 - DNA, 203 bp, Unknown
  IRES fragment
ggcgcgccagtccttctttccaggtctagaggggtaacactttgtactgtgtttggctccacgctcgatccactggcgagtgttagtaacagcactgttgcttcgtagcggagcatgacggccgtgggaactcctccttggtaacaaggacccacggggccaaaagccacgcccacacgggcccgtcacgactcggaccgatg

SEQ ID NO: 142 - DNA, 203 bp, Unknown
  IRES fragment
ggcgcgccagtcctgccccggacctcccaccgaggtggggggaaaggggccctggaccggccgggtggaaggcccggaaccggtccatcttcctcaaggttgaggaaggggtacgtctatgggtccggtgggtccgaaaggcgtctggatgcctagtgttagggttcgtaggtggtaaatcccagctacgactcggaccgatg

SEQ ID NO: 143 - DNA, 203 bp, Unknown
  IRES fragment
ggcgcgccagtcctgtggaaggcccggaaccggtccatcttcctcaaggttgaggaaggggtacgtctatgggtccggtgggtccgaaaggcgtctggatgcctagtgttagggttcgtaggtggtaaatcccagctaggcgtgaaagcgctataggataggcttatcccggtgaccgctgccccggacgactcggaccgatg

SEQ ID NO: 144 - DNA, 203 bp, Unknown
  IRES fragment
ggcgcgccagtcctgtctatgggtccggtgggtccgaaaggcgtctggatgcctagtgttagggttcgtaggtggtaaatcccagctaggcgtgaaagcgctataggataggcttatcccggtgaccgctgccccggaaccagccccgcggttctttggacacggtccacaggttgggggtaccggtgcgactcggaccgatg

SEQ ID NO: 145 - DNA, 203 bp, Unknown
  IRES fragment
ggcgcgccagtccttatcccggtgaccgctgccccggaaccagccccgcggttctttggacacggtccacaggttgggggtaccggtgtgaataaccccccgactgaagcgtcagtcgttaaacggagacggtctcctgagatcgcaacgacgccccacgtacgggaacgccgccaaaaccttcgggacgactcggaccgatg

SEQ ID NO: 146 - DNA, 203 bp, Unknown
  IRES fragment
ggcgcgccagtcctgtccacaggttgggggtaccggtgtgaataaccccccgactgaagcgtcagtcgttaaacggagacggtctcctgagatcgcaacgacgccccacgtacgggaacgccgccaaaaccttcgggacagctatgcgggttgacaatcccagtggggggccggggaccagctgattacgactcggaccgatg

SEQ ID NO: 147 - DNA, 203 bp, Unknown
  IRES fragment
ggcgcgccagtcctggggggccggggaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacatcgactcggaccgatg

SEQ ID NO: 148 - DNA, 203 bp, Unknown
  IRES fragment
ggcgcgccagtccttggccgaaaggcagccacggggccaccaaggcggcgcagcgctgcatgcggcaaggggaaaaatccttcgggtgacccctggtggcaatcccttcccttaggagcatgagtgtggtcgacacattcaccatggcttggctgtggttgctggtttgcttccccctcgcgggggggcgactcggaccgatg

SEQ ID NO: 149 - DNA, 203 bp, Unknown
  IRES fragment
ggcgcgccagtcctcactgggtgcaagccccagaaaccgacgcctactgaagtagacgtaatggccccggcccgaaccggcgaccggccaaaaggtggtggatgggtgatgacagggttggtaggtcgtaaatcccggtcatcctggtagccactataggtgggtcttaaggggaggctacggtccctcgactcggaccgatg

SEQ ID NO: 150 - DNA, 203 bp, Unknown
  IRES fragment
ggcgcgccagtccttcttaaggggaggctacggtccctcttgcgcatatggaggaaaagcgcacggtccacaggtgttggtcctaccggtgtaataaggacccggcgctaggcacgccgttaaaccgagcccgttactcccctgggcaaacgacgcccacgtacggtccacgtcgcccttcaatgtctcgactcggaccgatg

SEQ ID NO: 151 - DNA, 203 bp, Unknown
  IRES fragment
ggcgcgccagtcctggtccacgtcgcccttcaatgtctctcttgaccaataggcgtagccggcgagttgacaaggaccagtgggggccgggcgggagggggaaggacccccaccgctgcccttcccggggaggcgggaaatgcatggggccacccagctccgcggcggcctacagccggggtagcccacgactcggaccgatg

SEQ ID NO: 152 - DNA, 203 bp, Unknown
  IRES fragment
ggcgcgccagtcctgctgcccttcccggggaggcgggaaatgcatggggccacccagctccgcggcggcctacagccggggtagcccaagaaccttcgggtgagggcgggtggcattttcttttcctataccgatcatggcagtccttctgctcctactcgtggtggaggccggggctattttagccccgactcggaccgatg

SEQ ID NO: 153 - DNA, 203 bp, Unknown
  IRES fragment
ggcgcgccagtcctgcggcctacagccggggtagcccaagaaccttcgggtgagggcgggtggcattttcttttcctataccgatcatggcagtccttctgctcctactcgtggtggaggccggggctattttagccccggccacccatgcttgtagcgcgaaagggcaatatttcctcacaaactgtcgactcggaccgatg

SEQ ID NO: 154 - DNA, 203 bp, Unknown
  IRES fragment
ggcgcgccagtcctctgtaggagtctaaattggggacacagatgtttggaacgtcaccttgcagtgttaacttggctttcatgaatctctttgatcttccacaaggggtaggctacgggtgaaacctcttaggctaatacttctatgaagagatgccttggatagggtaacagcggcggatattggtgcgactcggaccgatg

SEQ ID NO: 155 - DNA, 203 bp, Unknown
  IRES fragment
ggcgcgccagtcctagggctgtctttaggcttaattccagacctctctgtgcttagggcaaacatcatttggccttaaatgggattctgtgagaggggatccctccattgacagctggactgttctttggggccttatgtggtgtttgcctctgaggtactcaggggcatttaggtttttcctcattccgactcggaccgatg

SEQ ID NO: 156 - DNA, 203 bp, Unknown
  IRES fragment
ggcgcgccagtcctcggaaccggtgagtacaccggaattgccaggacgaccgggtcctttcttggataaacccgctcaatgcctggagatttgggcgtgcccccgcaagactgctagccgagtagtgttgggtcgcgaaaggccttgtggtactgcctgatagggtgcttgcgagtgccccgggaggtcgactcggaccgatg

SEQ ID NO: 157 - DNA, 203 bp, Unknown
  IRES fragment
ggcgcgccagtcctgataaacccgctcaatgcctggagatttgggcgtgcccccgcaagactgctagccgagtagtgttgggtcgcgaaaggccttgtggtactgcctgatagggtgcttgcgagtgccccgggaggtctcgtagaccgtgcaccatgagcacgaatcctaaacctcaaagaaaaacccgactcggaccgatg

SEQ ID NO: 158 - DNA, 203 bp, Unknown
  IRES fragment
ggcgcgccagtccttttagtcagtgtggaaaatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaacgactcggaccgatg

SEQ ID NO: 159 - DNA, 203 bp, Unknown
  IRES fragment
ggcgcgccagtccttacggtaactttgtacgccagttttatctcccttcccccatgtaacttagaagtttttcacaaagaccaatagccggtaatcagccagattactgaaggtcaagcacttctgtttccccggtcaatgttgatatgctccaacagggcaaaaacaactgcgatcgttaaccgcaacgactcggaccgatg

SEQ ID NO: 160 - DNA, 203 bp, Unknown
  IRES fragment
ggcgcgccagtcctaagtttttcacaaagaccaatagccggtaatcagccagattactgaaggtcaagcacttctgtttccccggtcaatgttgatatgctccaacagggcaaaaacaactgcgatcgttaaccgcaaagcgcctacgcaaagcttagtagcatctttgaaatcgtttggctggtcgacgactcggaccgatg

SEQ ID NO: 161 - DNA, 203 bp, Unknown
  IRES fragment
ggcgcgccagtcctcaagcacttctgtttccccggtcaatgttgatatgctccaacagggcaaaaacaactgcgatcgttaaccgcaaagcgcctacgcaaagcttagtagcatctttgaaatcgtttggctggtcgatccgccatttcccctggtagacctggcagatgaggctagaaataccccaccgactcggaccgatg

SEQ ID NO: 162 - DNA, 203 bp, Unknown
  IRES fragment
ggcgcgccagtcctaacaactgcgatcgttaaccgcaaagcgcctacgcaaagcttagtagcatctttgaaatcgtttggctggtcgatccgccatttcccctggtagacctggcagatgaggctagaaataccccactggcgacagtgttctagcctgcgtggctgcctgcacaccctatgggtgtgcgactcggaccgatg

SEQ ID NO: 163 - DNA, 203 bp, Unknown
  IRES fragment
ggcgcgccagtcctgagccccgtgtgctcgctttgagtcctccggcccctgaatgtggctaaccttaaccctgcagctagagcacgtaacccaatgtgtatctagtcgtaatgagcaattgcgggatgggaccaactactttgggtgtccgtgtttcactttttcctttatatttgcttatggtgacacgactcggaccgatg

SEQ ID NO: 164 - DNA, 203 bp, Unknown
  IRES fragment
ggcgcgccagtcctgagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattgtggctgcttatggtgaccgactcggaccgatg

SEQ ID NO: 165 - DNA, 203 bp, Unknown
  IRES fragment
ggcgcgccagtcctgcgcctccgtgggcaagcactactgtttccccggtgaggccgcatagactgttcccacggttgaaagtggccgatccgttatccgctcatgtacttcgagaagcctagtatcgctctggaatcttcgacgcgttgcgctcagcactcaaccccggagtgtagcttgggccgatgcgactcggaccgatg

SEQ ID NO: 166 - DNA, 203 bp, Unknown
  IRES fragment
ggcgcgccagtcctgttcccacggttgaaagtggccgatccgttatccgctcatgtacttcgagaagcctagtatcgctctggaatcttcgacgcgttgcgctcagcactcaaccccggagtgtagcttgggccgatgagtctggacagtccccactggcgacagtggtccaggctgcgctggcggcccgactcggaccgatg

SEQ ID NO: 167 - DNA, 203 bp, Unknown
  IRES fragment
ggcgcgccagtcctcccggagtgtagcttgggccgatgagtctggacagtccccactggcgacagtggtccaggctgcgctggcggcccacctgtggcccaaagccacgggacgctagttgtgaacagggtgtgaagagcctattgagctacatgagagtcctccggcccctgaatgcggctaatcctcgactcggaccgatg

SEQ ID NO: 168 - DNA, 203 bp, Unknown
  IRES fragment
ggcgcgccagtcctctagttgtgaacagggtgtgaagagcctattgagctacatgagagtcctccggcccctgaatgcggctaatcctaaccatggagcaggcagctgcaacccagcagccagcctgtcgtaacgcgcaagtccgtggcggaaccgactactttgggtgtccgtgtttccttttattccgactcggaccgatg

SEQ ID NO: 169 - DNA, 203 bp, Unknown
  IRES fragment
ggcgcgccagtcctcggcccctgaatgcggctaatcctaaccatggagcaggcagctgcaacccagcagccagcctgtcgtaacgcgcaagtccgtggcggaaccgactactttgggtgtccgtgtttccttttattcttgaatggctgcttatggtgacaatcatagattgttatcataaagcgagtcgactcggaccgatg

SEQ ID NO: 170 - DNA, 203 bp, Unknown
  IRES fragment
ggcgcgccagtcctggggtcgccgtcctacacattgttgtgacgtgcggcccagattcgaatctgtaataaaagctttttcttctatatcctcagattggcagtgagaggagattttgttcgtggtgttggctggcctactgggtggggtagggatccggactgaatccgtagtatttcggtacaacacgactcggaccgatg

SEQ ID NO: 171 - DNA, 203 bp, Unknown
  IRES fragment
ggcgcgccagtcctgtaataaaagctttttcttctatatcctcagattggcagtgagaggagattttgttcgtggtgttggctggcctactgggtggggtagggatccggactgaatccgtagtatttcggtacaacatttgggggctcgtccgggattcctccccatcggcagaggtgcctactgttcgactcggaccgatg

SEQ ID NO: 172 - DNA, 203 bp, Unknown
  IRES fragment
ggcgcgccagtccttttgttcgtggtgttggctggcctactgggtggggtagggatccggactgaatccgtagtatttcggtacaacatttgggggctcgtccgggattcctccccatcggcagaggtgcctactgtttcttcgaactccggcgccggtaagtaagtacttgattttggtacctcgcgcgactcggaccgatg

SEQ ID NO: 173 - DNA, 203 bp, Unknown
  IRES fragment
ggcgcgccagtcctgacgctgccgggaagctccacctccgctcagcaggggacgccctggtctgagctctgtggtatctgattgttgttgaaccgtctctaagacggtgatactataagtcgtggtttgtgtgtttgtttgttaccttgtgtttgttcgtcacttgtcgacagcgccctgcgaattggcgactcggaccgatg

SEQ ID NO: 174 - DNA, 203 bp, Unknown
  IRES fragment
ggcgcgccagtcctagctctgtggtatctgattgttgttgaaccgtctctaagacggtgatactataagtcgtggtttgtgtgtttgtttgttaccttgtgtttgttcgtcacttgtcgacagcgccctgcgaattggtgtacccacaccgcgcggcttgcgaataatactttggagagtcttttgcccgactcggaccgatg

SEQ ID NO: 175 - DNA, 203 bp, Unknown
  IRES fragment
ggcgcgccagtcctagtcgtggtttgtgtgtttgtttgttaccttgtgtttgttcgtcacttgtcgacagcgccctgcgaattggtgtacccacaccgcgcggcttgcgaataatactttggagagtcttttgcctccagtgtcttccgtttgtactcgtcctcctctccctctccggccgggatgggcgactcggaccgatg

SEQ ID NO: 176 - DNA, 203 bp, Unknown
  IRES fragment
ggcgcgccagtccttactggggggtgtgtgggaccgtacctggagtgcacggtatatatgcattcccgcatggcaagggcgtgctaccttgccccttgacgcatggtatgcgtcatcatttgccttggttaagccccatagaaacgaggcgtcacgtgccgaaaatccctttgcgtttcacagaaccacgactcggaccgatg

SEQ ID NO: 177 - DNA, 203 bp, Unknown
  IRES fragment
ggcgcgccagtcctcccgcatggcaagggcgtgctaccttgccccttgacgcatggtatgcgtcatcatttgccttggttaagccccatagaaacgaggcgtcacgtgccgaaaatccctttgcgtttcacagaaccatcctaaccatgggtgtagtatgggaatcgtgtatggggatgattaggatccgactcggaccgatg

SEQ ID NO: 178 - DNA, 203 bp, Unknown
  IRES fragment
ggcgcgccagtcctatcatttgccttggttaagccccatagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctggctccgactcggaccgatg

SEQ ID NO: 179 - DNA, 203 bp, Unknown
  IRES fragment
ggcgcgccagtcctaaaggtctcgagatgccacgtggacgagggcatgcccaaagcacatcttaacctgagcgggggtcgcccaggtaaaagcagttttaaccgactgttacgaatacagcctgatagggtgctgcagaggcccactgtattgctactaaaaatctctgctgtacatggcacatggagcgactcggaccgatg

SEQ ID NO: 180 - DNA, 203 bp, Unknown
  IRES fragment
ggcgcgccagtccttgcccatagtaggactagcaaaacggagggactagccatagtggcgagctccctgggtggtctaagtcctgagtacaggacagtcgtcagtagttcgacgtgagcagaagcccacctcgagatgctacgtggacgagggcatgccaagacacaccttaaccctagcgggggtcgcgactcggaccgatg

SEQ ID NO: 181 - DNA, 203 bp, Unknown
  IRES fragment
ggcgcgccagtcctgttcgcaataagactggtcgtcacttggctgttctatcgtttcaggctttagcgcgcccttgcgcggcgggccgtcaagcccgtgcgctgtatagcgccaggtaaccggacagcggcgtgctggattttcccggtgccattgctctggatggtgtcaccaagctgacaaatgcgcgactcggaccgatg

SEQ ID NO: 182 - DNA, 203 bp, Unknown
  IRES fragment
ggcgcgccagtcctggtaaccggacagcggcgtgctggattttcccggtgccattgctctggatggtgtcaccaagctgacaaatgcggagtgaacctcacaaagcgacacgcctgtggtagcgctgcccaaaagggagcggaactccccgccgaggcggtcctctctggccaaaagcccagcgttgacgactcggaccgatg

SEQ ID NO: 183 - DNA, 203 bp, Unknown
  IRES fragment
ggcgcgccagtcctggtgtcaccaagctgacaaatgcggagtgaacctcacaaagcgacacgcctgtggtagcgctgcccaaaagggagcggaactccccgccgaggcggtcctctctggccaaaagcccagcgttgatagcgccttttgggatgcaggaaccccacctgccaggtgtgaagtggagtcgactcggaccgatg

SEQ ID NO: 184 - DNA, 203 bp, Unknown
  IRES fragment
ggcgcgccagtcctctctggccaaaagcccagcgttgatagcgccttttgggatgcaggaaccccacctgccaggtgtgaagtggagtgagcggatctccaatttggtctgttctgaactacaccatttactgctgtgaagaatgccctggaggcaagctggttacagccctgaccaggccctgcccgcgactcggaccgatg

SEQ ID NO: 185 - DNA, 203 bp, Unknown
  IRES fragment
ggcgcgccagtccttgaactacaccatttactgctgtgaagaatgccctggaggcaagctggttacagccctgaccaggccctgcccgtgactctcgaccggcgcagggtcaaaaattgtctaagcagcagcaggaacgcgggagcgtttcttttccttttgtactgacatgatggcggcgtctaaggcgactcggaccgatg

SEQ ID NO: 186 - DNA, 203 bp, Unknown
  IRES fragment
ggcgcgccagtcctacagccctgaccaggccctgcccgtgactctcgaccggcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatgcgactcggaccgatg

SEQ ID NO: 187 - DNA, 203 bp, Unknown
  IRES fragment
ggcgcgccagtcctcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattcttgcaaaagagaactgtttttgtcccccacgactcggaccgatg

SEQ ID NO: 188 - DNA, 203 bp, Unknown
  IRES fragment
ggcgcgccagtcctattgcttttcttccaactaaacccctattgatgtgttggtcgtttgccaatcggagggcgacaggcacaggtcgctccgagttctagtagtgtgggaacttgttactactgatgaaacgaggtagtgacactcagtacctgcgaacgaggtcggggccctcccttcttccttcacgactcggaccgatg

SEQ ID NO: 189 - DNA, 203 bp, Unknown
  IRES fragment
ggcgcgccagtccttcggggccctcccttcttccttcacccaactttcacttttcgttccactttagcaggggtcttctttctatccccctggcggcattggaactagccgtcgcgtcttaacgcgcagccctgaaggccccacaccttgtggatcttgccgtgggtatgtttctggcatgtgtttctcgactcggaccgatg

SEQ ID NO: 190 - DNA, 203 bp, Unknown
  IRES fragment
ggcgcgccagtccttagcaggggtcttctttctatccccctggcggcattggaactagccgtcgcgtcttaacgcgcagccctgaaggccccacaccttgtggatcttgccgtgggtatgtttctggcatgtgtttctcaagcctgcaaccgaagccgaacagccacatgaacagtttgagcgtggtacgactcggaccgatg

SEQ ID NO: 191 - DNA, 203 bp, Unknown
  IRES fragment
ggcgcgccagtcctccctcgtggtaacacgagcccccgtggccaaaagcccagtgtttacagcacctctcacatccaggacgaccccatcctggcgctcactcttagtagtatggcttagtacgcattaggtggtaagccgagctctccctcggccttgttctgaatgcacacatgtctaggggctaacgactcggaccgatg

SEQ ID NO: 192 - DNA, 203 bp, Unknown
  IRES fragment
ggcgcgccagtcctcctctcacatccaggacgaccccatcctggcgctcactcttagtagtatggcttagtacgcattaggtggtaagccgagctctccctcggccttgttctgaatgcacacatgtctaggggctaaggatgtcctacaggtacccgcacgtaaccttcagagagtgcggatctgagcgactcggaccgatg

SEQ ID NO: 193 - DNA, 203 bp, Unknown
  IRES fragment
ggcgcgccagtcctgcttagtacgcattaggtggtaagccgagctctccctcggccttgttctgaatgcacacatgtctaggggctaaggatgtcctacaggtacccgcacgtaaccttcagagagtgcggatctgagtaggagaccgtggtgcactgctttacagatgcagcccggtttaaaaagcgcgactcggaccgatg

SEQ ID NO: 194 - DNA, 203 bp, Unknown
  IRES fragment
ggcgcgccagtcctaatgcacacatgtctaggggctaaggatgtcctacaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactcgactcggaccgatg

SEQ ID NO: 195 - DNA, 203 bp, Unknown
  IRES fragment
ggcgcgccagtcctaggtacccgcacgtaaccttcagagagtgcggatctgagtaggagaccgtggtgcactgctttacagatgcagcccggtttaaaaagcgtctatgcccctacagggtagcggtgggccgcgccctttccttttaaaactacttgttctatggtgacaatggcaggaaacatgatcgactcggaccgatg

SEQ ID NO: 196 - DNA, 203 bp, Unknown
  IRES fragment
ggcgcgccagtcctaccagtgtttcaagaacacggatgcagcagcagctcttctggcctctcacgccatccaggggaccttgtcctaccctcttgtgtccgtcgtcagtgaatctctgactcgaaaaggtactcagcttctctatctacttgctgttgccgttgtcattatcctgtttattatcttgccgactcggaccgatg

SEQ ID NO: 197 - DNA, 203 bp, Unknown
  IRES fragment
ggcgcgccagtcctaacacggatgcagcagcagctcttctggcctctcacgccatccaggggaccttgtcctaccctcttgtgtccgtcgtcagtgaatctctgactcgaaaaggtactcagcttctctatctacttgctgttgccgttgtcattatcctgtttattatcttgctgggagttatcatgcgactcggaccgatg

SEQ ID NO: 198 - DNA, 203 bp, Unknown
  IRES fragment
ggcgcgccagtcctgcggacggagatcatcccccggttaccccctttcgacgcgggtactgcgatagtgccaccccagtctttcctactcccgactcccgaccctaacccaggttcctcggaacaggaacaccaatttactcatcccctggatgctgactaatcagaggaacgtcagcattttccggccgactcggaccgatg

SEQ ID NO: 199 - DNA, 203 bp, Unknown
  IRES fragment
ggcgcgccagtccttcctcggaacaggaacaccaatttactcatcccctggatgctgactaatcagaggaacgtcagcattttccggcccaggctaagagaagtagataagttagaatccaaattgatttatcatccccttgacgaattcgcgttggaaaaacacctctcacttgccgctcttcacaccgactcggaccgatg

SEQ ID NO: 200 - DNA, 203 bp, Unknown
  IRES fragment
ggcgcgccagtcctagaggaacgtcagcattttccggcccaggctaagagaagtagataagttagaatccaaattgatttatcatccccttgacgaattcgcgttggaaaaacacctctcacttgccgctcttcacacccattaatttaattcggcctctgtgttgagccccttgttgaagtgtttcccgactcggaccgatg

SEQ ID NO: 201 - DNA, 203 bp, Unknown
  IRES fragment
ggcgcgccagtcctaagtcaaccgactccgacgaaactaccatcatgcctccccgattatgtgatgctttctgccctgctgggtggagcaccctcgggttgagaaaaccttcttcctttttccttggactccggtcccccggtctaagccgctcggaatatgacagggttattttcacctcttcttttcgactcggaccgatg

SEQ ID NO: 202 - DNA, 203 bp, Unknown
  IRES fragment
ggcgcgccagtccttgctttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcgactcggaccgatg

SEQ ID NO: 203 - DNA, 203 bp, Unknown
  IRES fragment
ggcgcgccagtcctcctttttccttggactccggtcccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgccgactcggaccgatg

SEQ ID NO: 204 - DNA, 203 bp, Unknown
  IRES fragment
ggcgcgccagtcctagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagaaagcagttctcggtctagctctagtgcccgactcggaccgatg

SEQ ID NO: 205 - DNA, 203 bp, Unknown
  IRES fragment
ggcgcgccagtcctacaaaggcagcggaacccccctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtcccgactcggaccgatg

SEQ ID NO: 206 - DNA, 203 bp, Unknown
  IRES fragment
ggcgcgccagtcctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaacgactcggaccgatg

SEQ ID NO: 207 - DNA, 203 bp, Unknown
  IRES fragment
ggcgcgccagtccttctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttcgactcggaccgatg

SEQ ID NO: 208 - DNA, 203 bp, Unknown
  IRES fragment
ggcgcgccagtcctcctaaagttgatctcgaaacttggtgctaaacacatcaaggattgggaacacttggaggagttcagaaggtctctttgtgatgttgctgtttcgttgaacaattgtgcgtattacacacagttggacgacgctgtatgggaggttcataagaccgcccctccaggttcgtttgtcgactcggaccgatg

SEQ ID NO: 209 - DNA, 203 bp, Unknown
  IRES fragment
ggcgcgccagtcctacttggaggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagttcgactcggaccgatg

SEQ ID NO: 210 - DNA, 203 bp, Unknown
  IRES fragment
ggcgcgccagtcctggagttcagaaggtctctttgtgatgttgctgtttcgttgaacaattgtgcgtattacacacagttggacgacgctgtatgggaggttcataagaccgcccctccaggttcgtttgtttataaaagtctggtgaagtatttgtctgataaagttctttttagaagtttgtttatcgactcggaccgatg

SEQ ID NO: 211 - DNA, 203 bp, Unknown
  IRES fragment
ggcgcgccagtcctaattactaatttgatctttaggttataatgttaggactataaaaattagcttaatgcatttagtaatttaaggcttagttatttaactttacttatcaagatggccgttggcagccccacgaaatctagattagtccgaatgtcctattttgattaggtggtcagataggtcagcgactcggaccgatg

SEQ ID NO: 212 - DNA, 203 bp, Unknown
  IRES fragment
ggcgcgccagtcctgcctcagcgccaggcatagctggatcgtcaatcccaagtttggacttagacttgctctatgttacaattgggaggagcgtgacttaccattggtcgttgatgacgttaattccaaacaaaaacaacaacaacaacttagtttaaataattccggtctttaagcatcagggtagacgactcggaccgatg

SEQ ID NO: 213 - DNA, 203 bp, Unknown
  IRES fragment
ggcgcgccagtcctattagttagcccttgtggatacgccactgccgctcaggtacagtaggacataccccaaatattgggttccactcgtagagaagaaaattagtggcgaaacgtacggtttatgtcaaaggagaaggtgattttaattgcacctgaagcaaccctaggtcttccctttgatgtgagcgactcggaccgatg

SEQ ID NO: 214 - DNA, 203 bp, Unknown
  IRES fragment
ggcgcgccagtcctttaaacatcattgttcttatttacaatcaaatcgctatcgccacaaggctagtgataataactaagggggcgaagtcaagccctccaacctaatctccataaacagtgtctaagacgaacctcagcgaaagaaggaagatctctagacctactggaaataacataactctggaccgactcggaccgatg

SEQ ID NO: 215 - DNA, 203 bp, Unknown
  IRES fragment
ggcgcgccagtcctaaacagtgtctaagacgaacctcagcgaaagaaggaagatctctagacctactggaaataacataactctggacctattggaacttatataattggcgcccaaccaacaatctgaacccaccaatctaatttaacacactttgtcaggcgacaaacagggtagttaagttagaacgactcggaccgatg

SEQ ID NO: 216 - DNA, 203 bp, Unknown
  IRES fragment
ggcgcgccagtcctgactaagtgtgaacttgcctctctcaacaaaaagccaccgacattaagagagagagtattgctgcttagttaactgcaggccctatttagggttaccgcccaggatctgcaacagcattcctgtatcatccagggcaccggtggacttggtgaggattgagttgacctcatcatcgactcggaccgatg

SEQ ID NO: 217 - DNA, 203 bp, Unknown
  IRES fragment
ggcgcgccagtcctcattctatggttacccatcattagaggaaatttccaataaactctggtgtaaggcttagagtgatggtcgaggtgccctatttagggtgaggagcctcggtggcagccccaccaaatcctctattggataggaacagctgtactgggcagttacagcagtcgtatggtaacacacgactcggaccgatg

SEQ ID NO: 218 - DNA, 203 bp, Unknown
  IRES fragment
ggcgcgccagtcctattcaaaataaaatcccgtgcggtcggaaacaaaaattaatttaaattttttaattccgaaacttaaaaccaagtttaaagaaaacttaaaatcaagaaaacttaaaaccaagtttaaagaaaacttaaaatcaagaaaacttaaaaccaagtttaaagaaaacttaaaatcaacgactcggaccgatg

SEQ ID NO: 219 - DNA, 203 bp, Unknown
  IRES fragment
ggcgcgccagtcctcactgtttcatggttacccatcatttgaggaaatttccaataaacttgaatgtaaggcttgaaacagtggtctaggtgccctatttagggtgaggagcctagctggcagccccagtgaatcctctattggatagaaaccgctatatcgggtagctatagcagtcggatagtaatcgactcggaccgatg

SEQ ID NO: 220 - DNA, 203 bp, Unknown
  IRES fragment
ggcgcgccagtcctaaattagtggcaataacatatatatgtcaaccctgctcattggtttaattgagcgcatttagtgttgtgtgatcttgcgcgataaatgctgacgtgaaaacgttgcgtattgctacaacacttggttagctatttagctttactaatcaagacgccgtcgtgcagcccacaaaacgactcggaccgatg

SEQ ID NO: 221 - DNA, 203 bp, Unknown
  IRES fragment
ggcgcgccagtcctggaaattgtcgttgaactacatgttgtaaggctttagagaaataagggagtgtcctatttaggatgaggtgctccggtggcagccccaccaaaacctctagcgactaggaacagctatatcgggttgctatagcagtcaggatgtcattctggcgttccgaaatacccaaacctcgactcggaccgatg

SEQ ID NO: 222 - DNA, 203 bp, Unknown
  IRES fragment
ggcgcgccagtccttgtgaaaagggtaaagtatgaaagctactctcagaaaagtacttatgtattgatgagagccttaaaatgactttatattcacaaaactgctggaagacaatgatctggggtatcacattccctcttaggttaagtttcgcactactaggaatttttgcgaaaattcttaattcccgactcggaccgatg

SEQ ID NO: 223 - DNA, 203 bp, Unknown
  IRES fragment
ggcgcgccagtccttgatgagagccttaaaatgactttatattcacaaaactgctggaagacaatgatctggggtatcacattccctcttaggttaagtttcgcactactaggaatttttgcgaaaattcttaattccattcttatggtgtagtgtttgttcttttcaattggggcgtatctctctttcgactcggaccgatg

SEQ ID NO: 224 - DNA, 203 bp, Unknown
  IRES fragment
ggcgcgccagtcctaaactctccgaacactaggtgcagtaaggctttcatggagtggtttgctatttagcgtacgtgtaccataggcagccccaaaaacacgtgtgaggagaaagtcccagtcactttgggcaaagtagacagccgcgcttgcgtggtgggacttaattaatgcctgctaacccagttcgactcggaccgatg

SEQ ID NO: 225 - DNA, 203 bp, Unknown
  IRES fragment
ggcgcgccagtcctaggctttcatggagtggtttgctatttagcgtacgtgtaccataggcagccccaaaaacacgtgtgaggagaaagtcccagtcactttgggcaaagtagacagccgcgcttgcgtggtgggacttaattaatgcctgctaacccagttgaaattgataattttgatacaacaaccgactcggaccgatg

SEQ ID NO: 226 - DNA, 203 bp, Unknown
  IRES fragment
ggcgcgccagtcctcccgagctgcctgtgggttgcacccacccacagggcccactgggcgctagcactctggtactgaggtacctttgtgcgcctgtttttactccccttcccccgaagtaacttagaagctgtaaatcaacgatcaatagcaggtgtggcacaccagtcataccttgatcaagcactcgactcggaccgatg

SEQ ID NO: 227 - DNA, 203 bp, Unknown
  IRES fragment
ggcgcgccagtcctttcatgttggctgcgctggcggcccacctgtggcccaaagccacgggacgctagttgtgaacagggtgtgaagagcctattgagctacatgagagtcctccggcccctgaatgcggctaatcctaaccatggagcaggcagctgcaacccagcagccagcctgtcgtaacgcgccgactcggaccgatg

SEQ ID NO: 228 - DNA, 203 bp, Unknown
  IRES fragment
ggcgcgccagtccttgttcgcaggtagtcgtcagtggttcgacgccttggaataaaggtctcgagatgccacgtggacgagggcatgcccaaagcacatcttaacctgagcgggggtcgcccaggtaaaagcagttttaaccgactgttacgaatacagcctgatagggtgctgcagaggcccactgtcgactcggaccgatg

SEQ ID NO: 229 - DNA, 203 bp, Homo sapiens
ggcgcgccagtcctcgcatttccggcgacgcctcggtactgacctctgcagagccgggtggagcccattgacgtccagcgaagcgaggagcagcgatggacggtcgggtgcagctgataaaggccctcctggccttgccgatccggcctgcgacgcgtcgctggaggaacccgattccctttcccgagcgactcggaccgatg

SEQ ID NO: 230 - DNA, 203 bp, Homo sapiens
ggcgcgccagtccttcttctgcgacggcgcggacctggagcttccgcgcggtggcttcactctcctgtaaaacgctagagcggcgagttgttacctgcgtcctctgacctgagagcgaaggggaaagcggcgagatgactgaccgctacaccatccatagccagctggagcacctgcagtccaagtaccgactcggaccgatg

SEQ ID NO: 231 - DNA, 203 bp, Homo sapiens
ggcgcgccagtcctcatccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgcgactcggaccgatg

SEQ ID NO: 232 - DNA, 203 bp, Homo sapiens
ggcgcgccagtccttggcggtgggcgggagcggtcggcggcctcagccccttcagagagcgactttcaaactcgcgcccgcgtcgcggcagcacctgggcagccccgcacgccgtgcgcgtcccgagcccgcggggcagctaccgctcgaatctccctggggtgccctccccaggcagcaatgccaggcgactcggaccgatg

SEQ ID NO: 233 - DNA, 203 bp, Homo sapiens
ggcgcgccagtccttgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaaccgactcggaccgatg

SEQ ID NO: 234 - DNA, 203 bp, Homo sapiens
ggcgcgccagtcctggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctccgactcggaccgatg

SEQ ID NO: 235 - DNA, 203 bp, Homo sapiens
ggcgcgccagtcctcggggctcgcggacaaaacaagttgagcgcgagcgcgttgattggttggcggacggtgcgaggtggacgctgattggctgagggcagcgcgaggcgggcgctgattggctgcgacgcgccgacgccggtgttttgcagtcctgggcagctcggcagtccagcccggcccgggtccgactcggaccgatg

SEQ ID NO: 236 - DNA, 203 bp, Homo sapiens
ggcgcgccagtccttccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattcgactcggaccgatg

SEQ ID NO: 237 - DNA, 203 bp, Homo sapiens
ggcgcgccagtcctctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaactcgactcggaccgatg

SEQ ID NO: 238 - DNA, 203 bp, Homo sapiens
ggcgcgccagtcctgctgtcgtatcgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagcgactcggaccgatg

SEQ ID NO: 239 - DNA, 203 bp, Homo sapiens
ggcgcgccagtcctgactacaaggagacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagcgactcggaccgatg

SEQ ID NO: 240 - DNA, 203 bp, Homo sapiens
ggcgcgccagtcctagaggagtcaaccctgaggaggaaaaagtagtatgatttgctggcgtcacccctctgctccgtgcgggcgcggcgaatggcaggtcccgaggtcgcagcttccactggcgcgggttgagttccctgttgcccttggtctcggggtcgctgtaggcgctgaggctgcagctatcacgactcggaccgatg

SEQ ID NO: 241 - DNA, 203 bp, Homo sapiens
ggcgcgccagtcctcgacttcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaaccgactcggaccgatg

SEQ ID NO: 242 - DNA, 203 bp, Homo sapiens
ggcgcgccagtcctgattcacgcccccttccggcgcctagagcaccgctgccgccatgttgagggggggaccgcgaccagctgggcccctggctcagggaggggccacgtcagtgctgccagagacgtcacaatgccggcccagccgttcggcagagaagaggcgatggcggcgatggcatctctcggcgactcggaccgatg

SEQ ID NO: 243 - DNA, 203 bp, Homo sapiens
ggcgcgccagtcctgggaggtgaaaggtcatagtcctgtttggcggccatttctcttgaaactgcggctcgggacctgcggtacctgctgtagtcacgagggacgggcggcggcctggtcggcagagagtagcctgcaacattcggccgtggttacgatgagtttacccctcaatcccaaacctttcccgactcggaccgatg

SEQ ID NO: 244 - DNA, 203 bp, Homo sapiens
ggcgcgccagtcctaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggaagatgtagattccttcatgacgactcggaccgatg

SEQ ID NO: 245 - DNA, 203 bp, Homo sapiens
ggcgcgccagtcctcccttgcgcgccaccgtcccttctctcttcctcggcgctgcctacggaggtggcagccatctccttctcgctggcgattggaagacactctgcgacagtgttcagtccctgggcaggaaagcctccttccaggattcttcctcacctggggccgcttcttccccaaaaggcatccgactcggaccgatg

SEQ ID NO: 246 - DNA, 203 bp, Homo sapiens
ggcgcgccagtcctcagcaaaagaccagctggtcccagattcgctgctggagtgctggatggagcctttctctgccctctgtgacatttccaattttagataatgcctcacatctctgtccccccgggaccccctggagcccccatgatccctaagaagacagcttgaacctagatctcacccccaggcgactcggaccgatg

SEQ ID NO: 247 - DNA, 203 bp, Homo sapiens
ggcgcgccagtcctgtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagccgactcggaccgatg

SEQ ID NO: 248 - DNA, 203 bp, Homo sapiens
ggcgcgccagtcctgctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgacgactcggaccgatg

SEQ ID NO: 249 - DNA, 203 bp, Homo sapiens
ggcgcgccagtcctagacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcgactcggaccgatg

SEQ ID NO: 250 - DNA, 203 bp, Homo sapiens
ggcgcgccagtcctttgtcctcagccaattagcggcccaacgccccttccgcgcctcatccgggttcccgggacgggaaagtggcgtggtaaccaggcaactactgatcaatcccctccccggctgatttgcgcatcaggaggaggactgagcttatctgactccagagctttcaggagggaagaaagcgactcggaccgatg

SEQ ID NO: 251 - DNA, 203 bp, Homo sapiens
ggcgcgccagtccttccctagcaaggcgtttctctgggcgcgctctgtggccaccctcacactcggtgcccggaaatcgagccctttgcccacggctacttcacgggaccaccctcccgggttaggcataggccctcccggatcttccgcggtgcggtaaccagcgtgagctcgcccgccagaagaatcgactcggaccgatg

SEQ ID NO: 252 - DNA, 203 bp, Homo sapiens
ggcgcgccagtcctgcagtctccgcctaagactttccaagtcctgtagtttcgagcccgctgccctttgcctcctgggcggagaagctgcttcctcctgggaacaaccgcctcccgctcctagcaggttgctactgccccgaacccgcgctgcagggaacagcggggcaaacaaaaccaatagagccacgactcggaccgatg

SEQ ID NO: 253 - DNA, 203 bp, Homo sapiens
ggcgcgccagtcctagaaacagcctatagacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgcgactcggaccgatg

SEQ ID NO: 254 - DNA, 203 bp, Homo sapiens
ggcgcgccagtcctcggggcgccgctgagccaagtgggccacccgggcacggccacgctcccgggtcacgtgacacggagggggccgaattctgctggaggcagcgccatatcctggaggtgaaggtaccacctcatggagacccccgcggccgccgcccccgctgggagcttattcccctccttcctcgactcggaccgatg

SEQ ID NO: 255 - DNA, 203 bp, Homo sapiens
ggcgcgccagtccttatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcgactcggaccgatg

SEQ ID NO: 256 - DNA, 203 bp, Homo sapiens
ggcgcgccagtcctagagcgtcttctcgggcctgggcggcgcagacgaggcctgaggcggcggcgcgaggcagttccagctattcttcagatgctctggattttgagacggagcacaaattggaccctgtatttgattctccacggatgtcccgccgtagtttgcgcctggccacgacagcatgcacccgactcggaccgatg

SEQ ID NO: 257 - DNA, 203 bp, Homo sapiens
ggcgcgccagtccttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtccgactcggaccgatg

SEQ ID NO: 258 - DNA, 203 bp, Homo sapiens
ggcgcgccagtcctgggcaaaggaggaagagccagaggatccagacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggcgactcggaccgatg

SEQ ID NO: 259 - DNA, 203 bp, Homo sapiens
ggcgcgccagtcctgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccgcgactcggaccgatg

SEQ ID NO: 260 - DNA, 203 bp, Homo sapiens
ggcgcgccagtccttagtcccagagccaggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgaccgactcggaccgatg

SEQ ID NO: 261 - DNA, 203 bp, Homo sapiens
ggcgcgccagtcctatcgtgcgtcctctggagaagtgcgcgcgtgtaagtgtggcgagtgtggccaagggtgccggaggcagggttcgggagctgacatggacccaaatcctcgggccgccctggagcgccagcagctccgccttcgggagcggcaaaaattcttcgaggacattttacagccagagacgactcggaccgatg

SEQ ID NO: 262 - DNA, 203 bp, Homo sapiens
ggcgcgccagtcctccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaaccgactcggaccgatg

SEQ ID NO: 263 - DNA, 203 bp, Homo sapiens
ggcgcgccagtcctcccttcccaccccgcgtcgctcggcgttagccaaggcccgggcggcgccaccctccgggggcactaggtctggggccgcagtgcccagcacagagcagcgtttatcgggacgaagatgaatggaaagaattggagcaaaaagaggttgattacagcggcctcagggttcaggcacgactcggaccgatg

SEQ ID NO: 264 - DNA, 203 bp, Homo sapiens
ggcgcgccagtcctcgttgccgcgtccgagtccggccatcagtggctgcagatccggaggccaggagctcaaccacccttcttcggaacagggccggcctgctgctgtgccctcgacgctcggtgcctgtatctactccggggcctaggtcggctccgggggcggcttaggagaaggccgccggcgagcgactcggaccgatg

SEQ ID NO: 265 - DNA, 203 bp, Homo sapiens
ggcgcgccagtcctgcaggccgctgtgagcgcatcctcaccgggcacacccagtcggtcacctgtctccggtggggaggggacgggcttctctactctgcctcccaggaccgcaccatcaaagtctggagagctcatgacggtgtgctgtgccggactctgcaaggccacggccactgggtgaacacccgactcggaccgatg

SEQ ID NO: 266 - DNA, 203 bp, Homo sapiens
ggcgcgccagtcctgctccgcaggctgccggctccacccctcagggactggctggcttcgagcagggcatcggaaccaggcctcctggcactggcctgggtagagccagggcgagcaccagctgacccccagtggaaccctgtgacagtcctgccagggcccaggccatcccaaccgacttccatctccgactcggaccgatg

SEQ ID NO: 267 - DNA, 203 bp, Homo sapiens
ggcgcgccagtcctgcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggcgactcggaccgatg

SEQ ID NO: 268 - DNA, 203 bp, Homo sapiens
ggcgcgccagtcctagttccggtggctggcggaaacgggaacgtgcagccgcgggtgcaggagtcctggggcatggcgggggcggggcagggggaggcgcgcacagaacaggctggggcatccctcgccctggctctttgagcccggaccagacagagatgtgataatggatcatcatgtttctaccacgactcggaccgatg

SEQ ID NO: 269 - DNA, 203 bp, Homo sapiens
ggcgcgccagtccttacaccatacagctcaaacttcagaagattttgggttaagcagttatcattagtctgcaaatgatcgtgttttcacctgatcattagaaactaatgaaacaccttttaagtcttatgaattcaggttacactgttttccagatgccttggcagctggtacagggcctctgaaaacgactcggaccgatg

SEQ ID NO: 270 - DNA, 203 bp, Homo sapiens
ggcgcgccagtcctctcaggtgcttgcgaggtgatcagaaggcaaagatgtcggagcgaaaagtattaaacaaatactacccgccggactttgacccatcaaagatccccaaactcaagctccccaaagaccggcagtacgtggtgcggctgatggcccccttcaacatgaggtgtaagacgtgcggacgactcggaccgatg

SEQ ID NO: 271 - DNA, 203 bp, Homo sapiens
ggcgcgccagtcctacacaccctgacccgcatcgccctgggtctctcgagcctgctgcctgctcccccgccccaccagccatggtggtttctggagcgcccccagccctgggtgggggctgtctcggcaccttcacctccctgctgctgctggcgtcgacagccatcctcaatgcggccaggatacctcgactcggaccgatg

SEQ ID NO: 272 - DNA, 203 bp, Homo sapiens
ggcgcgccagtcctagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgccgactcggaccgatg

SEQ ID NO: 273 - DNA, 203 bp, Homo sapiens
ggcgcgccagtcctcacttccctctgtggctctgctcagaactggcggtttttcccagctccttgcccagaccaatacttccatgctgtcttcaagccctgcttcctgcacatctcccagcccagatggggagaacccatgtaagaaggtccactgggcttctgggaggagaaggacatcatccacagcgactcggaccgatg

SEQ ID NO: 274 - DNA, 203 bp, Homo sapiens
ggcgcgccagtcctattcctatagccgttatcactgccatcaccactgccaccagcatcttcttgcagattccacccctgctccccagagacttcctgctttgaaagtgagcagaaaggaagctctcagaaaaatctctagtggtggctgccgtcgctccagacaatcggaatcctgccttcaccacccgactcggaccgatg

SEQ ID NO: 275 - DNA, 203 bp, Homo sapiens
ggcgcgccagtcctgaagccggaagagaccggaccctgaacagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcacgactcggaccgatg

SEQ ID NO: 276 - DNA, 203 bp, Homo sapiens
ggcgcgccagtcctcttccgcctgcgcctgcgcaggcccgctccccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcgactcggaccgatg

SEQ ID NO: 277 - DNA, 203 bp, Homo sapiens
ggcgcgccagtcctacaccccaagaacgctgtcatttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagcgactcggaccgatg

SEQ ID NO: 278 - DNA, 203 bp, Homo sapiens
ggcgcgccagtcctgggtcacatggcggtggcgcggtagcgcgcgatgcagcacaggctagaggctgcgcaagcgcggggcccgcccctgggaccctccgggccgggcggtttggccccttagcgcccgggcgtcggggcggtaaaaggccggcagaagggaggcacttgagaaatgtctttcctccacgactcggaccgatg

SEQ ID NO: 279 - DNA, 203 bp, Homo sapiens
ggcgcgccagtcctttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggcgactcggaccgatg

SEQ ID NO: 280 - DNA, 203 bp, Homo sapiens
ggcgcgccagtcctgcggggtcaggggccgagcggagagggtagagacggggtttcaccgtgttagccaagatggtctcgatctcctgacctcgtgatccgcccgcctcggcctcccaaagtgctgggattacaggcgtgagccactgcgcccggcctgttgtacagttattaaagttatcatttaaccgactcggaccgatg

SEQ ID NO: 281 - DNA, 203 bp, Homo sapiens
ggcgcgccagtcctgagcccgtcttccgacgtgcagcctggcagtgcagtgagctgtctggccttttgtccttgatccttggttaaggaaatgaccaaccagtacggtattctcttcaaacaagagcaagcccatgatgatgccatttggtcagttgcttgggggacgaacaagaaggaaaactctgacgactcggaccgatg

SEQ ID NO: 282 - DNA, 203 bp, Homo sapiens
ggcgcgccagtccttggctggtgtctggccctcaggacatcctctccaatccaccacacaccaccttacccctctgctggcaagaggggacctgattcatcctcacgctaaacactcattctacccaactgattgagacagaacagaagataaactgaaacttctctgccttcccgctgcaagagtgacgactcggaccgatg

SEQ ID NO: 283 - DNA, 203 bp, Homo sapiens
ggcgcgccagtcctgtggcgcctgcgggattccgtaccggcgtctccatggcgaccgcgttggctgggtggcctccattgtcgggctgctgctctcagcggcggggctcgccagcgcttcagtgggcggggacgcggcaggtgactccagaccaaggaggatgagctgctgtccctggaagagaacggcgactcggaccgatg

SEQ ID NO: 284 - DNA, 203 bp, Homo sapiens
ggcgcgccagtcctatgcgccgcccgtggccatcttgtaggcggggacacgccgaggtaacttccagggtgcgccttcgttgtcttctccaagctgtagttctacgtcccgacctccctatcataccacactcttcagcgaccacgcaggcactttcccggtccccagtataccataattgaagaaaacgactcggaccgatg

SEQ ID NO: 285 - DNA, 203 bp, Homo sapiens
ggcgcgccagtcctcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctctcgactcggaccgatg

SEQ ID NO: 286 - DNA, 203 bp, Homo sapiens
ggcgcgccagtcctaccgagcttggctgtgtttatctcgttggggactaaggcgtcggttggcgcgcaacgggttctaggctgcaggcagctcgaggacccgcggccccgccccggctcggcctggcagatagcagaggcagcaggccgtgccgggggggcatgttgctgtaaccagtggcccaggggcgactcggaccgatg

SEQ ID NO: 287 - DNA, 203 bp, Homo sapiens
ggcgcgccagtcctgtggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgcgactcggaccgatg

SEQ ID NO: 288 - DNA, 203 bp, Homo sapiens
ggcgcgccagtcctacggtgggatccacaacatctccacatcgctgtccccacccagccagggcagcgccagcactagctcagacgcaaggacggaaccgctggactccaggttccttgcctgggagtaggagaaatccacctgctgggggctgagtgtggcctgagggacaggccctgggtcccgggcgactcggaccgatg

SEQ ID NO: 289 - DNA, 203 bp, Homo sapiens
ggcgcgccagtcctgggataaacggagctggacgactcagtctcttggtctgtggctgctgcggttacctggatgggcgagcacctctgaggctggctttgttacctgggcaataagggactagcagttcagccgttttctatgcctgctggatttgtttgtatttgttcccagccactgctcatgtacgactcggaccgatg

SEQ ID NO: 290 - DNA, 203 bp, Homo sapiens
ggcgcgccagtcctctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacacgactcggaccgatg

SEQ ID NO: 291 - DNA, 203 bp, Homo sapiens
ggcgcgccagtcctctcgctacgcaatgccaacccgaggctgaagaactacttcaaggagaactacattcctcaggtctgcgaggcactgttatgtggtatacttgttacatgtcctgaggatccgctgaggtatttagagggaatgatcatggttataatcaaaagtggtcttcagaatcttctttgcgactcggaccgatg

SEQ ID NO: 292 - DNA, 203 bp, Homo sapiens
ggcgcgccagtcctgcctctgtcatttcctagagctgtggcctcggatccctccctggtgccacagcagctgagtgcgcatcaaatctgaagaaaatctacacagtacagacagtacagatattttggagtgtatacaataatatccctcctgtgactagcctgcctttgagatgtagttatcatttacgactcggaccgatg

SEQ ID NO: 293 - DNA, 203 bp, Homo sapiens
ggcgcgccagtcctgctcggtctctcggtgctcgctccatcgggtctggcggggctggcagcggcgaggacccgggtctggcgctgtgggccgggagccgtggggcggcatggaggggctggttgtcgccgccggcggggacgtctccctgcacaacttcagcgcgaggctgtgggagcagctggtcccgactcggaccgatg

SEQ ID NO: 294 - DNA, 203 bp, Homo sapiens
ggcgcgccagtcctgccgccggatggcgtaggatcggccgctggtggtggtgataccgggtacccgggctatggcgccggcgcagcgctgccctctgtgccgccagaccttcttctgtggtcgcgggcacgtttacagccgcaagcaccagcggcagctgaaggaggctttggagaggctcctgcccccgactcggaccgatg

SEQ ID NO: 295 - DNA, 203 bp, Homo sapiens
ggcgcgccagtcctatggtcgatgatgctggtgccgctgagtcccagcggggcaaacagactccggcccactccctggagcagctgcgtaggttaccacttccgccgccacagattcgcatccggccctggtggtttccggtgcaggaactgagagaccctttggtgttctacctagaggcatggctgcgactcggaccgatg

SEQ ID NO: 296 - DNA, 203 bp, Homo sapiens
ggcgcgccagtcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttacccgaatctccagcgactcggaccgatg

SEQ ID NO: 297 - DNA, 203 bp, Homo sapiens
ggcgcgccagtcctgtcgggttaccagcgcgggggctacagttagcctcgagaacctttgctttcagccggactccggactcctccggggacagcgcagcgcccgccagagccctcggcgctccctcccgctggcggcttccgcagccttcaaggatggcgctggcggctttgatgatcgccctcggccgactcggaccgatg

SEQ ID NO: 298 - DNA, 203 bp, Homo sapiens
ggcgcgccagtcctgggggtccgcgggcgacactctcgggctcgcgcacctccccaagatggcggcgcccgaggcctcgcgcgcccggagttgctggttctgtgaggtagcggcggcaacgaccatggaggccacgtcccgggaggcggcgccagcgaagagctcggcctcgggccccaacgctcccccgactcggaccgatg

SEQ ID NO: 299 - DNA, 203 bp, Homo sapiens
ggcgcgccagtccttctggaagacggcagagctgccgccattttgcgggaagaggaggctctgtacctgcagtgctgcttttcttgcctagactctaggaactatccgagctccactccccacaacatactcaaaggaacggagagaaccgggacccccctgcggggacccggaactgatctgacaggcgactcggaccgatg

SEQ ID NO: 300 - DNA, 203 bp, Homo sapiens
ggcgcgccagtccttttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagcccgactcggaccgatg

SEQ ID NO: 301 - DNA, 203 bp, Homo sapiens
ggcgcgccagtcctcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaacccgactcggaccgatg

SEQ ID NO: 302 - DNA, 203 bp, Homo sapiens
ggcgcgccagtcctcacaggcagtgccactgcgcaggttgatcagcgaaacagcatccattttaatctgcggggagcccctgccttaccagggcgttctctccgcccgccggtggatgctccgcgcctgccctccgcagcctcgctcagcagtcctgcgttggggtctgcgccctaggatgcactgagcgactcggaccgatg

SEQ ID NO: 303 - DNA, 203 bp, Homo sapiens
ggcgcgccagtcctcgtctgccccgccagcgcgtcgagggaggggccagcgacacatggcctagtaactgtccggccgcggcgctggcttaagccatggctgagggtagccggattcctcaggcccgggcgctcctacagcagtgcctgcacgcccggctgcaaattcgcccagccgatggggacgtccgactcggaccgatg

SEQ ID NO: 304 - DNA, 203 bp, Homo sapiens
ggcgcgccagtcctctccgctccaatcccggaagtgcgcgcggccccgcccccgccggttcgcgtctctctgctgcggcgcggggaccgctgtgctctcggaaacggggtctctgggggatccagtgacgtgcccaaccacagagaccagacccctcctcctgtagagagtggtgctgccctctcgggcgactcggaccgatg

SEQ ID NO: 305 - DNA, 203 bp, Homo sapiens
ggcgcgccagtcctccaatcccggaagcgcgcgcggccccgcccccgaaagtcggctcggctccgctccaatcccggaagtgcgcgcggccccgcccccgccggttcgcgtctctctgctgcggcgcggggaccgctgtgctctcgacccctcctcctgtagagagtggtgctgccctctcgggatgtcgactcggaccgatg

SEQ ID NO: 306 - DNA, 203 bp, Homo sapiens
ggcgcgccagtcctgcgctgaggagagttcgccgccgtcgccgcccgtgaggatctgagagccatgtcggccagcagcctcttggagcagtacaaaatggatctgtacatcaaaaggatggattaaacgatgatgattttgaaccttacttgagtccacaggcaaggcccaataatgcatatactgcccgactcggaccgatg

SEQ ID NO: 307 - DNA, 203 bp, Homo sapiens
ggcgcgccagtccttgccgttatcgcccggctagtcagtcgtccaactcaccacagagaagtccggatcgtggtagagcgccgcgtcgcacccatgtgacgtcacggcggcgccactcgcttgaggctttccccgcccaccccagcccgttctctctttccggacctggccgagcaggaggcgccatccgactcggaccgatg

SEQ ID NO: 308 - DNA, 203 bp, Homo sapiens
ggcgcgccagtcctgctcacccctggatatacttctttgtcaagagaagcagaggtgtggacgctgtgtatgaaatgtctttcctccaggacccaagtttcttcaccatggggatgtggtccattggtgcaggagccctgggggctgctgccttggcattgctgcttgccaacacagacgtgtttctgcgactcggaccgatg

SEQ ID NO: 309 - DNA, 203 bp, Homo sapiens
ggcgcgccagtccttgcccagactggtcttgaactcctgggctcaagcgatcctcccaaagccctgagattacaggcgtgagccagcgcgccggacacaacctcctactttcatgaaagagtgggcacttccaacaggaggaaaatgtctttcctccaggacccaagtttcttcaccatggggatgtgcgactcggaccgatg

SEQ ID NO: 310 - DNA, 203 bp, Homo sapiens
ggcgcgccagtccttggtggcagcaggtgcttagcagcccttgtccagtctcgcctgtgacactgctgctcccttcccctgtcctgacctcctggttggctgtcctgccagagccttgcctggaagatgaaattccagctaccctgtgggagcagtaacgccttcttccttcttctcaatctccagaacgactcggaccgatg

SEQ ID NO: 311 - DNA, 203 bp, Homo sapiens
ggcgcgccagtcctaaagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcatcgactcggaccgatg

SEQ ID NO: 312 - DNA, 203 bp, Homo sapiens
ggcgcgccagtcctgtacccgggcccaaggctgagggacccggtggagcggaagtcactccctgaggcagtggcgacagcggcggcgagaggatgaacaacaagttcgacgctttgaaagatgatgacagtggggaccatgatcagaatgaagaaaacagcacacagaaagatggtgagaaggaaaaacgactcggaccgatg

SEQ ID NO: 313 - DNA, 203 bp, Homo sapiens
ggcgcgccagtcctaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggcgactcggaccgatg

SEQ ID NO: 314 - DNA, 203 bp, Homo sapiens
ggcgcgccagtccttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggaggccaggcaggcgactcggaccgatg

SEQ ID NO: 315 - DNA, 203 bp, Homo sapiens
ggcgcgccagtccttcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgcccgactcggaccgatg

SEQ ID NO: 316 - DNA, 203 bp, Homo sapiens
ggcgcgccagtcctgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcgatggaaattcacgactcggaccgatg

SEQ ID NO: 317 - DNA, 203 bp, Homo sapiens
ggcgcgccagtcctaatcagagctggttccgcgccgcggccgccgcgacaggtgcagcagagccgagccggccgcgctccgaacggcgcctcccgccccaccatgggcaacagcgcgagccgcagcgacttcgagtgggtctacaccgaccagccgcacacgcagcggcgcaaggagatactggccaacgactcggaccgatg

SEQ ID NO: 318 - DNA, 203 bp, Homo sapiens
ggcgcgccagtcctgcgcggcgtgactgagctacggttctggctgcgtcctagaggcatccggggcagtaaaaccgctgcgatcgcggaggcggcggccaggccgagaggcaggccgggcaggggtgtcggacgcagggcgctgggccgggtttcggcttcggccacagctttttttctcaaggtgcacgactcggaccgatg

SEQ ID NO: 319 - DNA, 203 bp, Homo sapiens
ggcgcgccagtcctggggcggggctgggctcccggggtaggtccgcggctgctgctgcgtccgacccccggccggcgcgggtatggagcttgggggtcactgggacatgaactcggccccgaggctggtctcggagaccgcagagcggaaacaggagcagaagacaggaaccgaggcggaggctgccgcgactcggaccgatg

SEQ ID NO: 320 - DNA, 203 bp, Homo sapiens
ggcgcgccagtcctttttccttccctctatccatccagagccccgccaaagggcgcacctgatctttctcatccttccctgctcttcccttcctctccacctcctcctcctccttggggaaaggggcccggagaagggcatgtgggggcccctctgacagtggcccgattggggtgacaggcgcccaacgactcggaccgatg

SEQ ID NO: 321 - DNA, 203 bp, Homo sapiens
ggcgcgccagtcctcgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgcgactcggaccgatg

SEQ ID NO: 322 - DNA, 203 bp, Homo sapiens
ggcgcgccagtccttgtcctggggtcgcggagacccgcgcgcctgccctgcacgccgggcggcaacctttgcagtcgcgttggctgctgcgatcggccggcgggtccctgccgaaggctcggctgcttctgtccacctcttacacttcttcatttatcggtggatcatttcgagagtccgtcttgtaacgactcggaccgatg

SEQ ID NO: 323 - DNA, 203 bp, Homo sapiens
ggcgcgccagtcctggccgcctccttgaggtagtatccgcacatggaattctagggccgcaggtgtatttacggtaactgtcgccactagatttcagcgcctttggactctcctgttttcactttcttttgttgactcccgtgtggccctcgtgggagcctgttttggctgcagcggtgtctggggtgcgactcggaccgatg

SEQ ID NO: 324 - DNA, 203 bp, Homo sapiens
ggcgcgccagtcctcagccgcgtctgggccaggagaaaaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggcgactcggaccgatg

SEQ ID NO: 325 - DNA, 203 bp, Homo sapiens
ggcgcgccagtcctggcatagcaagatggcctgccctcaggtacaggaagaaggaatggaatcggaaggaagaaaattcattccagagacaaaatagctcccctcctctgttgtagctgttcctctggcaatacaaactttctgctttcaggttctgcagcattccagaccttgagcactgaatcaggcgactcggaccgatg

SEQ ID NO: 326 - DNA, 203 bp, Homo sapiens
ggcgcgccagtcctcaacaggctccttactcaagctcgggttcttctcctaggcggaagccagaccagagagcgtgcgtgtttttcccagggtgccccgcgctgctgttatggccgcctccttgagagagtggatctttcctacaattgctgctggaagggaactatgaagccatattcttaaattcacgactcggaccgatg

SEQ ID NO: 327 - DNA, 203 bp, Homo sapiens
ggcgcgccagtccttcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagccgactcggaccgatg

SEQ ID NO: 328 - DNA, 203 bp, Homo sapiens
ggcgcgccagtccttccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatccgactcggaccgatg

SEQ ID NO: 329 - DNA, 203 bp, Homo sapiens
ggcgcgccagtcctagaaggctatttccgtttccgtacggaagcaaaggagccaagaccatggcgaaagccggggataagagcagcagcagcgggaagaaaagtctaaaacggaaagccgctgccgaagaacttcaggaggctgcaggcgctggggatggggcgacggaaaacggggtccaacccccgcgactcggaccgatg

SEQ ID NO: 330 - DNA, 203 bp, Homo sapiens
ggcgcgccagtcctatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacaccgactcggaccgatg

SEQ ID NO: 331 - DNA, 203 bp, Homo sapiens
ggcgcgccagtcctccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagccgactcggaccgatg

SEQ ID NO: 332 - DNA, 203 bp, Homo sapiens
ggcgcgccagtcctgggaactacttccgggggagcggcgcggcggcgcgggagttggttctaaagagtggtgagtcagaagagacgtcaggcagcaagcgacttgggccatggcctctgacctagacttctcacctccggaggtgcccgagcccactttcctggagaacctgctacggtacggactctcgactcggaccgatg

SEQ ID NO: 333 - DNA, 203 bp, Homo sapiens
ggcgcgccagtcctgattcctgtgcaaagagagagtgtcaatgaagacctcaaagtctggagaaaaatgacctttcatggaataagaagtatacctccttctacatgtttttgtcttactgacctctgataactggaacacatgactctgggtctgtagaaagtcaactgatcaaactcatcctcacccgactcggaccgatg

SEQ ID NO: 334 - DNA, 203 bp, Homo sapiens
ggcgcgccagtcctattgggctgagtcggagacttcctttcctgattggccgtgttgtacggcggcttctcgcgcagctgatgacctggaagtgatgcctaaagctgtggaccgcgtgggctcgcctccctgggactaggtttcagcggccgctgcgatgaccaaaataaaggcagatcccgacgggccgactcggaccgatg

SEQ ID NO: 335 - DNA, 203 bp, Homo sapiens
ggcgcgccagtcctcgaaggggcgcggggggcggggaccgtgcccgaccgtgccagctcccgccccggaagcggaagtgcaagcactgcggggtcctgtccagtgtgagcccgacccgagctccagtagttccgcccgctggtcatcgcgccctttcccctgccggtgtcctgctcgccgtccccgcccgactcggaccgatg

SEQ ID NO: 336 - DNA, 203 bp, Homo sapiens
ggcgcgccagtcctggggcaggcccgctttctgtcaaaatggcagcgcccagcgtgcgcgggtatctctgaagttggggtttaagattcttgcccgtgagagcgaacgagcctgccgtacttctgattttgaaacacctgggtctgggcttcccgggcgagcggtggaacctgtgagaagtttctacacgactcggaccgatg

SEQ ID NO: 337 - DNA, 203 bp, Homo sapiens
ggcgcgccagtcctatctttaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcgactcggaccgatg

SEQ ID NO: 338 - DNA, 203 bp, Homo sapiens
ggcgcgccagtcctccaagatgcaccggggagtaggtccggcctttcgggtggtcaggaagatggcggcctctggggcggagccgcaggtcctggtacaatacttggtgttacgaaaggatctatcacaagctccgttctcctggccggcgggcgcactggtagcgcaggcttgtcacgcggccaccgcgactcggaccgatg

SEQ ID NO: 339 - DNA, 203 bp, Homo sapiens
ggcgcgccagtccttccctggctcgcctcgcgcctgccggcggatccgtggtcatgccaacccagcagccggctgcgccgagtactcgtgcccccaaaccctcccggagtctctctggctcactttgtgccctgttttctgatgcagactcgggatccgggatgaaggcggagcttccccctgggcctcgactcggaccgatg

SEQ ID NO: 340 - DNA, 203 bp, Homo sapiens
ggcgcgccagtcctccttaactccatatattcatccacatccaaaagattgggttggtatattcaaggttggatggagtactgctcgtgattattacacgtttttatggtcccctatgcctgaacattatgtggaaggatcaacagtcaattgtgtactagcattccaagttgaaaattgagaaaacccgactcggaccgatg

SEQ ID NO: 341 - DNA, 203 bp, Homo sapiens
ggcgcgccagtcctacggctcagcgacgccacggccagcagcgctcgcgtcctccccagcaacagttactcaaagctaatcagatagcgaaagaagcaggagagcaagtcaagaaatacggtgaaggagtccttcccaaagttgtctaggtccttccgcgccggtgcctggtcttcgtcgtcaacacccgactcggaccgatg

SEQ ID NO: 342 - DNA, 203 bp, Homo sapiens
ggcgcgccagtcctttattcacttcacacttattgaaaagtgtgtatgtgagagggtggggtgtgtgtgtcaaagagagtgaggaagagaaggagagagagatcaattgattctgcagcctcagctccagcatccctcagttgggagcttccaaagccgggtgatcacttggggtgcatagctcggagcgactcggaccgatg

SEQ ID NO: 343 - DNA, 203 bp, Homo sapiens
ggcgcgccagtcctgcagcctcaaaccccagctgttggggccaggacacccagtgagcccatacttgctctttttgtcttcttcagactgcgccatggggctcagcgacggggaatggcagttggtgctgaacgtctgggggaaggtggaggctgacatcccaggccatgggcaggaagtcctcatcacgactcggaccgatg

SEQ ID NO: 344 - DNA, 203 bp, Homo sapiens
ggcgcgccagtcctgagcatgttggcctggtcctttgctaggtactgtagagcaggtgagagagtgagggggaaggactccaaattagaccagttcttagccatgaagcagagactctgaagccagactacctgggtcccaatcttgggcttggtatttcctcgctgtgtgactctggactgcgccatcgactcggaccgatg

SEQ ID NO: 345 - DNA, 203 bp, Homo sapiens
ggcgcgccagtcctcaggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttttacaggcgactcggaccgatg

SEQ ID NO: 346 - DNA, 203 bp, Homo sapiens
ggcgcgccagtcctagactatgatgaattcgaatgggacacatttgcttctgtggagttacgattcaaactgaatgtccaatataggaaggcaacatatacaacaagcaaaagtgattttagaaataacagaacgcgggagaaaattcacacacggaaaatgatacggataacaaaagcagattcacacgactcggaccgatg

SEQ ID NO: 347 - DNA, 203 bp, Homo sapiens
ggcgcgccagtcctccaaggaattgaaagggctgtagggggaggcagtgcgagccagccccgactgctcctcctcttcctcctcctcctccaaactcgcgagccccagagctcgctcagccgccgggagcacccagagggacgggaggcagccgcgcagccccgagctgggcagtgtccccagccgcccgactcggaccgatg

SEQ ID NO: 348 - DNA, 203 bp, Homo sapiens
ggcgcgccagtcctagttgtgactttcattttacctttcgaattcctgggtatatcttgggggctggaggacgtgtctggttattatataggtgcacagctggaggtgagatccacacagctcagaccagctggatcttgctcagtctctgtcagaggaagatcccttggaggaggccccgcagcgaccgactcggaccgatg

SEQ ID NO: 349 - DNA, 203 bp, Homo sapiens
ggcgcgccagtcctgaggagcctgaggaagagggcggcgacggtggtggtgactgagcggagcccggtgacaggatggctgggcacagattggtgttggtattaggagatctgcacatcccacaccggtgcaacagtttgccagctaaattcaaaaaactcctggtgccaggaaaaattcagcacattcgactcggaccgatg

SEQ ID NO: 350 - DNA, 203 bp, Homo sapiens
ggcgcgccagtcctgacggcaaatggcggacttcgacacctacgacgatcgggcctacagcagcttcggcggcggcagagggtcccgcggcagtgctggtggccatggttcccgtagccagaaggagttgcccacagagcccccctacacagcatacgtaggaaatctacctttcaatacggttcaggcgactcggaccgatg

SEQ ID NO: 351 - DNA, 203 bp, Homo sapiens
ggcgcgccagtcctcggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagcccgactcggaccgatg

SEQ ID NO: 352 - DNA, 203 bp, Homo sapiens
ggcgcgccagtcctcgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctgggatgaaattgattctgcagtaaagcgactcggaccgatg

SEQ ID NO: 353 - DNA, 203 bp, Homo sapiens
ggcgcgccagtcctaatgcgcacgccgtgggcgggccccgagccggaattgggggtgaagcgatagcgttttgcccgcattcggggcgcgcggagctggggggtccctgtggggctcccggagttaagatggcgtcctcagcggagggggacgaggggactgtggtggcgctggcgggggttctgcagcgactcggaccgatg

SEQ ID NO: 354 - DNA, 203 bp, Homo sapiens
ggcgcgccagtccttcgctttgtgattcttgatccggaacttgtcacccaggaaccccggaagaggtagctcacgcgatagaaacgtgttcgctgcccagaagaagggaaggcgcgagtgaggaaaggaggtactgtagatgccctccaaatccttggttatggaatatttggctcatcccagtacaccgactcggaccgatg

SEQ ID NO: 355 - DNA, 203 bp, Homo sapiens
ggcgcgccagtcctcgtcacttcctgttgccttaggggaacgtggctttccctgcagagccggtgtctccgcctgcgtccctgctgcagcaaccggagctggagtcggatcccgaacgcaccctcgccatggactcggccctcagcgatccgcataacggcagtgccgaggcaggcggccccaccaaccgactcggaccgatg

SEQ ID NO: 356 - DNA, 203 bp, Homo sapiens
ggcgcgccagtcctccaatgaggaagcctggcaggatggagggcgaggcctggcagctgtagtgcttctgggcagtagaggcgcggggtgcggagctagggcggccgagagccatggcggcgctattggcggcggcggcagtgcgagcccggatcctgcaggtttcttccaaggtgaaatccagtccccgactcggaccgatg

SEQ ID NO: 357 - DNA, 203 bp, Homo sapiens
ggcgcgccagtcctagccgccacgccccgggagaggaccgaccgcccagaccgccggtcccggggccccctgggccacgccgatcacggggagcccctcgactgcctcccagaacaaagtgggaaagggaagcttagcccgccgctgccgcctccgagcagcccgccaggactctggctactggagatcgactcggaccgatg

SEQ ID NO: 358 - DNA, 203 bp, Homo sapiens
ggcgcgccagtcctctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccggggtggtttgagtccagccaatgacactcgactcggaccgatg

SEQ ID NO: 359 - DNA, 203 bp, Homo sapiens
ggcgcgccagtcctgtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggcccgactcggaccgatg

SEQ ID NO: 360 - DNA, 203 bp, Homo sapiens
ggcgcgccagtcctgtggccggcatgtcgggggcggggggcgcctttgcctcgccgagggaggtcttgctggagcggccgtgctggctggacgggggctgcgagccggcccgcaggggctacctctaccagcagctgtgctgcgtagatgagcgggatcgtgtgcagaagaaaaccttcaccaagtggcgactcggaccgatg

SEQ ID NO: 361 - DNA, 203 bp, Homo sapiens
ggcgcgccagtccttgagctgagcctgtgccgagtgagcgtctcgtggggccgccagccttcagctgcctgtgtgccacacggggctgcccagagcaccgtgcctgaggccgagggtccgggcgacgaaggtgtgggggcagcatgtctcagcaccagctccgcgtgccgcagcccgagggcctgggccgactcggaccgatg

SEQ ID NO: 362 - DNA, 203 bp, Homo sapiens
ggcgcgccagtcctggccagcgcagccattttggcttcctgaccttgggctacggctgaccgttttttgtggtgtactccgtgccatcatgtccgtcctgacgccgctgctgctgcggggcttgacaggctcggcccggcggctcccagtgccgcgcgccaagatccattcgttgccgccggaggggacgactcggaccgatg

SEQ ID NO: 363 - DNA, 203 bp, Homo sapiens
ggcgcgccagtcctccagccatgggctcggggcgcgtacccgggctctgcctgcttgtcctgctggtccacgcccgcgccgcccagtacagcaaagccgcgcaagatgtggatgagtgtgtggaggggactgacaactgccacatcgatgctatctgccagaacaccccgaggtcatacaagtgcatccgactcggaccgatg

SEQ ID NO: 364 - DNA, 203 bp, Homo sapiens
ggcgcgccagtcctcaggccacaggagtaaaatctctctgcccgtcttctgggaagggagaatggcggcgcccgggctgcggctgggagcgggaagactctttgaaatgcctgcggtgctagagcgactgagccgctataatagcacgtcccaagcttttgctgaggtgctgcggctgccgaagcagccgactcggaccgatg

SEQ ID NO: 365 - DNA, 203 bp, Homo sapiens
ggcgcgccagtcctggggctttcagtagaaacaagcaaaccgcaggtccctgtggggggactctccaggaagaagggtaatttcctgcctccttaaattggctgctactgtcagttattttgctcccaaccccagagcttcacttgctccttcacttcccagttccgcaagaaccgtgggcgacagttcgactcggaccgatg

SEQ ID NO: 366 - DNA, 203 bp, Homo sapiens
ggcgcgccagtcctcgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagcccgactcggaccgatg

SEQ ID NO: 367 - DNA, 203 bp, Homo sapiens
ggcgcgccagtcctatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggcgactcggaccgatg

SEQ ID NO: 368 - DNA, 203 bp, Homo sapiens
ggcgcgccagtcctgcttctgtactgccaggtccgggtcggcggctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagccgactcggaccgatg

SEQ ID NO: 369 - DNA, 203 bp, Homo sapiens
ggcgcgccagtccttgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgcgactcggaccgatg

SEQ ID NO: 370 - DNA, 203 bp, Homo sapiens
ggcgcgccagtcctacctgcagctcccgcgactagaagtgtgaggtcccagggcccttcccgcggaatcggcgctgagaagccccaacccccctcccgcctcccaggcaccttcgggtccaggactacaactcccggcagggtgcgcaaaacgaccgcccaaggcaacggaggctcacgagaatcagccgactcggaccgatg

SEQ ID NO: 371 - DNA, 203 bp, Homo sapiens
ggcgcgccagtcctgtgggggaaaaggccccggaacgaggccggcccgcgagggcccgcgctcccctcctccccggcggccgcactcacccactccggaatcggccctgtcgcccccgcccgcactccagagccggctgagaacggcagcggcgagggctccacgtgcagcgtctctccggaatcagccgactcggaccgatg

SEQ ID NO: 372 - DNA, 203 bp, Homo sapiens
ggcgcgccagtcctgctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaaccgactcggaccgatg

SEQ ID NO: 373 - DNA, 203 bp, Homo sapiens
ggcgcgccagtcctctcttacaacattggctgccggcgtgactttgaccgcttcccggtgcgttaccggcagctgaacccacccggcgccacgggactttgacgcgtgctctgcgcttgccatgagactcctgggagctgcagccgtcgcggctctggggcgcggaagggcccccgcctccctaggctcgactcggaccgatg

SEQ ID NO: 374 - DNA, 203 bp, Homo sapiens
ggcgcgccagtcctggtattctcatcgcggtcacctctaccggtgtggacaagtaaagtttgaatcagcttctccatggcctgggcaccagttcccggctgagccattttccttttggctaaaagtccccgcccagaggccaattcgtcgcggcggcggtggagatcgcaggtcgctcaggcttgcagcgactcggaccgatg

SEQ ID NO: 375 - DNA, 203 bp, Homo sapiens
ggcgcgccagtcctgtgtaggatgcatctgcggtggccattcttctctccagaggtccttcctaggactgactttgtggagattctgtgctggtaggtggcggggcaagacacgcctgtctctccccctggaaggagtcagtccagcaagaaacctgatgaaaccagtgactcccagctctggatgagcgactcggaccgatg

SEQ ID NO: 376 - DNA, 203 bp, Homo sapiens
ggcgcgccagtccttgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatggggccgtgggcaagacctgccttcgactcggaccgatg

SEQ ID NO: 377 - DNA, 203 bp, Homo sapiens
ggcgcgccagtcctatttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgccacgactcggaccgatg

SEQ ID NO: 378 - DNA, 203 bp, Homo sapiens
ggcgcgccagtcctcggggcgccgagacagggcgtgttcgctgttcagtgccggtgttgcagggagtgagggcagctggagtgcgttctgccgaagcttgtggttgcacgcccatcgtcttaggggctaccttccgtgttaccttatcccatatcacacaactggtcctcagccataacaagctaacacgactcggaccgatg

SEQ ID NO: 379 - DNA, 203 bp, Homo sapiens
ggcgcgccagtcctgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtgaccatgtccaagtctctgaagaagttggtggaggcgactcggaccgatg

SEQ ID NO: 380 - DNA, 203 bp, Homo sapiens
ggcgcgccagtcctagtgcagagctcggggcaggggccgggaggcgtgggggagccgggccctcccctcaggaacgtgtcccggggccgacccggcccgtagtgtggaagcagcttcaggtaggtgagctcgtgaaacaatatgaagaggagaaaatagccttttaaggaaattggcccacagaaaggcgactcggaccgatg

SEQ ID NO: 381 - DNA, 203 bp, Homo sapiens
ggcgcgccagtcctaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatccgactcggaccgatg

SEQ ID NO: 382 - DNA, 203 bp, Homo sapiens
ggcgcgccagtcctggtggtttgaactttgagccttttgtagtcctgatgaataatttcattttcctcaagtttatgacactcggaacgtcaagaactggaggtttgtgcaatttgagaccggtcggcactgtgcagagatcagagtactaagagacagagattaaaatggcttccagaggaaagacacgactcggaccgatg

SEQ ID NO: 383 - DNA, 203 bp, Homo sapiens
ggcgcgccagtcctcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggcgactcggaccgatg

SEQ ID NO: 384 - DNA, 203 bp, Homo sapiens
ggcgcgccagtcctccagaagacgtcaggtgacttcagtcctgctgcagttgtgcagcagaggagactgcagacttcggttgaggaaacgggtatttcatgtctcagggagtaggtttgtgcagttacagcttttctgttggtatgcataattaataattggagctgcaaagcagatcgtgacaagagcgactcggaccgatg

SEQ ID NO: 385 - DNA, 203 bp, Homo sapiens
ggcgcgccagtcctgtgctcgtggggagctggccgagtggaaaacgtccacattgacccaaccgcagtgaagggagagcgcctccagtggtgtggtgcgtggagaaatgggaaggagagagttctgatgagaccctttttgctcttcctgctgcatctgagcctgtgatacgctcctctgcagaaaatcgactcggaccgatg

SEQ ID NO: 386 - DNA, 203 bp, Homo sapiens
ggcgcgccagtcctaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagcccgactcggaccgatg

SEQ ID NO: 387 - DNA, 203 bp, Homo sapiens
ggcgcgccagtcctgtcaaggcccgccccctgccaacggtcctcacccattagccgaaggccccgcccctcacagattgccgcagggcaggggcggagacagcccgggccgtcccaggctccgcccccggaagcctcacttccgggcgcgagcacgccccgcctcgccccggcggcagagaggagactcgactcggaccgatg

SEQ ID NO: 388 - DNA, 203 bp, Homo sapiens
ggcgcgccagtcctgtctttaaagggcaattgtcgacactctgcaaacataccgatttgttgtctgcccactttggagtcttcaatctgggcagtaactatttaccctttttcctgctagcctgtccccctctctggattgaagtcacctgctaagacaatggactaccgaccagactcccggaaatccgactcggaccgatg

SEQ ID NO: 389 - DNA, 203 bp, Homo sapiens
ggcgcgccagtcctttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactcgactcggaccgatg

SEQ ID NO: 390 - DNA, 203 bp, Homo sapiens
ggcgcgccagtcctcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggacgactcggaccgatg

SEQ ID NO: 391 - DNA, 203 bp, Homo sapiens
ggcgcgccagtcctcactcagggcaagggtgtccgacggctggagcgttctgttttgaacccaaagtggatgatgctgtcagagctgaactactgaaaggaggctgtgaaaatttcccatcttctcattggccatcagttgagataagatggaagactcttacaaggataggacttcactgatgaaggcgactcggaccgatg

SEQ ID NO: 392 - DNA, 203 bp, Homo sapiens
ggcgcgccagtcctgtctgacttgagtccctgctgctgcagtgcacgccccttcggcagccagggtggggcccagacccaacctggcccctcctgcccccaccccgcctttgggtcgctgacccccaggctgtggtgagggtctgagagctggtaccacggagcctgggcaacctcctccgcccaccccgactcggaccgatg

SEQ ID NO: 393 - DNA, 203 bp, Homo sapiens
ggcgcgccagtcctaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaaccgactcggaccgatg

SEQ ID NO: 394 - DNA, 203 bp, Homo sapiens
ggcgcgccagtcctgaaaagcggccagggtggcccctagctttccttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtccgactcggaccgatg

SEQ ID NO: 395 - DNA, 203 bp, Homo sapiens
ggcgcgccagtcctgggggcaacggtcacctgatctgcggctgtcgaggccgctgaggcagtggaggctgaggctatgatggcggccatggcgacggctcgagtgcggatggggccgcgatgcgcccaggcgctctggcgcatgccgtggctgccggtgtttttgtcgttggcggcggcggcggcggccgactcggaccgatg

SEQ ID NO: 396 - DNA, 203 bp, Homo sapiens
ggcgcgccagtccttgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagcgactcggaccgatg

SEQ ID NO: 397 - DNA, 203 bp, Homo sapiens
ggcgcgccagtcctgcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagttcgactcggaccgatg

SEQ ID NO: 398 - DNA, 203 bp, Homo sapiens
ggcgcgccagtcctatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggcccccgactcggaccgatg

SEQ ID NO: 399 - DNA, 203 bp, Homo sapiens
ggcgcgccagtcctgaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagcgactcggaccgatg

SEQ ID NO: 400 - DNA, 203 bp, Homo sapiens
ggcgcgccagtcctattggccgagcgcggccgttgggggtgaggccgcgtcgggggaggacaacaaagggccgcgggcggcgggcagtggtgtcccagtctcccggtgcttccctgaggctgaggcgcccggcctcccgcccgccgcgctccagatgaagtgtgagcactgcacgcgcaaggaatgtacgactcggaccgatg

SEQ ID NO: 401 - DNA, 203 bp, Homo sapiens
ggcgcgccagtcctcaggaactgggccagctccggtcccttccttttggggctctcactctggaggatggggtggatgggagaaaaaaccgggaagatcctgacggagttcctccagttctatgaagaccagtatggcgtggctctcttcaacagcatgcgccatgagattgagggcacggggctgcccgactcggaccgatg

SEQ ID NO: 402 - DNA, 203 bp, Homo sapiens
ggcgcgccagtcctacgaggctagatggcttcacaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgccgactcggaccgatg

SEQ ID NO: 403 - DNA, 203 bp, Homo sapiens
ggcgcgccagtcctggcggagcggcgggcggggcgtcgccgtactaggcctgccccctgtccggccagcccctcgaagcacctactccacaggtccagccggccggtgagcgcctggggaccgcagaggtgagagtcgcgcccgggagtccgccgcctgcgccaggatggagttcgtgaaatgccttgcgactcggaccgatg

SEQ ID NO: 404 - DNA, 203 bp, Homo sapiens
ggcgcgccagtcctgggcttgggcgccagaggcggagtcggggaggaggtggctccagagatggcagtgagcgagaggagggggctcggccgcgggagccccgcggagtgggggcagcggctacttctggtgctgctgctgggtggctgctccgggcgcatccaccagctggcgctgacgggggagaacgactcggaccgatg

SEQ ID NO: 405 - DNA, 203 bp, Homo sapiens
ggcgcgccagtcctgagtaggatggagtctccctcccgagctgggggtgtgggcctaggaaaggctgcttcgccgctgtgttcggagagctctggatactgcggggcttttccgcggaggagcgcccgccggcatctgcatctgggaccgacctcctgggctggctgatcaaagaggaagcagcagcacgactcggaccgatg

SEQ ID NO: 406 - DNA, 203 bp, Homo sapiens
ggcgcgccagtcctacaaagcccagcccagcggaaggaacggtttcggagttgtttttctttgatacgggagttcctccttgctctcgcccctactctttctggtgttagatcgagctaccctctaaaagcagtttagagtggtaaaaaaaaaaaaaaacacaccaaacgctcgcagccacaaaagggcgactcggaccgatg

SEQ ID NO: 407 - DNA, 203 bp, Homo sapiens
ggcgcgccagtcctctctgggctgctcgggcgccaccactactgtccccatcccgccccgccagctgggccaaagggtgacttgactcacgacgctgccaccagcccacggcttgcccgaggcgtataaaggctgccagggccgcaggctgccaagccctgccctgcccaaggcgcatagagcatggccgactcggaccgatg

SEQ ID NO: 408 - DNA, 203 bp, Homo sapiens
ggcgcgccagtcctagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactcgactcggaccgatg

SEQ ID NO: 409 - DNA, 203 bp, Homo sapiens
ggcgcgccagtccttccagagccaagcgccccgcccctgcccgggcgcgctccctccttagccctgcccctctctgaccccacctccgacgcaagagtggggcggggcagctgccggtggcgtcccgaacccagactcgccccgccccagagactgcgcctgcgcgggcacgagacaacctctccgcgcgactcggaccgatg

SEQ ID NO: 410 - DNA, 203 bp, Homo sapiens
ggcgcgccagtcctgcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagacgactcggaccgatg

SEQ ID NO: 411 - DNA, 203 bp, Homo sapiens
ggcgcgccagtcctgtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagacgactcggaccgatg

SEQ ID NO: 412 - DNA, 203 bp, Homo sapiens
ggcgcgccagtcctgagtcacgtgggtccccccggttccggcgcggttgaggccttcggtggtgaacgagtctccagcaccatgtctggtttgtctggcccaccagcccggcgcggcccttttccgttagcgttgctgcttttgttcctgctcggccccagattggtccttgccatctccttccatctcgactcggaccgatg

SEQ ID NO: 413 - DNA, 203 bp, Homo sapiens
ggcgcgccagtcctacagaacgggagcaacctcggcgcaaacactcccgccggagcctgcaccggtcaggcagtggcagtgaccacaaggaggagaaagccagcctgtcccttgagacctctgagagctcacaggaggcaaagagtccgaaggtggagctgcacagccactcagaggtccctttccagcgactcggaccgatg

SEQ ID NO: 414 - DNA, 203 bp, Homo sapiens
ggcgcgccagtcctcgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggcccgactcggaccgatg

SEQ ID NO: 415 - DNA, 203 bp, Homo sapiens
ggcgcgccagtcctgacatttcttaacagcagggccaccaggcagagcgggacagccaggaggaagggcagcttggcagagcctcaggatggacccccttggggacacgctgcggcgactgcgggaggccttccacgcggggcgcacgcggccagctgagttccgggctgcgcagctccaaggcctggcgactcggaccgatg

SEQ ID NO: 416 - DNA, 203 bp, Homo sapiens
ggcgcgccagtcctagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcacgactcggaccgatg

SEQ ID NO: 417 - DNA, 203 bp, Homo sapiens
ggcgcgccagtcctcttcctctttccctcggagcgggcggcggcgttggcggcttgtgcagcaatggccaagatcaaggctcgagatcttcgcgggaagaagaaggaggagctgctgaaacagctggacgacctgaaggtggagctgtcccagctgcgcgtcgccaaagtgacaggcggtgcggcctccgactcggaccgatg

SEQ ID NO: 418 - DNA, 203 bp, Homo sapiens
ggcgcgccagtcctggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggcgactcggaccgatg

SEQ ID NO: 419 - DNA, 203 bp, Homo sapiens
ggcgcgccagtcctcacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctacccgactcggaccgatg

SEQ ID NO: 420 - DNA, 203 bp, Homo sapiens
ggcgcgccagtcctgtgactgggtggggctgcctcacttctgcctgatttgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccgactcggaccgatg

SEQ ID NO: 421 - DNA, 203 bp, Homo sapiens
ggcgcgccagtcctccgctgttatacgtcacttccacggctcagcgtcagggaggagagagaatgtcttttcgaggcggaggtcgtggaggctttaatcgaggtggtggaggtggcggcttcaaccgaggtggcagcagcaaccacttccgaggtggaggcggcggtggaggcggcggcaatttcagacgactcggaccgatg

SEQ ID NO: 422 - DNA, 203 bp, Homo sapiens
ggcgcgccagtcctgcttgggtaggggccaggctagcctgagtgcacccagatgcgcttctgtcagctctccctagtgcttcaaccactgctctccctgctctactttttttgctccagctcagggatgggggtgggcagggaaatcctgccaccctcacttctccccttcccatctccaggggggcccgactcggaccgatg

SEQ ID NO: 423 - DNA, 203 bp, Homo sapiens
ggcgcgccagtccttcgacgggcgtggcgggggaggggacgctgagggcccatgtgctgaaaatccgaagtgccgcggaaagtggaggtgagggccgcccgccctagaggtgcccgtccgagaggcagagctgacaaggaaggtttcgagcgttttgctggcaaagggatttcttacaacctccaggccgactcggaccgatg

SEQ ID NO: 424 - DNA, 203 bp, Homo sapiens
ggcgcgccagtcctagaaagtcgacgggcgtggcgggggaggggacgctgagggcccatgtgctgaaaatccgaagtgccgcggaaagtggagagctgacaaggaaggtttcgagcgttttgctggcaaagggatttcttacaacctccaggcatgcgtctttctgccctgctggccttggcatccaacgactcggaccgatg

SEQ ID NO: 425 - DNA, 203 bp, Homo sapiens
ggcgcgccagtcctagaactgagctcatctttgcggggttagctagccgttgagtccaagtctccttggcaagacagtagcttagagaaacgagatcgaatgcacccggaaggtggccaatttgtgcctcaactccttggccatctcctggctaccaaactcaagcgtttcctccttagcaaaggcggcgactcggaccgatg

SEQ ID NO: 426 - DNA, 203 bp, Homo sapiens
ggcgcgccagtcctcgcggaggtgattccacactgaggcgagcgcggcggccggggtggtagtggcagtgttcgtgtgctcaggtctgaatcgccgagggaggaggcggtggaggaagaggtggcggcggtggcggtggtcgtagcggtggcggaggaggcgggtacgaatcagctgcgggcggagaccgactcggaccgatg

SEQ ID NO: 427 - DNA, 203 bp, Homo sapiens
ggcgcgccagtcctcgccggcctgcagtctagccgtagtgcgcctgcgcgcggctaggaggggccgtcaggcggggatacagcctggaaggtaatgcatgtccatggtacacaaattcacaagtttggagaccctgacacacccaccttctcacctgggctctgcgtatcccccagccttgagggaagcgactcggaccgatg

SEQ ID NO: 428 - DNA, 203 bp, Homo sapiens
ggcgcgccagtccttgaaatccggttctaacgggtccggggctcccagcgctataaaaactttataaaccccccggagcccgagcagtgtgaagaagaggcgagaacgaccccgggaccgaccaaagcccgcgcgccgctgcatcccgcgtccagcacctacgtcccgctgccgtcgccgccgccacccgactcggaccgatg

SEQ ID NO: 429 - DNA, 203 bp, Homo sapiens
ggcgcgccagtcctgatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtgcgactcggaccgatg

SEQ ID NO: 430 - DNA, 203 bp, Homo sapiens
ggcgcgccagtcctcccgcagtctcatttgccgcttccgacgcgtgaccccggcgcgctagcgtccgggaccggtgacaggcgcggggtgcgccaagcagtcccatgtgtcccctccctctcgcagccgccgcagtcgctgcgccccgagcccctctccggctcctcaacagagggctcgccgccgcccgactcggaccgatg

SEQ ID NO: 431 - DNA, 203 bp, Homo sapiens
ggcgcgccagtcctgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgagcgactcggaccgatg

SEQ ID NO: 432 - DNA, 203 bp, Homo sapiens
ggcgcgccagtcctcggggcggtgcgctgggctgcacctccctccccgcgccccgtcctctcccgccctacaggccctagcagggcaggcgggaggtgagcgcggccatcccgctcccggagttccgggatcctggagtccgtagttcgtggtccttcgccggtgtccccggagcccagcggctgtggcgactcggaccgatg

SEQ ID NO: 433 - DNA, 203 bp, Homo sapiens
ggcgcgccagtcctctggccacgccctctccgcgagtccagtcccacgcgggatgaagagggcaccctccgccaagaggctgctgcgggacccgggtttcccctttccggcgccttccagcctcccaatcctcgggtctcgcctccctccgtctcctccctttcccctgtctgtctttccattggtcccgactcggaccgatg

SEQ ID NO: 434 - DNA, 203 bp, Homo sapiens
ggcgcgccagtcctccgggccagcccgcgtgcctgcgcagtcccctccccgagaaccatccccttgccccgcccagcgtcaggggtgcgcggccgccgagagaccccggaggcgtagccggctgcggaggcgaagaggtggcagcgcgagctgggaccagcgtctcggaggcgccgcagaattcacagcgactcggaccgatg

SEQ ID NO: 435 - DNA, 203 bp, Homo sapiens
ggcgcgccagtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgcccgactcggaccgatg

SEQ ID NO: 436 - DNA, 203 bp, Homo sapiens
ggcgcgccagtcctgcacgcgcaaacctcctgtgatgcctgcgcctcctggccccgccttccgctcgtgggagttccggatgtttagcgttaccatggatcctggaggtgcccgcgaacactgcttgtcgcctgggcaaccggagaggacgaagcaggacctaggtggcggcggtggtaccggctgcacgactcggaccgatg

SEQ ID NO: 437 - DNA, 203 bp, Homo sapiens
ggcgcgccagtcctttcgcttgggtagaggaagccgtgaggccggagcttaggtcgggaagggatggatcgctgagccgatagcgtccgctaggctgtctgcctcggtacctgttactgctgctacttcctcgtttgacaccttcctggaatctctcttgatttttgaggaaatacctagtaacaaaccgactcggaccgatg

SEQ ID NO: 438 - DNA, 203 bp, Homo sapiens
ggcgcgccagtcctttggtccaagcaagaaggcagtggtctactccatcggcaacatgctggtcctttatggacacagcacccaggaccttccggaaaccaatgcccgcgtagtcggagggactgaggccgggaggaattcctggccctctcagatttccctccagtaccggtctggaggttcccggtcgactcggaccgatg

SEQ ID NO: 439 - DNA, 203 bp, Homo sapiens
ggcgcgccagtcctcagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagcgactcggaccgatg

SEQ ID NO: 440 - DNA, 203 bp, Homo sapiens
ggcgcgccagtcctgtaagcgctgcggagattgggctagaggcggaggcctgggccacggcggaggcgctgggtccttctggcactcctctggtggaccgcccccatcggccacacttgccctgctctccagtgattctgtagctcctggctccgtagtctcgcggacagctctctttcctggaagatcgactcggaccgatg

SEQ ID NO: 441 - DNA, 203 bp, Homo sapiens
ggcgcgccagtcctgcaatgctaggcgatggggaatccgaagacgcacaggagtccaagggttggctgactgcagaccctcatcataagtctagagccggagaagatggggagacgccggcctgcgccctttcgtgccctcgtgaggctggcatgcaggatggcaggacagcccggccacatgccccacgactcggaccgatg

SEQ ID NO: 442 - DNA, 203 bp, Homo sapiens
ggcgcgccagtcctatagagtagcggaagtggtccgttctcttcctctcccggcccaagcttctgggtatttctattgcgcgaggcattgtgggttgctgggcggcccggtctcggagaagaggggagagtggcgggccgctgaataagcttccaaaatgatgcccacaccagttatcctattgaaagcgactcggaccgatg

SEQ ID NO: 443 - DNA, 203 bp, Homo sapiens
ggcgcgccagtcctggcgcttccgcaggaagaaggaagcggcgccgccatcgcctcccggcgctccctccccgactcctaagtccttcggccgccaccatgtccgcctcggctgtcttcattctggacgttaagggcaagccattgatcagccgcaactacaagggcgatgtggccatgagcaagattcgactcggaccgatg

SEQ ID NO: 444 - DNA, 203 bp, Homo sapiens
ggcgcgccagtcctagtacagcagttgagagtaaggcctctggagctacactgaatgcctagcccacaccagttatcctattgaaagaggggactgatagctcccaaggcatcccccagcttgtgagtaacatcagtgcctgccaggtgattgctgaggctgtaagaactaccctgggtccccgtggccgactcggaccgatg

SEQ ID NO: 445 - DNA, 203 bp, Homo sapiens
ggcgcgccagtcctggggagggccgcgcagtgggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattcgactcggaccgatg

SEQ ID NO: 446 - DNA, 203 bp, Homo sapiens
ggcgcgccagtccttttcctgcgcggccgagcctgtcgccgccggatccggcctgcgggggtagttacggtgtttgctaggccggccgccctcttggagcttctgccctccgctgaggaagcggcgccgcctgacgcgggacggtcgggcgggcgccatgttgtgaaccgcctcggcggagctgtaagcgactcggaccgatg

SEQ ID NO: 447 - DNA, 203 bp, Homo sapiens
ggcgcgccagtcctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatcgactcggaccgatg

SEQ ID NO: 448 - DNA, 203 bp, Homo sapiens
ggcgcgccagtcctataaggccctctcctccaccctgccaggctcactctgccccacagccacagcccctgactgccgcagcccccacagagcccgccgcgcaccccacgtcccccacgccagcgcccagccatggaggccatcaagaagaaaatgcagatgctgaagttggacaaggagaatgccatcgactcggaccgatg

SEQ ID NO: 449 - DNA, 203 bp, Homo sapiens
ggcgcgccagtcctattatgcattttccacatagggaaactgaggctcaggggtgttaagtgactcacccaaggtcacacggctaggaagttgctgcacgctcctatgctccatttcctctgggagcctatcaacccagataaagcgggacctcctctctggtagaggtgcagggggcagtactcaaccgactcggaccgatg

SEQ ID NO: 450 - DNA, 203 bp, Homo sapiens
ggcgcgccagtcctgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactggggaccgactcggaccgatg

SEQ ID NO: 451 - DNA, 203 bp, Homo sapiens
ggcgcgccagtccttcacacctgccaagcatcacacctgcgatgcctgcacgagctgggtggggtccgcgcagctgcagtaagggggcgacccggcgtctgttagtcggcggttcatctccttcgtgcctcgatgagctttaacgccattttcctccattctctttcttcacctcttgagtttccaagcgactcggaccgatg

SEQ ID NO: 452 - DNA, 203 bp, Homo sapiens
ggcgcgccagtcctagtctggctgcggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgactcggaccgatg

SEQ ID NO: 453 - DNA, 203 bp, Homo sapiens
ggcgcgccagtcctcgcggccgactggaggcccggagcaggggcggagtttccggcggcagcgccactcgggcgtcgggtgacgctaggcggacggaccatcatgtgacacggaagtagctccgaacaggaagaggacgaaaaaaataaccgtccgcgacgccgagacaaaccggacccgcaaccacccgactcggaccgatg

SEQ ID NO: 454 - DNA, 203 bp, Homo sapiens
ggcgcgccagtcctattgcggaagtttctctacccatgcggtgtctctatggtcgggtgggtggggccaggaggaagatggcggcgtccgcagctgccgctgagctccaggcttctgggggtccgcggcacccagtgtgtctgttggtgttgggaatggcgggatccgggaaaaccacttttgtacagcgactcggaccgatg

SEQ ID NO: 455 - DNA, 203 bp, Homo sapiens
ggcgcgccagtcctgtcctccagtggctccgctccccgttctctgtgggctcaaaatgacagaggctcacaggacacctgcatgcccaaggcactccaccgtatgtgatcaacctggatccagcagtacatgaagttccctttcctgccaatattgatattcgtgatactgtaaagtataaagaagtacgactcggaccgatg

SEQ ID NO: 456 - DNA, 203 bp, Homo sapiens
ggcgcgccagtcctgattatttttctcctcttccttttttaatctatcctcttttcaccacattttagtgagaaagcaattttttttttacaaatggagcttatattgatttttatttcataaataattgaaagagggtagaaaaatctgcccttcatttaaaaattgaatgtttcactatgtatttacgactcggaccgatg

SEQ ID NO: 457 - DNA, 203 bp, Homo sapiens
ggcgcgccagtcctgcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctccgactcggaccgatg

SEQ ID NO: 458 - DNA, 203 bp, Homo sapiens
ggcgcgccagtcctcgcagaagaaccacaaaccccagaagccctcgcgcccactcttctccctcccctccagaagtcggagtgctgtttttgttgttggtgaaaggtgaggggaacagctgatccgtctgttgggaggacagatatctcaaggccaggatggaagaatcaccactaagccgggcaccacgactcggaccgatg

SEQ ID NO: 459 - DNA, 203 bp, Homo sapiens
ggcgcgccagtccttcaggccaaatcgcaactcagacccagtgaacccaaggcctgaagagaatttggattcatttaccttgttttgtggggactggagagacaagtaaactctcagagtaactgtcccctctgactaccatttctaaggatgccccggaggcccagctagccccagacttcggcccccgactcggaccgatg

SEQ ID NO: 460 - DNA, 203 bp, Homo sapiens
ggcgcgccagtccttccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctcgcgcgcccacgtctgaagagcgcgactcggaccgatg

SEQ ID NO: 461 - DNA, 203 bp, Homo sapiens
ggcgcgccagtcctggattcatttaccttgttttgtggggactggagagacaagtaaactctcagagtaactgtcccctctgactaccatttctaaggcaagccccctgtttctactcttgcgccccctgctggtttcctgccctgtctgatgccccggaggcccagctagccccagacttcggcccccgactcggaccgatg

SEQ ID NO: 462 - DNA, 203 bp, Homo sapiens
ggcgcgccagtccttccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggttcatatttggtgcttagacaaattcaaacgactcggaccgatg

SEQ ID NO: 463 - DNA, 203 bp, Homo sapiens
ggcgcgccagtcctaaggtttaaagggcgcctccatggggggcgctcagctggagctaccgagcggtgccaggccaggtgtgtgcgtccgtcggtctttccgtgcccacgccggagaccagccccggaggccgcctgggcctatccctgtgccaggcaccatgaagcaggagtctgcagccccgaacacgactcggaccgatg

SEQ ID NO: 464 - DNA, 203 bp, Homo sapiens
ggcgcgccagtcctacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatgcgactcggaccgatg

SEQ ID NO: 465 - DNA, 203 bp, Homo sapiens
ggcgcgccagtcctcggcgaccgcgggctgacgtggcggggctggcgtgtgggtctcgcagcgttgctcacagaacagagtagaggcggcggcggcggcggccggacccagactggtagtgaggctttggaccccgagccgctgcaatgccgctggagctggagctgtgtcccgggcgctgggtgggccgactcggaccgatg

SEQ ID NO: 466 - DNA, 203 bp, Homo sapiens
ggcgcgccagtcctccgcggtggttacaaagggggtcaagagtgccggacccagccgcgcggagcccaccattgcggcccgagggggacccgacgggggcccgacggtgtggcgtggcgcaaggagcgcgcctgccttctctcgccgccgggaacgggctgcaccaatggccagattccagcaagattcgactcggaccgatg

SEQ ID NO: 467 - DNA, 203 bp, Homo sapiens
ggcgcgccagtcctgcgacgtcacgctcggctataaaaggcgcggctcggggcccttgcggcgctggaggagctcgaggctgaggctgccggggggctgtgggctaccgggccgccggcgcctcagcgatgttttactcagggctcctcactgagggcggccgcaaggagaccgacatgcgggaggcgcgactcggaccgatg

SEQ ID NO: 468 - DNA, 203 bp, Homo sapiens
ggcgcgccagtcctgccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcacgactcggaccgatg

SEQ ID NO: 469 - DNA, 203 bp, Homo sapiens
ggcgcgccagtcctggacccggatgcaagcgtgctatataagcgttgctcaagtcccacccctttctttttgaggaagacgcggtcgtaagggctgaggatttttggtccgcacgctcctgctcctgactcaccgctgttcgctctcgccgaggaacaagtcggtcaggaagcccgcgcgcaacagcccgactcggaccgatg

SEQ ID NO: 470 - DNA, 203 bp, Homo sapiens
ggcgcgccagtcctatcgtcgtgatccacctccccaggaccttggagccacgtttacaaataggaatagggtacgtgggagggatagaacgtacagccaataaaatcatgtggcgccgatgggcgtgttgaggccgctgcctggcttagggcggaaacagattctctgcataagaaggggaacgaaagcgactcggaccgatg

SEQ ID NO: 471 - DNA, 203 bp, Homo sapiens
ggcgcgccagtcctccacctctggacagtcccactcagccccttcttcactctctgggcctcccaaaagacagtcagccttgtcctcaggcccgcacccagttgtcagcctctgactcctctcccctcaaaggattcttaccttggctcctcctcttagccctaacctgcctcctttgcctgtgagtccgactcggaccgatg

SEQ ID NO: 472 - DNA, 203 bp, Homo sapiens
ggcgcgccagtcctaaagcaggatgccctcccagttcctcctgcctctaggttcctctttccctgctgattccaggagcctatcaacccagataaagcgggacctcctctctggtagaggtgcagggggcagtactcaacatgatcacagagggagcgcaggcccctcgattgttgctgccgccgctgcgactcggaccgatg

SEQ ID NO: 473 - DNA, 203 bp, Homo sapiens
ggcgcgccagtcctcgcatgcgctggcggcctgcgccgccttaagtgccgcgccagcccggggcggcccagtcggcctgtcagccggcttcgagataagtcccggcgcttgcgcggcggcggctatggcggcggaggaggaggaggtggactctgccgacaccggagagaggtcaggatggctaactgcgactcggaccgatg

SEQ ID NO: 474 - DNA, 203 bp, Homo sapiens
ggcgcgccagtcctcccggcgtccctgcccctgggcggggacaggcggcggccaagcggggagtcgaggcggcgagcgcgcagctggcctagtctgcggtccccaactcctggagtcccctgggagctgccgctgcaggcccccgagccgctaggccccgccgccaggccaccgctgctgcggcagcccgactcggaccgatg

SEQ ID NO: 475 - DNA, 203 bp, Homo sapiens
ggcgcgccagtcctgttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggccccgactcggaccgatg

SEQ ID NO: 476 - DNA, 203 bp, Homo sapiens
ggcgcgccagtcctgagaaggaaagaacggccgctatagccctatcggctgctacaacaccaaaacgcatccacctaactggctgacgctacaccttggtctttccgggtccttgcacgcttcgctccaactcctgcagagctgagccggaggggaatccggaagggacacgctgaacaggaacagaacgactcggaccgatg

SEQ ID NO: 477 - DNA, 203 bp, Homo sapiens
ggcgcgccagtccttccggccacggtgatgacgagtctccgtcaacctcgtctggcacagctgggacctcctctgtgccagagctacctgggttttactttgaccctgaaaagaaacgctacttccgcttgctccctggacataacaactgcaaccccctgacgaaagagagcatccggcagaaggagcgactcggaccgatg

SEQ ID NO: 478 - DNA, 203 bp, Homo sapiens
ggcgcgccagtccttcgcctaacctcgcgcccgggccgcgcctcctcctcctcctgctccccgccgcttccgtttctcgagggaaaggctgctgcctcctgctctgtcctcatccccggcttagctgacggcccagagggtgggtgccaattccaccagcagctgcaactgaaaagcaaggttcagaacgactcggaccgatg

SEQ ID NO: 479 - DNA, 203 bp, Homo sapiens
ggcgcgccagtcctcagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaacgactcggaccgatg

SEQ ID NO: 480 - DNA, 203 bp, Homo sapiens
ggcgcgccagtcctccccacgcgctgtgaccccatttgttgcacgtgcatgttcaggtcgagagagggatgcgacgtgttcggggagcagcccaccttgtgggtggccaatccgggacgggaatcttaaacttttaactcttggtgcaaagactgatccactggcggctttacgggagcgggaaaaaacgactcggaccgatg

SEQ ID NO: 481 - DNA, 203 bp, Homo sapiens
ggcgcgccagtcctagtcggagccgggcttgcccgggcatgtgggagctgccggctttccggacgccacgtgcagaccggaagagacacgcggggcttcaggctgctgccccattggaagattactccccaggcttcccttgccccaagcagtgagctgactggaatggtaccccgggaggcccctgacgactcggaccgatg

SEQ ID NO: 482 - DNA, 203 bp, Homo sapiens
ggcgcgccagtcctgtcgtcgggctcgttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatggcgctcccgacgctgccgcgactcggaccgatg

SEQ ID NO: 483 - DNA, 203 bp, Homo sapiens
ggcgcgccagtcctctgtgcccgctgtgcctgctgtgcccgcgctgtcgccgctgctaccgcgtctgctggacgcgggagacgccagcgagctggtgattggagccctgcggagagctcaagcgcccagctctgcccgaggagcccaggctgccccgtgagtcccatagttgctgcaggagtggagcccgactcggaccgatg

SEQ ID NO: 484 - DNA, 203 bp, Homo sapiens
ggcgcgccagtcctgagccccacctccctcctcttcgcccccgcacgccgaaaacaggggcctctcacgtgacccctgcgcgctcccgcgggggagcgtagtctcggaggcggcgccgcaggggattgaggggttgactgagcgttgcgagccttagctttctcccgaacgccagcgctgaggacacgcgactcggaccgatg

SEQ ID NO: 485 - DNA, 203 bp, Homo sapiens
ggcgcgccagtcctcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagacccgactcggaccgatg

SEQ ID NO: 486 - DNA, 203 bp, Homo sapiens
ggcgcgccagtcctctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttcgactcggaccgatg

SEQ ID NO: 487 - DNA, 203 bp, Homo sapiens
ggcgcgccagtcctggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcgactcggaccgatg

SEQ ID NO: 488 - DNA, 203 bp, Homo sapiens
ggcgcgccagtcctggcgtcgcgggggcggggctcgggaaagacccgtgccagcgggcgtgtggccgcgggtttcgcacggtccaataagggagggcggcgtggcccggcctggtagcgacgaggacgcgcctgcgcagaggcggcagcaccaccggggttgactccgggggcgcggcgaggagagaccgactcggaccgatg

SEQ ID NO: 489 - DNA, 203 bp, Homo sapiens
ggcgcgccagtcctgggtgagcaaaggggcgggtccctggctgctgtggcctcccctgaccccctccccccgctgctggggtcctcggccaagcccccttctcactggactgagacatgaggctgagctggttccgggtcctgacagtactgtccatctgcctgagcgccgtggccacggccacggggcgactcggaccgatg

SEQ ID NO: 490 - DNA, 203 bp, Homo sapiens
ggcgcgccagtcctgtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcacgactcggaccgatg

SEQ ID NO: 491 - DNA, 203 bp, Homo sapiens
ggcgcgccagtcctggccttgttctccagctgagaggacgatcgtccttataggagaggccgagtctccgagggcaatttcagaggtctggtgcgagggaagcagagactttcaaggaacaaggaaatgcatactatgccaagaaagattacaatgaagcttataattattatacaaaagccatagatcgactcggaccgatg

SEQ ID NO: 492 - DNA, 203 bp, Homo sapiens
ggcgcgccagtcctaccccgggggcggggcttccggcgcgctgccttgtgggcacggtagttccgccgggtctggcttccgcctgccgagcggcccgggaccgcaggccggactacacttcccgtcggcccgcctgctctcccgatgccgccttggcgcgagacgttggcaagcagagtgtctccaagcgactcggaccgatg

SEQ ID NO: 493 - DNA, 203 bp, Homo sapiens
ggcgcgccagtcctacgtgagggggcgaggggcgggatgcccctccgcgggccccgccaatgatgagctggattgcgtgggacgaagggtcgtcattggacaaccgccgcgggcgccctggtctctgctacctgtagctgagggcgctgttgatgggcagcgcggcgcgctgggaaggctcgttctcgcgactcggaccgatg

SEQ ID NO: 494 - DNA, 203 bp, Homo sapiens
ggcgcgccagtcctgtcattttccctctactgctggaaaagaaggctcaagaggaagaatccaggttttgaggttttgctgaagatattcctgaagaatcatcccaggtgccacactaaaaaaatgatccagttgacagctacccctgtgagtgcacttgttgatgagccagtgcatatccgagctaccgactcggaccgatg

SEQ ID NO: 495 - DNA, 203 bp, Homo sapiens
ggcgcgccagtccttgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgcgactcggaccgatg

SEQ ID NO: 496 - DNA, 203 bp, Homo sapiens
ggcgcgccagtcctgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgcgactcggaccgatg

SEQ ID NO: 497 - DNA, 203 bp, Homo sapiens
ggcgcgccagtcctcgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatacgactcggaccgatg

SEQ ID NO: 498 - DNA, 203 bp, Homo sapiens
ggcgcgccagtcctagggacgggaagtgggcggggccggccggcagcagcttgcgggacacggagccgcgaggagacagctgaggcccgcggagaccagggggtgaagcctggagaccctcttgccctggcctagctgcaggcccccgggatgctttgggcatgtcctctggagccccacagaagagccgactcggaccgatg

SEQ ID NO: 499 - DNA, 203 bp, Homo sapiens
ggcgcgccagtcctggagatctgatcctgattgcagaaccttccctgattacagaatcttgggttgtatctcccacttcacccttctagaccatcccagaagatctataagatttcatctgggaaatcactaggagttcttggaagggaaagaaggaagattgttggttggaataaaaacagggttgacgactcggaccgatg

SEQ ID NO: 500 - DNA, 203 bp, Homo sapiens
ggcgcgccagtcctgatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctcgactcggaccgatg

SEQ ID NO: 501 - DNA, 203 bp, Homo sapiens
ggcgcgccagtcctttttgtctgccccttcctgcctgtgggaaggagagaaaattaggggaggccacgggcttgaaagctttccctgcatggaggccactggatgggattctagatgctcgcctgggacccaggttcgtgccctcgtgaggctggcatgcaggatggcaggacagcccggccacatgccgactcggaccgatg

SEQ ID NO: 502 - DNA, 203 bp, Homo sapiens
ggcgcgccagtcctggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccacccgactcggaccgatg

SEQ ID NO: 503 - DNA, 203 bp, Homo sapiens
ggcgcgccagtcctcttcagggctgggggccgcgctatgccccgccccctccccagccccagacacggaccccgcaggccaactggctccctgcccctgcccccgccccttgacatcccagactccctggctatttaaacagagatgggtgcccccatccgcacactgtcctttggccaccggacatccgactcggaccgatg

SEQ ID NO: 504 - DNA, 203 bp, Homo sapiens
ggcgcgccagtcctggaggcccaggcacctcatgtctgccctcaacccagagtggagcagaccttccctggagcttctcaggagccacttcaaaaggagaagaagacacatgaattagagacagcacgggggagcaggctgtggagctgggagtgacggggtgagtccaggaaggctgcctggaggagcgactcggaccgatg

SEQ ID NO: 505 - DNA, 203 bp, Homo sapiens
ggcgcgccagtcctcgccgggtgactgacgttgaggcccaaccagggagaggcggggccaaggccagggcctgactaaacctggagactcgggtggccgaggggcttcataccagctgaagagcgacaagccgctggcagccgcggatctcaccgccgctcagggtttttagaacttcagccataaaacgactcggaccgatg

SEQ ID NO: 506 - DNA, 203 bp, Homo sapiens
ggcgcgccagtccttccatttcctgttttgtatgtatatcgattccgctcctcttctttccgccagtttttgtagagacagcatcttgttgcccaggctggtctcgaactctggggctgaagtgattctccctcttcagcctcccagagttctgggattataggcacgagccaccatgcccagccttacgactcggaccgatg

SEQ ID NO: 507 - DNA, 203 bp, Homo sapiens
ggcgcgccagtcctacgccccgcctcttccgcttctgtggtctgatcttcctgcggctgaaccgcccggctgagccgacattgccggcgtcttggcgattcggcccgacgagctccgctttcgctacagcatggtggcctactggagacaggctggactcagctacatccgatactcccagatctgtgcgactcggaccgatg

SEQ ID NO: 508 - DNA, 203 bp, Homo sapiens
ggcgcgccagtcctactcggcttccgtccattcttccggtggagatggctgcggccgtggcggggatgctgcgagggggtctcctgccccaggcgggccggctgcctaccctccagactgtccgctatggctccaaggctgttacccgccaccgtcgtgtgatgcactttcagcggcagaagctgatgcgactcggaccgatg

SEQ ID NO: 509 - DNA, 203 bp, Homo sapiens
ggcgcgccagtcctctgactgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgcgactcggaccgatg

SEQ ID NO: 510 - DNA, 203 bp, Homo sapiens
ggcgcgccagtcctcggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggttagcaagatgaacaaagatgcgactcggaccgatg

SEQ ID NO: 511 - DNA, 203 bp, Homo sapiens
ggcgcgccagtcctagctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagccgactcggaccgatg

SEQ ID NO: 512 - DNA, 203 bp, Homo sapiens
ggcgcgccagtcctgacttctccagacaggttatgttacctgcagaggctgccctgaagctccctgtggcctggagactatgtacaagaggaatggtctgatggctagcgtgttggtcacctctgccactccacagggcagcagcagctcggactctctggagggccagagctgcgactatgccagcacgactcggaccgatg

SEQ ID NO: 513 - DNA, 203 bp, Homo sapiens
ggcgcgccagtcctgagaggaagcgcacctgagggagcacagcgaaggccgggacgcagggagctggatggagagcgagcctgggcggcgaaaggttgccgaggcgggggctgggcgcctgggaacaaaggaaagcaatagaagaactgcttaaggaggcaaaacgtgggaaaactagagctgaaacacgactcggaccgatg

SEQ ID NO: 514 - DNA, 203 bp, Homo sapiens
ggcgcgccagtcctcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggcgactcggaccgatg

SEQ ID NO: 515 - DNA, 203 bp, Homo sapiens
ggcgcgccagtcctgccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtggcttgtgagaaggttggccgactcggaccgatg

SEQ ID NO: 516 - DNA, 203 bp, Homo sapiens
ggcgcgccagtcctcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgaccgcgcgactcggaccgatg

SEQ ID NO: 517 - DNA, 203 bp, Homo sapiens
ggcgcgccagtcctgggatgtgtgtgccagccctcggtccagtgcccgctcctgagctgactcctgctgggccccgacagcttgccgtgtttcctgtgcctgtagctccctggttggatagctgccgcccgggagaggtgacccgggcgccctgctagggtgaaggcccctgccctcggcccgggatccgactcggaccgatg

SEQ ID NO: 518 - DNA, 203 bp, Homo sapiens
ggcgcgccagtcctgggtgccggtggagtcgtgttggtcctcagaatccccgcgtagccgctgcctcctcctaccctcgccatgtttcttacccggtctgagtacgacagcttggttctacagccattgggatccagacatcagagggtgtgtgcctagctgtggagaagagaattacttccccactgcgactcggaccgatg

SEQ ID NO: 519 - DNA, 203 bp, Homo sapiens
ggcgcgccagtcctctgcggccgtgtgggtgagttggctgccggggcgtgaatactttttctcccgaaggaagattatttcaagtggaatatgccattgaggctatcaagcttggttctacagccattgggatccagacatcagagggtgtgtgcctagctgtggagaagagaattacttccccactgcgactcggaccgatg

SEQ ID NO: 520 - DNA, 203 bp, Homo sapiens
ggcgcgccagtcctagaaaggggcgggaggggtactgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccccgactcggaccgatg

SEQ ID NO: 521 - DNA, 203 bp, Homo sapiens
ggcgcgccagtcctagttggtccttagtactgcggccgtgtgggggcgtgaatactttttctcccgaaggaagattatttcaagtggaatatgccattgaggctatcaagcttggttctacagccattgggatccagacatcagagggtgtgtgcctagctgtggagaagagaattacttccccactgcgactcggaccgatg

SEQ ID NO: 522 - DNA, 203 bp, Homo sapiens
ggcgcgccagtcctaccagctctgagtcccaccccgaggccgcccccaaaaggaaactgtcatcgataggaatacaagttgactgcattcagccagtgccaaaagaggagcccagtcccgctaccaaattccagtccatcggggttcaggtagaggacgactggcgaagcagcgtcccctctcacagtcgactcggaccgatg

SEQ ID NO: 523 - DNA, 203 bp, Homo sapiens
ggcgcgccagtcctaggaagggcgggtcagcgcgccggcgcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaacgactcggaccgatg

SEQ ID NO: 524 - DNA, 203 bp, Homo sapiens
ggcgcgccagtcctacctttcagggagatttgagagaaagactccagaagcccgcggggagagcaggggttctggggaagataaagcccttcatccaggatccctctgtgaccataagatgagatggaccaaacgcccccggcgcgtcctgaatatctggtctcagggattcgaactccccctgtgagcgactcggaccgatg

SEQ ID NO: 525 - DNA, 203 bp, Homo sapiens
ggcgcgccagtcctaaaatccaccccaacaatcgctgtgtgccgctttagtgcgctcgccgtcggctctacctgcgtgctttagctccttctcgcctgatccttctgtctctcccaaccccggacacccggcttcgactggttatatcttcggtgttcttttcctctcttcttctttcgcggttcagccgactcggaccgatg

SEQ ID NO: 526 - DNA, 203 bp, Homo sapiens
ggcgcgccagtcctgaggtgggactgggcgggtcaggccgcagcggctgacggcaggggaggagccgggtccactgccgggtggaggggcaaggcgagtgtgtgtccttatcctagcaattggggcgcgggcctgtgagccagttggagttgcggcggcgggaacgattgggctgagcagaggacgaccgactcggaccgatg

SEQ ID NO: 527 - DNA, 203 bp, Homo sapiens
ggcgcgccagtcctcagcagggaggcgagcagagggcccccagagggagccgcggaggtgcaggtcgaagaggccgggctacgtcgtgccctgcgcgtgagcagctgcagaggcagaggcagcatccagcggcggcgccagcagttccagtccgttgctttactttttgcttcaccgacatagtcattcgactcggaccgatg

SEQ ID NO: 528 - DNA, 203 bp, Homo sapiens
ggcgcgccagtcctatagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtcgactcggaccgatg

SEQ ID NO: 529 - DNA, 203 bp, Homo sapiens
ggcgcgccagtcctgccttccgctccgccccttcaggcaggaagtgtcggcgccgccactgtccggccacagcctaacgctcttcgctgtcgtttgtggtctcgcgcagggcggccccggttctggtgtttggcgtcggaattaaacaaccaccatgtcgagcaaaaaggcaaagaccaagaccaccacgactcggaccgatg

SEQ ID NO: 530 - DNA, 203 bp, Homo sapiens
ggcgcgccagtcctggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatcccgactcggaccgatg

SEQ ID NO: 531 - DNA, 203 bp, Homo sapiens
ggcgcgccagtccttggatgtttccaaggattgtcttcagtcatggccttgggattaaagtgcttccgcatggtccaccctacctttcgcaattatcttgcagcctctatcagacccgtttcagaagttacactgaagacagtgcatgaaagacaacatggccataggcaatacatggcctattcagccgactcggaccgatg

SEQ ID NO: 532 - DNA, 203 bp, Homo sapiens
ggcgcgccagtcctagccaattctgaccgtgtcaacgaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttcgactcggaccgatg

SEQ ID NO: 533 - DNA, 203 bp, Homo sapiens
ggcgcgccagtcctccaggtgacaatccccaattccttgggaaacctggacgcatccagctccagggacctgtccggcaagtggtgacatgcaccgtccagggagaaactctgctggccgtccgctctgactaccactgtgccgtgtggaagtttggtaaacagtggcagccaacccttctgcaggcacgactcggaccgatg

SEQ ID NO: 534 - DNA, 203 bp, Homo sapiens
ggcgcgccagtcctgtcacttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcgcgactcggaccgatg

SEQ ID NO: 535 - DNA, 203 bp, Homo sapiens
ggcgcgccagtcctcttcagtggcctcctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggattcagcacccgactcggaccgatg

SEQ ID NO: 536 - DNA, 203 bp, Homo sapiens
ggcgcgccagtcctgaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaaccgactcggaccgatg

SEQ ID NO: 537 - DNA, 203 bp, Homo sapiens
ggcgcgccagtccttgcgcagggggtagcagaggcgcggacaaaccgcggggtgaccagggcgcatgcgtaacagggcttgacagcgcgcggaagaaaaaccagcaagaaggcggcgggggaagatggcggtcctggggtagagtttgcaagctttctgactaggctagtcgagtaactattcgggtccgactcggaccgatg

SEQ ID NO: 538 - DNA, 203 bp, Homo sapiens
ggcgcgccagtcctctattgatgggcccaagcgtaaccaggctcttctgattggccggtgtacttcagtttccgtccaaggtccgcctcctacctccttctgcttcggtccttaggataagaccatggccttgagagcatgtggcttgatcatcttccgaagatgcctcattcccaaagtggacaacacgactcggaccgatg

SEQ ID NO: 539 - DNA, 203 bp, Homo sapiens
ggcgcgccagtcctctgggcttccgtcctccgcccgcgcccgacggagcctgttcgcgtcgactgcccagagtccgcgaatcctccgctccgagcccgtccggactcccccgatcccagctttctctcctttgaaaacactaagaataatgtcactgcatcagtttttactagagccaatcacctgtccgactcggaccgatg

SEQ ID NO: 540 - DNA, 203 bp, Homo sapiens
ggcgcgccagtcctacagggtataaaagctgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccacccgactcggaccgatg

SEQ ID NO: 541 - DNA, 203 bp, Homo sapiens
ggcgcgccagtccttggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagccgcgcgcccggcgtgccgagcggcaacgcgactcggaccgatg

SEQ ID NO: 542 - DNA, 203 bp, Homo sapiens
ggcgcgccagtcctggttggaattttggcgggttcagctgtgaacgaagaaggcgtcccggcatcggccaagattctacattgctcatctgggcatctgagcctccttcgaagtttcctgtcacaactgtcctcttgacagcatggatgaggaggaagacaatctgtctctgctgaccgcactgctggcgactcggaccgatg

SEQ ID NO: 543 - DNA, 203 bp, Homo sapiens
ggcgcgccagtcctagtcccgacgagcaacgcgtttgtagaggggtgggtgcgcacgctctgtccctgcgtgaccttccgaccccgctgtcctcaccgcaatggcggctgtgagggccctggtggcctcgaggctcgctgcggcatctgcattcacgtccctgtcccccggcggtcggacgccttccccgactcggaccgatg

SEQ ID NO: 544 - DNA, 203 bp, Homo sapiens
ggcgcgccagtccttgtggcaaaggaaggagctgactgggggagttcgaggcggcgggcggcggtgaccccggcctggaactgccccggtacggaagtgttccggggtccgtggggagcaggagagggaggcgggggaccgtcccgcgcggggcacgatgttgaacatgtggaagcaccaatgttgttcgactcggaccgatg

SEQ ID NO: 545 - DNA, 203 bp, Homo sapiens
ggcgcgccagtcctcgccctcccgccgcgcgctcgggatcccgaccagtcctgaccgcacgggggccgcggccacggggcgcaggggccatggtgcgcggcaggatctcccggctctgggtccgggacgtgcgcttccccacgtcgcttgggggccacggcgcggacgccatgcacacggaccctgaccgactcggaccgatg

SEQ ID NO: 546 - DNA, 203 bp, Homo sapiens
ggcgcgccagtccttaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatccgactcggaccgatg

SEQ ID NO: 547 - DNA, 203 bp, Homo sapiens
ggcgcgccagtcctgcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactcgactcggaccgatg

SEQ ID NO: 548 - DNA, 203 bp, Homo sapiens
ggcgcgccagtcctgagccgaaaggaaccggcgctttgtgacgtcacgtccgccttaccggcggattaagctcgctttcttctaggcgcgtttcctgaaggtcgatggccaggtggtcttcataaactatactgccttgtgatgcctccctagaaatgagaggtctcaataccagctcagaccatgtgcgactcggaccgatg

SEQ ID NO: 549 - DNA, 203 bp, Homo sapiens
ggcgcgccagtcctttccgcccgcgacccccttccagacccgctcccgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgcgactcggaccgatg

SEQ ID NO: 550 - DNA, 203 bp, Homo sapiens
ggcgcgccagtcctagcgccgccgccacctttccattcagtcgcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagccgactcggaccgatg

SEQ ID NO: 551 - DNA, 203 bp, Homo sapiens
ggcgcgccagtccttcccctctgggggcggcgatcctccctccggagccccccttcaaccctcccggaagtgagcatttgcaggaccagggatgctgtgctgctctcccatgagccagtcaccgagtcggtctgctgcagccctttctgaacctctggccgtctggatgctccactgtgcttgccaagcgactcggaccgatg

SEQ ID NO: 552 - DNA, 203 bp, Homo sapiens
ggcgcgccagtcctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 553 - DNA, 203 bp, Homo sapiens
ggcgcgccagtcctcacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtcgactcggaccgatg

SEQ ID NO: 554 - DNA, 203 bp, Homo sapiens
ggcgcgccagtccttcgcgccctttggcaagctcggactcatcttctggggattgccgcagtgacccagtaatgggaagggattgatttccaccttgcggggtatggggcgctcttaggaggactctggagaagtagttgtcctgggagaggagcgatcttaatcctgctgcatgacgggaggacaaacgactcggaccgatg

SEQ ID NO: 555 - DNA, 203 bp, Homo sapiens
ggcgcgccagtcctgcgcatgagcagtgctgctcccaacccgccagtcgcggtctccggcgccagctacgccgctgccgctgtcactatggcccattacaaagccgccgactcgaagcgtgagcagttccggaggtacttggagaagtcgggggtgctggacacgctgaccaaggtgttggtagccttcgactcggaccgatg

SEQ ID NO: 556 - DNA, 203 bp, Homo sapiens
ggcgcgccagtcctttgcgctccccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgccgactcggaccgatg

SEQ ID NO: 557 - DNA, 203 bp, Homo sapiens
ggcgcgccagtcctgttattggttggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaacgactcggaccgatg

SEQ ID NO: 558 - DNA, 203 bp, Homo sapiens
ggcgcgccagtcctgtcccttccctgggcaccaagagatgggctccccttgcctggcagagaaacagctggaaactggctccctgagacaagaagactggtaaacccagcgcttcctacctggtggtcttcagcaatgcccatgccttccagagacgggggcctgcatcccagacaccaccactatggcgactcggaccgatg

SEQ ID NO: 559 - DNA, 203 bp, Homo sapiens
ggcgcgccagtcctagccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagttacgactcggaccgatg

SEQ ID NO: 560 - DNA, 203 bp, Homo sapiens
ggcgcgccagtcctacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgcgactcggaccgatg

SEQ ID NO: 561 - DNA, 203 bp, Homo sapiens
ggcgcgccagtcctagagggcgagggcgagggcagagggcgctggcggcagcggccgcggaagatgagcagcagctgctcagggctgagcagggtcctggtggccgtggctacagccctggtgtctgcctcctccccctgcccccaggcctggggccccccaggggtccagtatgggcagccaggcagcgactcggaccgatg

SEQ ID NO: 562 - DNA, 203 bp, Homo sapiens
ggcgcgccagtcctgacgtcgcggtgacgtcacggagttgccatggcgtcgctgagcggcctggcgtcggcgctggagtcgtacaggggccgggaccgcctgatccgagtgctggggtactgctgccagctggttggtggagttctggttgaacagtgtcccgccaggtccgaagtggggacacgtctcgactcggaccgatg

SEQ ID NO: 563 - DNA, 203 bp, Homo sapiens
ggcgcgccagtcctgcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcccgactcggaccgatg

SEQ ID NO: 564 - DNA, 203 bp, Homo sapiens
ggcgcgccagtcctcggcctcgggacgccgtgacgttgcgttcctccagtcccttgccacctccctctttcttcccctctggggaagctcagtgctggacttccgaagaccttttacgacattgagtctcggagttggtctcagcgccggatccacttttcggcaaagtgacgtggacgtcaacagcacgactcggaccgatg

SEQ ID NO: 565 - DNA, 203 bp, Homo sapiens
ggcgcgccagtcctacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgacgactcggaccgatg

SEQ ID NO: 566 - DNA, 203 bp, Homo sapiens
ggcgcgccagtcctcagacttgggtttgaaatccacgtatgaccctggcccgttggcctctctgagcccggcttcctcctctacaaaatggagatcgcaaccgtccccacccgatagcgagagggcgcacacccgcattccaggctggacgggtctctgggcagcgggctcctccccgcccagggcgccgactcggaccgatg

SEQ ID NO: 567 - DNA, 203 bp, Homo sapiens
ggcgcgccagtcctgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgcccgactcggaccgatg

SEQ ID NO: 568 - DNA, 203 bp, Homo sapiens
ggcgcgccagtcctatctccccaccctctcttctccaccagccaacgtccgggaaaaacgagtttttcacgactgaaaacaacatagcaaaataagccaagatgtctgtggatccaatgacctacgaggcccagttctttggcttcacgccacaaacgtgcatgcttcggatctacattgcatttcaacgactcggaccgatg

SEQ ID NO: 569 - DNA, 203 bp, Homo sapiens
ggcgcgccagtcctcactgacagcgtgagcccgcggcggctgctgccatggtggctggcggccgggtaagggtctgagtggatctcctgccaggccagagcgccttcgggggccgcggcggaaggccaggagtttgcagccagggcgccgggtttgtggtctgcagtgtcgtgaggctgaggtgcagccgactcggaccgatg

SEQ ID NO: 570 - DNA, 203 bp, Homo sapiens
ggcgcgccagtccttttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcacgactcggaccgatg

SEQ ID NO: 571 - DNA, 203 bp, Homo sapiens
ggcgcgccagtcctgacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgcgactcggaccgatg

SEQ ID NO: 572 - DNA, 203 bp, Homo sapiens
ggcgcgccagtcctgccccgcgcggatggcgacggaaggggaggccgctcggcctggcctggagggagacctcgctctgccccgcgtcccagccatggcgacatcctcggccgcgctgccccgaatactcggcgcgggtgcccgggccccgtcgcgctggttgggctttctcgggaaggcgacccccccgactcggaccgatg

SEQ ID NO: 573 - DNA, 203 bp, Homo sapiens
ggcgcgccagtcctcaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcacgactcggaccgatg

SEQ ID NO: 574 - DNA, 203 bp, Homo sapiens
ggcgcgccagtcctctcgaccctgaaacttggagcagggtgggggttcagtatgaagccccgggaccgccccgcccctggccgcactgaccggatactgggggtcatggggggcatgctgcgcgcatgcgccctccctgggcaggaggggcccccaaggagaagccctctagggttggtgggtaccgacgactcggaccgatg

SEQ ID NO: 575 - DNA, 203 bp, Homo sapiens
ggcgcgccagtcctgcagtcagccggggacctcgtccgagcccacccgcctttggaggctccatctccattctgggttctgatgatgccactacttgtcacattgtggtcctgaggcacacaggtaatggggccacctgcttgacacattgtgacggaaccgacaccaaagctgaggtccccttgatccgactcggaccgatg

SEQ ID NO: 576 - DNA, 203 bp, Homo sapiens
ggcgcgccagtcctgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcacgactcggaccgatg

SEQ ID NO: 577 - DNA, 203 bp, Homo sapiens
ggcgcgccagtcctcagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggcgactcggaccgatg

SEQ ID NO: 578 - DNA, 203 bp, Homo sapiens
ggcgcgccagtcctaaaccatgggggcggaagaggtgctgggcaggaggcggaagaggtgctgtgcaggaggcgggcgggcgcggttctttccggaaggattgaatctcctttagccccgcccgcctccgtagctgcctgaagtagtgcagggtcagcccgcaagttgcaggtcatggcgctggctgccgactcggaccgatg

SEQ ID NO: 579 - DNA, 203 bp, Homo sapiens
ggcgcgccagtcctcctcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctcgactcggaccgatg

SEQ ID NO: 580 - DNA, 203 bp, Homo sapiens
ggcgcgccagtcctcggccttccgtccgctgcctccgtccgattctgcgtctgcttgctgaggaggcggattaggggggcgcggagtctcttcccttgagtgcataggtcccggttggtagagggtttgagtccgcatcgccacagctgaaggctgcgagggactaagagcagaatatatctttagaacgactcggaccgatg

SEQ ID NO: 581 - DNA, 203 bp, Homo sapiens
ggcgcgccagtcctctcctcctcgtatttccccctcggtcctttacgccgcctttccccctcatttgcagatgctgcatcccctttttggaattgctcaaccaggtggtaaccggcgccgcttcctggccttgggaggtggttcctttcttaacccacaagaacctctcccaagagaacttggtcctgcgactcggaccgatg

SEQ ID NO: 582 - DNA, 203 bp, Homo sapiens
ggcgcgccagtcctgcgtcctggtgtacgggctggccctggacgtcacttccgctggcggcagtggcgtcacttcctgctcttgggggcggggcatccgtgtccttgcggtgctgggcagcagaccgtccaaaccgacacgcgtggtatcctcgcggtgtccggcaagagactaccaagacagacgctcgactcggaccgatg

SEQ ID NO: 583 - DNA, 203 bp, Homo sapiens
ggcgcgccagtcctccctgagttcagggaatttccccagcatcccaaagcttgagtttcctgccagtcgggagggatgaatgcagataaagggagtgcagaaggcacgaggaaaccaaagtgctctgtatcctccagtctccgcgcctccacccagctcaggaacccgcgaaccctctcttgaccactcgactcggaccgatg

SEQ ID NO: 584 - DNA, 203 bp, Homo sapiens
ggcgcgccagtcctagttcacccactagaggcaaagacgtaagagagctaccagcgtattgagaggagatacacaggcactacgagaatggagtttagaagaaggtcagagccctgggcagtgttgggccaggctttagggcctcaggagtgcaagtagctgatgaagtatgtcgcattttttatgaccgactcggaccgatg

SEQ ID NO: 585 - DNA, 203 bp, Homo sapiens
ggcgcgccagtcctcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctcccgactcggaccgatg

SEQ ID NO: 586 - DNA, 203 bp, Homo sapiens
ggcgcgccagtcctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagcgactcggaccgatg

SEQ ID NO: 587 - DNA, 203 bp, Homo sapiens
ggcgcgccagtcctgcaaggcgggtggctccaccctgcgtcgggcctcagtcagcccccgggggaggccatgaacgccacggggaccccggtggcccccgagtcctgccaacagctggcggccggcgggcacagccggctcattgttctgcactacaaccactcgggccggctggccgggcgcgggggcgactcggaccgatg

SEQ ID NO: 588 - DNA, 203 bp, Homo sapiens
ggcgcgccagtccttgtgacttcacctcagttttgtgatccgtaaaatggacaaattcgaagctacttcacagtgctgttgagaggattaaatgaaacaatgcttgtaaagctctttgcaggagggagcctcggaagcagggcctggccggcagagcacacctgctgtcaccagggaccacaggcagccgactcggaccgatg

SEQ ID NO: 589 - DNA, 203 bp, Homo sapiens
ggcgcgccagtcctagcctcccttgccgcctccctcctctgcccggccgcagcagtgcacatggggtgttggaggtagatgggctcccggcccgggaggcggcggtggatgcggcgctgggcagaagcagccgccgattccagctgccccgcgcgccccgggcgcccctgcgagtccccggttcagcccgactcggaccgatg

SEQ ID NO: 590 - DNA, 203 bp, Homo sapiens
ggcgcgccagtcctccgggagcccgcgcaccctctctgggctccacccaggctgagagctggggtcgtggcggcgggggtggagagcgcgcccctagaggacctggggacacgggtgactcagacgtgactcaggaaggctcaggtcctgctggcatccgcggaggtgagacggtgatcagagctgggcgactcggaccgatg

SEQ ID NO: 591 - DNA, 203 bp, Homo sapiens
ggcgcgccagtccttccggttcctagcgttaactgcgaccggggttcagcgctcgggtgaggagctggtggcgtcggcaggttcgaggcgattcgaggtgagggggtcaagcggagaggctcggagtcggagaaagctgtcgcgacccagccacccagggtctggggtcggtgggagctccagctaggcgactcggaccgatg

SEQ ID NO: 592 - DNA, 203 bp, Homo sapiens
ggcgcgccagtccttcgcaacgtcacgggcaagggccgccattttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagcgactcggaccgatg

SEQ ID NO: 593 - DNA, 203 bp, Homo sapiens
ggcgcgccagtcctgattgtgggaaggcagctgaactcggcgcctggaaagatggaggcagcggagacagaggcggaagctgcagccctagaggtcctggctgaggtggcaggcatcttggaacctgtaggcctgcaggaggaggcagaactgccagccaagatcctggttgagtttgtggtggactccgactcggaccgatg

SEQ ID NO: 594 - DNA, 203 bp, Homo sapiens
ggcgcgccagtcctatgccgaacttctgcgctgcccccaactgcacgcggaagagcacgcagtccgacttggccttcttcaggttcccgcgggaccctgccagatgccagaagtgggtggagaactgtaggagagcagacttagaagataaaacacctgatcagctaaataaacattatcgattatgtcgactcggaccgatg

SEQ ID NO: 595 - DNA, 203 bp, Homo sapiens
ggcgcgccagtccttgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggcccgactcggaccgatg

SEQ ID NO: 596 - DNA, 203 bp, Homo sapiens
ggcgcgccagtcctaaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagacgactcggaccgatg

SEQ ID NO: 597 - DNA, 203 bp, Homo sapiens
ggcgcgccagtcctggtcggtgcgcgcttctcccgaggtggaacgggcggcagtcaagcgccggcgttctctgccgtcaccctttccttgccggccggcacttcggctgcagagttttgcccacgcttcgagacttagggagcagtgcctttcagaatttgcccactcatctggtataactggttctgcgactcggaccgatg

SEQ ID NO: 598 - DNA, 203 bp, Homo sapiens
ggcgcgccagtcctgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgcccgactcggaccgatg

SEQ ID NO: 599 - DNA, 203 bp, Homo sapiens
ggcgcgccagtcctgggcgtgcacgcgggcgcggctgcgtgagaggcgcgcggcggcgcagtaaacagtctccttccacaaaaccatggcgtcgctcaaatgtagcaccgtcgtctgcgtgatctgcttggagaagcccaaataccgctgtccagcctgccgcgtgccctactgctcggtagtctgctcgactcggaccgatg

SEQ ID NO: 600 - DNA, 203 bp, Homo sapiens
ggcgcgccagtcctccagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcgactcggaccgatg

SEQ ID NO: 601 - DNA, 203 bp, Homo sapiens
ggcgcgccagtcctaggaccctcgtgacttggccgagacaggggaagggagaagttgagtcgggcaaggaagagatgctaaagcctggggaattaagaacatgccagaatcatcccgagggagtctggaattagggagggtgaggactcgctaggatcgtcctgtggatctggctacagcaggagctgcgactcggaccgatg

SEQ ID NO: 602 - DNA, 203 bp, Homo sapiens
ggcgcgccagtcctaaacaatgcctgatatgtggagtaaagtcctcctccttggcctttgtcaagtcatcccctcttctcctcaggaactgctcaaacctgtgccccaaagatgagggcccaggaggacctcgagggccggacacagcatgaaaccaccagggacccctcgaccccgctacccacagacgactcggaccgatg

SEQ ID NO: 603 - DNA, 203 bp, Homo sapiens
ggcgcgccagtcctccgttcccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaaacgactcggaccgatg

SEQ ID NO: 604 - DNA, 203 bp, Homo sapiens
ggcgcgccagtcctcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgcccgactcggaccgatg

SEQ ID NO: 605 - DNA, 203 bp, Homo sapiens
ggcgcgccagtcctgcatttgtctggccttcccttttactgctggctgggaaggaggagcatcagaccacagatcctggaaggcacttctctccctgactgctgctcacactgccgtgagaacctgcttatatccaggaccaaggaggcaatgccaggaagctggtgaagggtttcctctcctccacccgactcggaccgatg

SEQ ID NO: 606 - DNA, 203 bp, Homo sapiens
ggcgcgccagtcctacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggcccgactcggaccgatg

SEQ ID NO: 607 - DNA, 203 bp, Homo sapiens
ggcgcgccagtcctagtgcgctgtgctcgaggggtgccggccaggcctgagcgagcgagctagccagcaggcatcgagggggcgcggctgccgtccggacgagacaggcgaacccgacgcagaagagtccaccaccggacagccagcacatccacgatggagcgtcttgtcgcccgtgggaccttccccgactcggaccgatg

SEQ ID NO: 608 - DNA, 203 bp, Homo sapiens
ggcgcgccagtcctcggaggctcggccacaacgccactggattggtggtagggcggggcgggccacagtctccagcctgaagcggaagtggaggaaagatggaggaccatcagcacgtgcccatcgacatccagaccagcaagctgctcgattggctggtggacagaaggcactgcagcctgaaatggcgactcggaccgatg

SEQ ID NO: 609 - DNA, 203 bp, Homo sapiens
ggcgcgccagtcctgggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccacgactcggaccgatg

SEQ ID NO: 610 - DNA, 203 bp, Homo sapiens
ggcgcgccagtccttggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggcccgactcggaccgatg

SEQ ID NO: 611 - DNA, 203 bp, Homo sapiens
ggcgcgccagtccttcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggccatcatgaggaagccacgagcagccgtgggaacgactcggaccgatg

SEQ ID NO: 612 - DNA, 203 bp, Homo sapiens
ggcgcgccagtcctatcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcatcgactcggaccgatg

SEQ ID NO: 613 - DNA, 203 bp, Homo sapiens
ggcgcgccagtcctcttcccgccagtcccctaaccctgaggctgccgcgcggcggtcactgcgccggggtagtgggccccagtgttgcgctctctggccgttccttacactctgcttcaggctccagtgcaggggcgtagtgggatatggccaactcgggctgcaaggacgtcacgggtccagatgagcgactcggaccgatg

SEQ ID NO: 614 - DNA, 203 bp, Homo sapiens
ggcgcgccagtccttctctccacgaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgacgactcggaccgatg

SEQ ID NO: 615 - DNA, 203 bp, Homo sapiens
ggcgcgccagtcctccctggccacaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccgactcggaccgatg

SEQ ID NO: 616 - DNA, 203 bp, Homo sapiens
ggcgcgccagtcctttgggaaggggccagattgcatcagacagggcctgatgggctggagccagactgtggtctgaggaggagacacagccttataagctgagggagtggagaggcccggggccaggaaagcagagacagacaaagcgttaggagaagaagagaggcagggaagacaagccaggcacgcgactcggaccgatg

SEQ ID NO: 617 - DNA, 203 bp, Homo sapiens
ggcgcgccagtccttgggctacagtgggccgctctgcctcgctcccgcccgcctgcctcagtctccccagctctctgccacccccctcggaccagtgcctcttagatgtcgccctctggtcgcctgtgtcttctcaccatcgttggcctgattctccccaccagaggacagacgttgaaagataccaccgactcggaccgatg

SEQ ID NO: 618 - DNA, 203 bp, Homo sapiens
ggcgcgccagtcctagggaggggcagctctgcatggcctgattcctgcaccccacctttgccccctcacacctcctctcatctcccgtttttgaagaggaggaccctgtcacatctggacaattctgcaagaactctgtagaactgacttcactgtgaaccaggctccagaagtcaacagaaacaaaacgactcggaccgatg

SEQ ID NO: 619 - DNA, 203 bp, Homo sapiens
ggcgcgccagtcctcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatcgactcggaccgatg

SEQ ID NO: 620 - DNA, 203 bp, Homo sapiens
ggcgcgccagtccttcaaatcaaatcagaaagacatccttcggaatgtgttcagaaccaattagtgacaacactgaagaccagaaaggcaagctgaagacaccagacttcgcttgaagggcaaacaagaaatccaaacatcatgtcaatggcaacagaacagtcgaacctttcccagagggaacacagcgactcggaccgatg

SEQ ID NO: 621 - DNA, 203 bp, Homo sapiens
ggcgcgccagtccttggagcagcgcgcgcaagcgaggccaggggaaggtgggcgcaggactttagccggttgagaaggatcaagcaggcatttggagcacaggtgtctagaaacttttaaggggccggttcaagaaggaaaagttcccttctgctgtgaaactatttggcaagaggctggagggcccacgactcggaccgatg

SEQ ID NO: 622 - DNA, 203 bp, Homo sapiens
ggcgcgccagtccttggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcatacgactcggaccgatg

SEQ ID NO: 623 - DNA, 203 bp, Homo sapiens
ggcgcgccagtccttgagtctcgctggagctcttctcgcccgcccacctcatctcaacccactttccgcggggagcggcgccaagctgggccttcctcggatcaggcgtcccctgaagtcggcacgcccctctgcgtcccccttcggtcccgctaggaccccgtccgggctgccgtcgcctcgtcgctcgactcggaccgatg

SEQ ID NO: 624 - DNA, 203 bp, Homo sapiens
ggcgcgccagtcctcgcactcactgctcgcgccgggcgcgctccgccagctccgtgctccccgcgccaccctcctccgggccgcgctccctaagggatggtactgaatttcgccgccacaggagaccggctggagcgcccgccccgcggcctcgcctctcctccgagcagccagcgcctcgggacgcgcgactcggaccgatg

SEQ ID NO: 625 - DNA, 203 bp, Homo sapiens
ggcgcgccagtcctgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagacgactcggaccgatg

SEQ ID NO: 626 - DNA, 203 bp, Homo sapiens
ggcgcgccagtcctacctctgcggcgtcactgggagcccgacggaaaactgcgctaaaggcttgtctttcccctgcccgaccgaaggagccgaccttgcctgcgctacagcttccttattttcgtcgcctgttctcctgatcctgcgtgttctaaaaaccccttaggctttccatgggttcccagacccgactcggaccgatg

SEQ ID NO: 627 - DNA, 203 bp, Homo sapiens
ggcgcgccagtcctccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtccgactcggaccgatg

SEQ ID NO: 628 - DNA, 203 bp, Homo sapiens
ggcgcgccagtcctaaggcagcctgcaaggcgctcatcccgcggaggaggcacgctctcggcgctcactgctctccacgccggggacatttccaccgaatgtagcatgaaagggctctgctctacgtgccagccttgggtgagagctgatgctgaagacaccgcggtgggattccagctgtctgattacgactcggaccgatg

SEQ ID NO: 629 - DNA, 203 bp, Homo sapiens
ggcgcgccagtccttggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagcgactcggaccgatg

SEQ ID NO: 630 - DNA, 203 bp, Homo sapiens
ggcgcgccagtcctgacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggttcaatgtatctcgactcggaccgatg

SEQ ID NO: 631 - DNA, 203 bp, Homo sapiens
ggcgcgccagtcctggcttgttcgggcctgagctggcgctacgaagttccggtccaggtctctgacttcgggcttgttcgctggtggcgtcggagccgagccggactggtcaggatgatcacggacgtgcagctcgccatcttcgccaacatgctgggcgtgtcgctcttcttgcttgtcgttctctacgactcggaccgatg

SEQ ID NO: 632 - DNA, 203 bp, Homo sapiens
ggcgcgccagtcctaactcttttgagtccagaatctcagaatcgggcgttgggctttgccgggtgcttcagatcaatggatgagttccacccgttcatcgaggcactgctgcctcacgtccgcgctttctcctacacctggttcaacctgcaggcgcggaagcgcaagtacttcaagaagcatgaaaacgactcggaccgatg

SEQ ID NO: 633 - DNA, 203 bp, Homo sapiens
ggcgcgccagtcctaagccccgccccgcgccctgcgtcgggttaagagggggttcctcgccagccaggtgctcgtcatgcgcaatgtggcgctgcggcgggcggcagggcctgtgtgtgctgaggcggctgagcggcggacatgcacaccacagagcgtggcgatggaacagtaaccgggcttgtgagcgactcggaccgatg

SEQ ID NO: 634 - DNA, 203 bp, Homo sapiens
ggcgcgccagtcctcactgtctgaaacagtcgcgtaaggggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgaccgactcggaccgatg

SEQ ID NO: 635 - DNA, 203 bp, Homo sapiens
ggcgcgccagtcctgaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccacgactcggaccgatg

SEQ ID NO: 636 - DNA, 203 bp, Homo sapiens
ggcgcgccagtcctggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggcgactcggaccgatg

SEQ ID NO: 637 - DNA, 203 bp, Homo sapiens
ggcgcgccagtcctaccaatcccgggctcagcaagttctcgcgataccgtgagatctccagtcctgacgacaccgccgctgaaatgttagtgagactgtagggtgggcggtgcgagcggcggttagctcccagttcggcctctgaggaaaacgggcgttcgcctgcggttggtccgactgttagcaaccgactcggaccgatg

SEQ ID NO: 638 - DNA, 203 bp, Homo sapiens
ggcgcgccagtcctctaaacgaaagagccacgacgctctgcgcatgtgcgctcttcgcaagctgaaaatcttgcggggagctctttagcaagttccgccttccagcctgaagcgcatgcgcagcctcggttccgttgcgtagcgtgtccctcagtgggacactgcagggtgcggggacaactacgaagcgactcggaccgatg

SEQ ID NO: 639 - DNA, 203 bp, Homo sapiens
ggcgcgccagtcctaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatcgactcggaccgatg

SEQ ID NO: 640 - DNA, 203 bp, Homo sapiens
ggcgcgccagtcctgtcccgtcggtctcggcgccgggaagaggcggtggcgctgcccgcggtggcgggggttggcgacggagcgcgttggtgccaggaccggggtccgaggcgcgctctccgcccacagaaatgagccgtcagactgctacagcattacctaccggtacctcgaagtgtccaccatcccgactcggaccgatg

SEQ ID NO: 641 - DNA, 203 bp, Homo sapiens
ggcgcgccagtcctaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaacccgactcggaccgatg

SEQ ID NO: 642 - DNA, 203 bp, Homo sapiens
ggcgcgccagtcctcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaagctccaggtcccttctccagccacccagccccaagcgactcggaccgatg

SEQ ID NO: 643 - DNA, 203 bp, Homo sapiens
ggcgcgccagtcctgacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaacgactcggaccgatg

SEQ ID NO: 644 - DNA, 203 bp, Homo sapiens
ggcgcgccagtcctggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatccgactcggaccgatg

SEQ ID NO: 645 - DNA, 203 bp, Homo sapiens
ggcgcgccagtcctgctgctaactgccctggtgtgtgtgagggagagagagggagggagggagagagagcgcgctagcgcgagagagcgagtgagcaagcgagcagaaaagaggtggagagggggggaataagaaagagagagaaggaaaggagagaaggcaggaagaaggcaagggacgagacaacccgactcggaccgatg

SEQ ID NO: 646 - DNA, 203 bp, Homo sapiens
ggcgcgccagtcctgtcacagcatcacctgggtgacgaggtcataacacctcagcccttgcttaaaaaattttatttctacttttctattgtaaagagatctcaaaacaggaagataaaattggactgacagctctacagcctagtcttttagacagtgaactaggccagcattggcagacactggcgcgactcggaccgatg

SEQ ID NO: 647 - DNA, 203 bp, Homo sapiens
ggcgcgccagtcctgctgcaatccctgctgggcagatggagagaggagcaagggagatggcagccccgggggactgtgcatagggagggactcatgaagtggcagctaagccctgtccagtggccacccgtcagccaagggccagagaccaggaaaggaagaaaggcagcttcacttcctctttgaggcgactcggaccgatg

SEQ ID NO: 648 - DNA, 203 bp, Homo sapiens
ggcgcgccagtcctctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccacgactcggaccgatg

SEQ ID NO: 649 - DNA, 203 bp, Homo sapiens
ggcgcgccagtccttgccagtctgtggagagtcctgctgccctccagccgggctcctccaccgggccttgcaggggccgagagagctcggtgcccgcccttccgctcgcctttttcgtcagctggctggagcagcatgggtccgggaggtctctaggctgaggcggcggccgctcctctagttccacacgactcggaccgatg

SEQ ID NO: 650 - DNA, 203 bp, Homo sapiens
ggcgcgccagtcctcagttggctgttaagtgacactgattctccccgccccgcctgacccccgagaaggaggcttgtcccccgctgcgtgagggggtggggaagtgggtagtgaattcggatctacctgggaggggggagtggaagttcccgccccggagagcggcgaggcggcagccacagttgattcgactcggaccgatg

SEQ ID NO: 651 - DNA, 203 bp, Homo sapiens
ggcgcgccagtcctacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaaccgactcggaccgatg

SEQ ID NO: 652 - DNA, 203 bp, Homo sapiens
ggcgcgccagtcctagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaaccgactcggaccgatg

SEQ ID NO: 653 - DNA, 203 bp, Homo sapiens
ggcgcgccagtcctaactccagggctagtgagctggaccggaagtaggtttctacccgaccgcattttacgtggtgctgcatttccggtagcggcggcgggaaatcggctgtgggagagaggctaggcctctgaggaggcgaatccggcgggtatcagagccatcagaaccgccaccatgacggtgggcgactcggaccgatg

SEQ ID NO: 654 - DNA, 203 bp, Homo sapiens
ggcgcgccagtccttgtgctttctctctgtttcagctgttttccttttaagatactcctctcagatttgtgtgcttcttcccttcccacattctatactgcccagcgcctgggattccagatctgcgtttgaatccaggaaagggaggtggacacctgcgcaggtgtgtgccctccggcccctgaagccgactcggaccgatg

SEQ ID NO: 655 - DNA, 203 bp, Homo sapiens
ggcgcgccagtcctgactttctggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcgcgactcggaccgatg

SEQ ID NO: 656 - DNA, 203 bp, Homo sapiens
ggcgcgccagtcctgctgctcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggacgactcggaccgatg

SEQ ID NO: 657 - DNA, 203 bp, Homo sapiens
ggcgcgccagtcctatggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacaccccccgactcggaccgatg

SEQ ID NO: 658 - DNA, 203 bp, Homo sapiens
ggcgcgccagtcctatccgggcaggataaaggcctgggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctcgactcggaccgatg

SEQ ID NO: 659 - DNA, 203 bp, Homo sapiens
ggcgcgccagtcctggaaccgccctgctgccgccgcctgcttcctctgctcgcggttagcccgtcagtccctgctctgtgcgcgcctccatctgggccatggatggcggggatctgatgagcttctttcttctggcatcattaacggaccttttaccatgaatagttctactccttctacaggtgtgtcgactcggaccgatg

SEQ ID NO: 660 - DNA, 203 bp, Homo sapiens
ggcgcgccagtcctgacgccatcccggccagaaaagccctggccagtggcgggcgcgacactatccgtgcggccaggcggagacccggaggaccgaagcttccggacgacgaggaaccgcccaacatggcctcggagagtgggaagctttggggtggccggtttgtgggtgcagtggaccccatcatgcgactcggaccgatg

SEQ ID NO: 661 - DNA, 203 bp, Homo sapiens
ggcgcgccagtcctcgagcggccgacggcgggtgcacgcgtcggtacacgtctgggcggcgacctggtcgcaagccatggtcccacgcggggtcccagggccgccgcgggacttggccgaggtctcccgacttgtgctgtgagatacgttaacgctttctcgacaccaggggtctggacttagtgacccgactcggaccgatg

SEQ ID NO: 662 - DNA, 203 bp, Homo sapiens
ggcgcgccagtcctatctgcctcagcctctttgtcactgcctggaccattgtccctgctgtttctcagacagcatagaggctgaggctggggccaggacccagacagagacacacggtcactgcagctgaagccgctgcccctgctacaggcaccaccaggaccagctgatcattccagcccacagcacgactcggaccgatg

SEQ ID NO: 663 - DNA, 203 bp, Homo sapiens
ggcgcgccagtcctggaggtgcggctggcccggtttcctggcgacgcggccctgcaggcggttgcgttccccgtcgttaccctctttctcttcccgacgcgtgagttaggccgtaatgccttggctgctctcagcccccaagctggttcccgctgtagcaaacgtccgcggcctctcaggatgtatgtcgactcggaccgatg

SEQ ID NO: 664 - DNA, 203 bp, Homo sapiens
ggcgcgccagtcctgcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctaccgactcggaccgatg

SEQ ID NO: 665 - DNA, 203 bp, Homo sapiens
ggcgcgccagtcctgcaccggggaattcgaatgggagaggcgggcccaaggagggagtggaatggccgcgggcggctcgacgcagcagaggcgacgcgagatggcggcagcttcagcggcggcgatctcaggagctggtcgctgtcggctaagcaagattggagctactcgtcgtccacctccagctccgactcggaccgatg

SEQ ID NO: 666 - DNA, 203 bp, Homo sapiens
ggcgcgccagtcctgcgctgggtcaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacgactcggaccgatg

SEQ ID NO: 667 - DNA, 203 bp, Homo sapiens
ggcgcgccagtcctcgaatgatttaaccaacgccttttccctccaaagaaacttggaggatatacctttttttccttaaatggcatctttctacccccaaaaagaaagtgtgtggttttgagggcggggacattttgggttttaaacagcgcgtttaagaacacctcagatctgccttctctatcccacgactcggaccgatg

SEQ ID NO: 668 - DNA, 203 bp, Homo sapiens
ggcgcgccagtcctagttccgagaccggttgccatggcgttctggacagcctcgcgagtccgaccccgcccttcaggagtgacgagcggcctgaccaatgggagcagggggcgggctctctgacgaaggactggaaggtggcggtggtgaaggtgcaggccgttggggcggctcagaggcaggtgactcgactcggaccgatg

SEQ ID NO: 669 - DNA, 203 bp, Homo sapiens
ggcgcgccagtcctggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcgcgactcggaccgatg

SEQ ID NO: 670 - DNA, 203 bp, Homo sapiens
ggcgcgccagtcctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtcgactcggaccgatg

SEQ ID NO: 671 - DNA, 203 bp, Homo sapiens
ggcgcgccagtcctagaggaagagaacgatttaaggagcgaatactactggtaaactaatggaagaaatctgctgcaccactggatattgggagtgtgtggcatgcatcctcatcatcaggaaactctaaaaaagaaccgagtggtgctagccaaacagctgttgttgagcgaattgttagaacatctcgactcggaccgatg

SEQ ID NO: 672 - DNA, 203 bp, Homo sapiens
ggcgcgccagtccttacctgcttcctgagctccccgagaagtcatccaggacctccccgagaagccgtccaggaaacatgctctcaggggacccccatctgcctcagcctctttgtcactgcctggaccattgtccctgctgtttctcaggcaccaccaggaccagctgatcattccagcccacagcacgactcggaccgatg

SEQ ID NO: 673 - DNA, 203 bp, Homo sapiens
ggcgcgccagtcctatggaaaggcttcctttctccacctctgtaactggtgcttctgagaagtaaatggtatttggatcctgacctcagacgcgaatttgggtcttctgtgcttaggagcagaaagagcccaggaggggcctgttcctttacttcttgggggaaacgcaatgcgtggcctgacttctccgactcggaccgatg

SEQ ID NO: 674 - DNA, 203 bp, Homo sapiens
ggcgcgccagtcctgctagttcctggtgcgtcacgggggagttccttaaaggggaagcgagccgggctacggggcgagcgcggggtgcggtggtcggcggggaggcccccgcgctttaaaataatgcccgcggcgcccgcgcgaccatgcaatggcgagcgctcgtcctggggctggtgctcctccggcgactcggaccgatg

SEQ ID NO: 675 - DNA, 203 bp, Homo sapiens
ggcgcgccagtcctcctttctccctcgcgttaggcaggtgacagcagggacatgtctcgggagatgcaggatgtagacctcgctgaggtgaagcctttggtggagaaaggggagaccatcaccggcctcctgcaagagtttgatgtccagacaaaacctgctacaaccccctcttcaactacgaggaccgactcggaccgatg

SEQ ID NO: 676 - DNA, 203 bp, Homo sapiens
ggcgcgccagtcctcaggccagccctggggcgccttaaaaaccggagctggcgcttggcatcgccactctgggcaggatccaacgtcgctccagctgctcttgacgactccacagataccccgaagccatggcaagcaagggcttgcaggacctgaagcaacaggtggaggggaccgcccaggaagcccgactcggaccgatg

SEQ ID NO: 677 - DNA, 203 bp, Homo sapiens
ggcgcgccagtcctaggagttgctgcatcgagttgtgaggattaaaagttggatgtaacggcttggtaattatgagctcttctagtgtcccttcctcttccctgtgcccaaggggttttaggaaagcattttatctccacagcaatcctatgaggttgatactactatcctcatagaaggggaaactgcgactcggaccgatg

SEQ ID NO: 678 - DNA, 203 bp, Homo sapiens
ggcgcgccagtccttaattatgagctcttctagtgtcccttcctcttccctgtgcccaaggggttttaggaaagcattttatctccacagcaatcctatgaggttgatactactatcctcatagaaggggaaactgatgccaggagaggttcaagcgtcttacctgaagtcacaaagcaaactgagtgcgactcggaccgatg

SEQ ID NO: 679 - DNA, 203 bp, Homo sapiens
ggcgcgccagtcctgcatcagggccgggggacgggtaaggggggggtgaagaaggggccggccttcaagcaagagcgacgcaagatggcagccaccacgggctcggtccctcgcaatttccgactgttggaagaactcgaagaaggccagaaaggagtaggagatggcacagttagctggggtctagacgactcggaccgatg

SEQ ID NO: 680 - DNA, 203 bp, Homo sapiens
ggcgcgccagtccttttcagagaaagttacgtggagcgtgggcgtttcgcagactcctaagcttctggcaagtatgaggcaaggatttcacagaagaacttggagcaaaaattcccactgtcatagctataggctgtccagtcttgagggagctgcaggaacaggaaaaagagaccttcagagaagaccgactcggaccgatg

SEQ ID NO: 681 - DNA, 203 bp, Homo sapiens
ggcgcgccagtcctcatgtcactgcctgccacttccggctcctgcgtcgctccggaagcctgcgagttccggaagccttggtaatccagattcggctaggaaaagacaagctttccagagaatgtttcagagaaagttacgtggagcgtgggcgtttcgcagactcctaagagaccttcagagaagaccgactcggaccgatg

SEQ ID NO: 682 - DNA, 203 bp, Homo sapiens
ggcgcgccagtcctgcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtcctcgactcggaccgatg

SEQ ID NO: 683 - DNA, 203 bp, Homo sapiens
ggcgcgccagtcctgtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaacgactcggaccgatg

SEQ ID NO: 684 - DNA, 203 bp, Homo sapiens
ggcgcgccagtccttttgcggctccaacatggctccgcggctgtgcagcatctctgtgacggcgcgtttctattccaaggacaatgaaggcagctggttccgctccctctttgttcacaaagtggatccccggaaggatgcccactccaccctgctgtccaagaaggaaaccagcaacctctataagacgactcggaccgatg

SEQ ID NO: 685 - DNA, 203 bp, Homo sapiens
ggcgcgccagtcctgcgaggaagcgcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggcccgactcggaccgatg

SEQ ID NO: 686 - DNA, 203 bp, Homo sapiens
ggcgcgccagtcctctcggccccgcccccgcgccccggatatgctgggacagcccgcgcccctagaacgctttgcgtcccgacgcccgcaggtcctcgcggtgcgcaccgtttgcgacttggtacttggaaaaatggacaaggattgtgaaatgaaacgcaccacactggacagccctttggggaagccgactcggaccgatg

SEQ ID NO: 687 - DNA, 203 bp, Homo sapiens
ggcgcgccagtcctcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagcgactcggaccgatg

SEQ ID NO: 688 - DNA, 203 bp, Homo sapiens
ggcgcgccagtcctcccaaaccaaggcccccagagaggtcccccaggcccctttgggtccctgagcctcagctggaggtggggggtgcctgcagtgcgctggctcagtctccttctgaaaagctggatccagcttgtttgaagcccttgagctgatcttagatccggcgcaggagaccaacgcctgcccgactcggaccgatg

SEQ ID NO: 689 - DNA, 203 bp, Homo sapiens
ggcgcgccagtcctggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgttgtttacttctggtttagtgtgaacgactcggaccgatg

SEQ ID NO: 690 - DNA, 203 bp, Homo sapiens
ggcgcgccagtcctgcggcggacacttccctgggcgggactgtctcgtggcacccggtggaaccgaggagaacgtggagcgccgggagcggcgaatatggacgactacagcctggatgagttccgtcggcgctggcaggaggagctggcgcaggcccaggcgccgaagaagcggcgacggcccgaggccgactcggaccgatg

SEQ ID NO: 691 - DNA, 203 bp, Homo sapiens
ggcgcgccagtcctgggagacccgccgcctccctccctccctagctgacttgctccctcccgggctgcggctgctgcaaaagccagcagcggcagcgggagctgtccggaggccggcgtcgagggtttgccgctgtctctgctattccatcctccccataggggctctctcccctctcccatctcaagcgactcggaccgatg

SEQ ID NO: 692 - DNA, 203 bp, Homo sapiens
ggcgcgccagtcctagctgacttgctccctcccgggctgcggctgctgcaaaagccagcagcggcagcgggagctgtccggaggccggcgtcgaggtgagacccgggcagactgaggctgcggggtttgccgctgtctctgctattccatcctccccataggggctctctcccctctcccatctcaagcgactcggaccgatg

SEQ ID NO: 693 - DNA, 203 bp, Homo sapiens
ggcgcgccagtcctgggattggttctccaggatcttgtttgtgactgttttctccccttagtgagctgtattttcaaggccctagcagcaacaagcctcgtgtgatccgggaagtgcgggctgactctgtggggaagttggtaactgtgcgtggaatcgtcactcgtgtctctgaagtcaaacccaagcgactcggaccgatg

SEQ ID NO: 694 - DNA, 203 bp, Homo sapiens
ggcgcgccagtccttaggaaaaagttttggatgggattatgtggaaactaccctgcgattctctgctgccagagcaggctcggcgcttccaccccagtgcagccttcccctggcggtggtgaaagagactcgggagtcgctgcttccaaagtgcccgccgtgagtgagctctcaccccagtcagccaacgactcggaccgatg

SEQ ID NO: 695 - DNA, 203 bp, Homo sapiens
ggcgcgccagtcctttccccggtgtcccgacggcggctcaagtcagagttgctgggttttgctcagattggtgtgggaagagcctgcctgtggggagcggccactccatactgctgaggcctcaggactgctgctcagcttgcccgttacctgaagaggcggcggagccgggcccctgaccggtcacccgactcggaccgatg

SEQ ID NO: 696 - DNA, 203 bp, Homo sapiens
ggcgcgccagtcctagagcggggaaggctgagtccacactgcaagtccagagagcagggaactaccttgagtattctactcaaacttatgtctcagagttccccaatttcccaagaagggagagatagaggccacaatccagggggccatctcttaaggtaccaataattttgcaggatcaaaccaaacgactcggaccgatg

SEQ ID NO: 697 - DNA, 203 bp, Homo sapiens
ggcgcgccagtccttcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacagattcacacgactcggaccgatg

SEQ ID NO: 698 - DNA, 203 bp, Homo sapiens
ggcgcgccagtccttttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggcgactcggaccgatg

SEQ ID NO: 699 - DNA, 203 bp, Homo sapiens
ggcgcgccagtcctgccatataaatcagatttttgacatgttataaaatgcaagtcacagctgctgttgtctgcggtattcaaaaacttttgaaacactgcatgtccaacaaaatttattttttgtgtgaatgtactgtttttcaaccctactctcttgaccaagaatgaaactatttacaaattaagcgactcggaccgatg

SEQ ID NO: 700 - DNA, 203 bp, Homo sapiens
ggcgcgccagtcctgggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcgactcggaccgatg

SEQ ID NO: 701 - DNA, 203 bp, Homo sapiens
ggcgcgccagtcctcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatcgactcggaccgatg

SEQ ID NO: 702 - DNA, 203 bp, Homo sapiens
ggcgcgccagtcctatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgaccgactcggaccgatg

SEQ ID NO: 703 - DNA, 203 bp, Homo sapiens
ggcgcgccagtcctcacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcacgactcggaccgatg

SEQ ID NO: 704 - DNA, 203 bp, Homo sapiens
ggcgcgccagtcctagatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactcgactcggaccgatg

SEQ ID NO: 705 - DNA, 203 bp, Homo sapiens
ggcgcgccagtcctgctttatctggtagcactgttacataaaattaacatttattggtgatcactaggtgccaacattatgcgaagaactttacgtggacatcccatttaattctcagaagccgatcacaaggtggccagcatcgaaatgttcagccttttagtgatgaagatgcatcaattgaaacacgactcggaccgatg

SEQ ID NO: 706 - DNA, 203 bp, Homo sapiens
ggcgcgccagtcctggcagccccatagccatctcagggacaaggaggctgtgatcagatctcgcgaggttcaggaaagcgccccgggaactgggccgctgggccagcccctgcgtcggggggcaagatggcagcccaggctttggcgctgctgagagaggtagcgaggctggaagcgccgctggaggacgactcggaccgatg

SEQ ID NO: 707 - DNA, 203 bp, Homo sapiens
ggcgcgccagtcctattctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagcgactcggaccgatg

SEQ ID NO: 708 - DNA, 203 bp, Homo sapiens
ggcgcgccagtccttcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggcaaggtgacccccgactcggaccgatg

SEQ ID NO: 709 - DNA, 203 bp, Homo sapiens
ggcgcgccagtcctgagtctgtaccctcgtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgccgactcggaccgatg

SEQ ID NO: 710 - DNA, 203 bp, Homo sapiens
ggcgcgccagtcctgtgcagaaggcacgaggaagccacagtgctccggatcctccaatcttcgctcctccaatctccgctcctccacccagttcaggaacccgcgaccgctcgcagcgctctcttgaccactatgagcctcctgtccagccgcgcggcccgtgtccccggtccttcgagctccttgtgcgactcggaccgatg

SEQ ID NO: 711 - DNA, 203 bp, Homo sapiens
ggcgcgccagtcctaaggccctcggccggaagctccgctttctcttcctgctctccatcatggcggatcaaggtgaaaaggagaaccccatgcgggaacttcgcatccgcaaactctgtctcaacatctgtgttggggagagtggagacagactgacgcgagcagccaaggtgttggagcagctcacacgactcggaccgatg

SEQ ID NO: 712 - DNA, 203 bp, Homo sapiens
ggcgcgccagtcctagtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctatcgactcggaccgatg

SEQ ID NO: 713 - DNA, 203 bp, Homo sapiens
ggcgcgccagtcctgggttgcgtttagcagaggaccggagcaaggaccctcacgacccacataaaatctacgagtttgtgaactcaggagttggggacttttcccagccagacacctctccggacaccaatggtggaggcagtacttctgatacccaggaagacattctggatgagttactgggtaaccgactcggaccgatg

SEQ ID NO: 714 - DNA, 203 bp, Homo sapiens
ggcgcgccagtcctctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggatccctgctgggcaccaacagctccacccgactcggaccgatg

SEQ ID NO: 715 - DNA, 203 bp, Homo sapiens
ggcgcgccagtccttcccgcctccctgggagctccgcacgggatttgcagatttacagaatggctgcacattaatggaaagagaagcataaacctatcttctttcattatggagggaggtttggcagatggagaacctgatcgaacttcgcaaacagtgacgaatctcagcttctgacaccaggaaagcgactcggaccgatg

SEQ ID NO: 716 - DNA, 203 bp, Homo sapiens
ggcgcgccagtcctctcctggaccggggggcgcggaggttggagagaggagctacccgggtctcggacaggcggcactgggaccacgaggcagggagccaggcttgaagcaggtgacatgtagacgtcccctggtccagcctcggaacctgagcgcccttctgcctggaaagtttgtggctaggcgcccgactcggaccgatg

SEQ ID NO: 717 - DNA, 203 bp, Homo sapiens
ggcgcgccagtcctcttaggaaaactcgacaggatattgaggggaggctccagccctcgggagtaaatatcttcccttccaacctggtgtcagcagcctttcgctcatactctaccacctatgaagagaggaatatcaccggaaccagggtgaaggtgcccgtggggcaggaggtggaggggatgaaccgactcggaccgatg

SEQ ID NO: 718 - DNA, 203 bp, Homo sapiens
ggcgcgccagtcctggggctgaaggaggctgactccccaagtcctgcaaaggggtgcaagcctagttccaaccctgccgggctgaggcatgagtaggggctgtatttgcgtgcaggcgggcccccaaagcttccactcgctgccttaaaacgccaacccagcctctcagacaatgctgccctcccactcgactcggaccgatg

SEQ ID NO: 719 - DNA, 203 bp, Homo sapiens
ggcgcgccagtcctgggctggggcgctccgctgagccactcctgcgcccccctggccttgtctacctcttgccccccgaggggttagtgtcgagctcaccccagcatcctatcacctcctggtggccttgccgcccccacaaccccgaggtataaagccaggtacacgaggcaggggacgcaccaaggcgactcggaccgatg

SEQ ID NO: 720 - DNA, 203 bp, Homo sapiens
ggcgcgccagtcctgcggtctcgttattcgtgttttctctccgccctacgattattcccttccgcccccttctctaagctgcacagcctgaatagaagggctggtccagcggcggcggaggctggcgctgtcctgagagggagggctctgtgcggaagagatgaatcggacaaagggtgatgaggaggcgactcggaccgatg

SEQ ID NO: 721 - DNA, 203 bp, Homo sapiens
ggcgcgccagtcctggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaacgactcggaccgatg

SEQ ID NO: 722 - DNA, 203 bp, Homo sapiens
ggcgcgccagtcctagcatgagtcagacagcctctggctttctggaagggcaaggactctatatatacagagggagcttcctagctgggatattggagcagcaagaggctgggaagccatcacttaccttgcactgagaaagaagacaaaggccagtatgcacagctttcctccactgctgctgctgccgactcggaccgatg

SEQ ID NO: 723 - DNA, 203 bp, Homo sapiens
ggcgcgccagtcctgcctctggctttctggaagggcaaggactctatatatacagagggagcttcctagctgggatattggagcagcaagaggctgggaagccatcacttaccttgcactgagaaagaagacaaaggcaagttgaaaagcggagaaatagtggcccagtggttgaaaaattgaagcaacgactcggaccgatg

SEQ ID NO: 724 - DNA, 203 bp, Homo sapiens
ggcgcgccagtcctaaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctgcgactcggaccgatg

SEQ ID NO: 725 - DNA, 203 bp, Homo sapiens
ggcgcgccagtccttgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaacgactcggaccgatg

SEQ ID NO: 726 - DNA, 203 bp, Homo sapiens
ggcgcgccagtcctatgtgcacacacatacactcacacgtgtgtgcaggtgcacacctcccccagaggctgcagccaagacgggcatcccacatcagagggatgaatggcaggtctgtcccgccagctgtgtgctctctcccacccgaagaaagcagcagagactcagacggcggagcctggaggagccgactcggaccgatg

SEQ ID NO: 727 - DNA, 203 bp, Homo sapiens
ggcgcgccagtcctggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagctcaactggtgattgacctgaataaccaacgactcggaccgatg

SEQ ID NO: 728 - DNA, 203 bp, Homo sapiens
ggcgcgccagtcctacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatcgactcggaccgatg

SEQ ID NO: 729 - DNA, 203 bp, Homo sapiens
ggcgcgccagtcctagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtcgactcggaccgatg

SEQ ID NO: 730 - DNA, 203 bp, Homo sapiens
ggcgcgccagtcctgcggctggattctcttccctggccaagtctctgagatcttctcccagggcgatgcaaagctactcgctaccagcttggacctgtctgcagtatctcctctgggacctgccatgctgaggacccattctcacctctgagggactcctgtcctaggactaaggtggagcctgggcccgactcggaccgatg

SEQ ID NO: 731 - DNA, 203 bp, Homo sapiens
ggcgcgccagtcctggtggtgttgacgattgaactgggcagtactggggccgtgagcggagagcaaagtgggctggactgggtcaggccctccttcctcgctgccgggatctccactccgccaatcccctgtgcctggcgttgggcggtttcccgaggagcttgggccgccgcagcttacagttgaaccgactcggaccgatg

SEQ ID NO: 732 - DNA, 203 bp, Homo sapiens
ggcgcgccagtcctctgaaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgcgactcggaccgatg

SEQ ID NO: 733 - DNA, 203 bp, Homo sapiens
ggcgcgccagtccttccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgcccgactcggaccgatg

SEQ ID NO: 734 - DNA, 203 bp, Homo sapiens
ggcgcgccagtcctaggccgcggcccagctgaccctcggggctcccccggcagcggacagggaagggttaaaggcccccggctccctgccccctgccctggggaacccctggccctgtggggacatgaactagggacaaattcccagctgacggggaccacaacctggattccctgcccaccctggcccgactcggaccgatg

SEQ ID NO: 735 - DNA, 203 bp, Homo sapiens
ggcgcgccagtcctagaataattttgctgccaagtgaatcagagagacttgcagttctcggagagcacggaacttattcctgcccagagttcagacacagccagaaattaccatttcatacttcacagaatggaggtttcagcagccaaagccccaagtgccgcagacttgtctgagattgaaataaacgactcggaccgatg

SEQ ID NO: 736 - DNA, 203 bp, Homo sapiens
ggcgcgccagtcctacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggcccgactcggaccgatg

SEQ ID NO: 737 - DNA, 203 bp, Homo sapiens
ggcgcgccagtcctgagaccctctgctcttctgctcccttcctgtgtgctgcctggcaatggggaactctgagggctgcaataccaagaaggagggtgacctgatagctgctcaggctcggctgaaggacctggaggctctgctgaactccaaggaggccgcactgagcactgctctcagtgagaagccgactcggaccgatg

SEQ ID NO: 738 - DNA, 203 bp, Homo sapiens
ggcgcgccagtcctcacaattgacagcctcaaggttcctggctttttgaaccaccacagacatctcctttcccggctaccccaccctgagcgccagacaccatgaaccttccttccacaaaggtctcctgggccgccgtgacgctactgctgctgctgctgctgctgccgcccgcgctgttgtcgtcccgactcggaccgatg

SEQ ID NO: 739 - DNA, 203 bp, Homo sapiens
ggcgcgccagtcctccggaagtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaacgactcggaccgatg

SEQ ID NO: 740 - DNA, 203 bp, Homo sapiens
ggcgcgccagtcctacccacacacagcctactttccaagcggagccatgtctggtaacggcaatgcggctgcaacggcggtgagtgctgagccggtgaccagcacactttgggcttctggacgagccgtgcagcgattggccccaggttgccatcctcagtcgtctattggaagaaaacagcccaaagcgactcggaccgatg

SEQ ID NO: 741 - DNA, 203 bp, Homo sapiens
ggcgcgccagtcctactgatttttagaactccacatttgaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactccgactcggaccgatg

SEQ ID NO: 742 - DNA, 203 bp, Homo sapiens
ggcgcgccagtcctggctgggtccagatacctgtgttttgactctgttcctgtggatagctgcttggtctgaagttccagaaaggatcctgttcccagacaggtccctgagtactgacggtcacaggctgccgcgtctttcctgttgactcatgtttggttcctccagtgaaaattttacttagagaacgactcggaccgatg

SEQ ID NO: 743 - DNA, 203 bp, Homo sapiens
ggcgcgccagtcctcaatcagttgcgaccttctcttaacaggtggagtcgaccgccagcatcttggcctctgtgaaggaacaagaggcccagtttgagaagctgacccgggcgctggaggaggaacggcgccacgtctcggcgcagctggaacgcgtccgggtctcaccacaagatgccaacccactccgactcggaccgatg

SEQ ID NO: 744 - DNA, 203 bp, Homo sapiens
ggcgcgccagtcctcaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagcgactcggaccgatg

SEQ ID NO: 745 - DNA, 203 bp, Homo sapiens
ggcgcgccagtccttcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacgactcggaccgatg

SEQ ID NO: 746 - DNA, 203 bp, Homo sapiens
ggcgcgccagtccttcatttggtcccaagtatgactcagggttaggctgggtcctcaggctccgtgctgttggaaggaagtgggaggattccaggggagttctgggaccttttcaaactgaagagaggaggctggctgcatcatgggagaagagactattgggaagaagttacctgcaactacagcaacgactcggaccgatg

SEQ ID NO: 747 - DNA, 203 bp, Homo sapiens
ggcgcgccagtcctaaaagctccagaaacgttgactgggaccactggagacactgaagaaggcaggggcccttagagtcttggttgccaaacagatttgcagatcaaggagaacccaggagtttcaaagaagcgctagtaaggtctctgagatccttgcactagctacatcctcagggtaggaggaagcgactcggaccgatg

SEQ ID NO: 748 - DNA, 203 bp, Homo sapiens
ggcgcgccagtcctctggttttccagtcaggcggccggagggcagccctcaagaacggccctgaccgcccgcggggtgaggggccctttctgggcaggacccgccccttggtcccgcagagccttggtacttggacctgaaccttgctccgagagggagtcctcgcggacgtcagccaagattccagacgactcggaccgatg

SEQ ID NO: 749 - DNA, 203 bp, Homo sapiens
ggcgcgccagtcctaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaacgactcggaccgatg

SEQ ID NO: 750 - DNA, 203 bp, Homo sapiens
ggcgcgccagtcctgggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagcgactcggaccgatg

SEQ ID NO: 751 - DNA, 203 bp, Homo sapiens
ggcgcgccagtcctcaagagcaagcatgtaccgctgaaaacacaagataactgcataagtaatgactttcagtgcagattcatagctaacccataaactgctggggcaaaaatcatcttggaaggctctgaacctcagaaaggattcacaagacgatctgccgaccctctgggagaaaatccagcaagcgactcggaccgatg

SEQ ID NO: 752 - DNA, 203 bp, Homo sapiens
ggcgcgccagtcctggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggacgactcggaccgatg

SEQ ID NO: 753 - DNA, 203 bp, Homo sapiens
ggcgcgccagtccttgtgacatttcctctggtggtttccacgaacccaggcgtcacccctcggtggagataaagtggagccacccagctccaccgtgtctcagcctggggtcggcctctgctgcttctggactcagtgaccctgggctgtcagggagcttctgagccttggttttcctgtctagtaagcgactcggaccgatg

SEQ ID NO: 754 - DNA, 203 bp, Homo sapiens
ggcgcgccagtcctggcggccaagatgtccgtgccttgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacacgactcggaccgatg

SEQ ID NO: 755 - DNA, 203 bp, Homo sapiens
ggcgcgccagtcctggggcgcggggagtcgaggcatttgcgcctgggcttcggagcgtagcgccagggcctgagcctttgaagcaggaggaggggaggagagagtggggctcctctatcgggaccccctccccatgtggatctgcccaggcggcggcggcggcggcggaggaggaggcgaccgagaagcgactcggaccgatg

SEQ ID NO: 756 - DNA, 203 bp, Homo sapiens
ggcgcgccagtcctccccggactctgcctgctcctgccatggtgccgtggccctgctgggcggatggagcaggatcccaagccgccccgtctgcggctctgggccctgatcccctggcttcccaggaagcagcggcccaggatcagccagacctctctgcctgtccctggccctggctctggcccccacgactcggaccgatg

SEQ ID NO: 757 - DNA, 203 bp, Homo sapiens
ggcgcgccagtcctaaattaacgtactatcctccttacttttgggtcgggccctccgggaagatggcggccgtgcaggcggccgaggtgaaagtggatggcagcgagccgaaactgagcaagaagtggtggtaatcattagttccagggtgctctgccatgttgacgcaagctgctgtaaggcttgttcgactcggaccgatg

SEQ ID NO: 758 - DNA, 203 bp, Homo sapiens
ggcgcgccagtcctgagctcacaatcttaaaatgtatctcctgtaatgctgggagtggggtacgagcttcctgctgtgggagggagggggacaggaagcctcgtaaggtctcaccaggtggcaagcacactggattagaagatgcaggaaagcaccttccagtctgaagatcatttaaagactcagtccgactcggaccgatg

SEQ ID NO: 759 - DNA, 203 bp, Homo sapiens
ggcgcgccagtcctgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagcccgactcggaccgatg

SEQ ID NO: 760 - DNA, 203 bp, Homo sapiens
ggcgcgccagtcctgtcggccctggggctgttcaggcactcagggcaggggagaggagagactaccgtcctggagataacggttccacggaggcccaaggcgaaacggaaggatcctcatgtacaaaactgagcggaatggagctgtgagcacgcatcaggtcctcagccagcagagccacgttccttcgactcggaccgatg

SEQ ID NO: 761 - DNA, 203 bp, Homo sapiens
ggcgcgccagtcctaatcactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctcgactcggaccgatg

SEQ ID NO: 762 - DNA, 203 bp, Homo sapiens
ggcgcgccagtccttcagcaccttggcgaagccttgggtttctttcttaaaggactgatttttagaactccacatttgagaacggccggtttgtgggcgatgctgaccttgaaagacagaaattttcagatttgaaactcaacggaccccaggatcacagtcaccttctatatagcaccatccccaggcgactcggaccgatg

SEQ ID NO: 763 - DNA, 203 bp, Homo sapiens
ggcgcgccagtcctagaagagcaggaaagatcccgaaaggaggaagaggtggcgaaaaatcaactgccctgctggatttgtctttctcagcaccttggcgaagccttgggtttctttcttaaaggactgatttttagaactccacatttgaggatcacagtcaccttctatatagcaccatccccaggcgactcggaccgatg

SEQ ID NO: 764 - DNA, 203 bp, Homo sapiens
ggcgcgccagtcctagtgtcctggttactgcagcggcagcaacagcaggtcctactatcgcctccctctagtctctgcttctctggatccctgaggagggcagaaggaagaaaacagcccaaagatgagagtgattcgcgtgggtacccgcaagagccagcttgctcgcatacagacggacagtgtggcgactcggaccgatg

SEQ ID NO: 765 - DNA, 203 bp, Homo sapiens
ggcgcgccagtcctgggcacttggagttgtcttaggactgatgtctgaattaactaaatgaacttgtctggtttgcagagtgctgatggcagagattggtgaggatttggataaatctgatgtgtcctcattaattttcctcatgaaggattacatgggccgaggcaagataagcaaggagaagagttcgactcggaccgatg

SEQ ID NO: 766 - DNA, 203 bp, Homo sapiens
ggcgcgccagtcctagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacacgactcggaccgatg

SEQ ID NO: 767 - DNA, 203 bp, Homo sapiens
ggcgcgccagtcctagcgcgcaggcgcggccggattccgggcagtgacgcgacggcgggccgcgcggcgcatttccgcctctggcgaatggctcgtctgtagtgcacgccgcgggcccagctgcgaccccggccccgcccccgggaccccggccatggacgaactgttccccctcatcttcccggcagcgactcggaccgatg

SEQ ID NO: 768 - DNA, 203 bp, Homo sapiens
ggcgcgccagtcctggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacacgactcggaccgatg

SEQ ID NO: 769 - DNA, 203 bp, Homo sapiens
ggcgcgccagtcctttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacacgactcggaccgatg

SEQ ID NO: 770 - DNA, 203 bp, Homo sapiens
ggcgcgccagtccttcacgccaccccctccaccttggacacaggacgctgtggtttctgagccaggtacaatgactcctttcgcctcccccgttgcccctctggatccactgcttaaatacggacgaggacagggccctgtctcctcagcttcaggcaccaccactgacctgggacagtgaatcgacacgactcggaccgatg

SEQ ID NO: 771 - DNA, 203 bp, Homo sapiens
ggcgcgccagtcctcttcaggccactctcctgtgcctgccagaagagacagagcttgaggagagcttgaggagagcaggaaagcctcccccgttgcccctctggatccactgcttaaatacggacgaggacagggccctgtctcctcagcttcaggcaccaccactgacctgggacagtgaatcgacacgactcggaccgatg

SEQ ID NO: 772 - DNA, 203 bp, Homo sapiens
ggcgcgccagtcctccccccccaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccacgactcggaccgatg

SEQ ID NO: 773 - DNA, 203 bp, Homo sapiens
ggcgcgccagtcctagagcccgacctggttttcagccccagccccgccactgagtggctttgtgagtgcgggcaagtcactcagcctccctaggcctcagtgacttccctgaaagcaagaattccactttcttgctgttgtgatggtggtaagggaacgggcctggctctggcccctgacgcaggaaccgactcggaccgatg

SEQ ID NO: 774 - DNA, 203 bp, Homo sapiens
ggcgcgccagtcctacagtggacctaggaaaccctcagctcagagaacaaccctgcattccccacacaacacccacaatcagccactgcgggcgaggagggcacgaggccaggttcccaagagctcaggaacatggagctgatccaggacacctcccgcccgccactggagtacgtgaagggggtccccgactcggaccgatg

SEQ ID NO: 775 - DNA, 203 bp, Homo sapiens
ggcgcgccagtcctcttgtcgcctaggtccacccgagccccctcccccgggccgcccccgagcacgaagttggcgggagcctataaaagctggtgccggcgcgacccgcggacacacagtgcaggcgcccaagccgccgccgccagatcggtgccgattcctgccctgccccgaccgccagcgcgacccgactcggaccgatg

SEQ ID NO: 776 - DNA, 203 bp, Homo sapiens
ggcgcgccagtccttacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaacgactcggaccgatg

SEQ ID NO: 777 - DNA, 203 bp, Homo sapiens
ggcgcgccagtcctatccacgaccaagctcttccacctgcggagctcgcttagtctgcacctcaaccgtgcggaaagtgactgccctgtttactgaggaaaaactggggctcagaaagataccatggagtagtttgaaacaggaacaaaatcttctgaaagctcggagcagaagcctttttggtcaaccgactcggaccgatg

SEQ ID NO: 778 - DNA, 203 bp, Homo sapiens
ggcgcgccagtcctcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagagggtgccactacccggcttcgactcggaccgatg

SEQ ID NO: 779 - DNA, 203 bp, Homo sapiens
ggcgcgccagtcctgagtaggcgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttcgactcggaccgatg

SEQ ID NO: 780 - DNA, 203 bp, Homo sapiens
ggcgcgccagtcctagagagtgttcaagaaggaagtgtatcttcatacatcaccacacctgaaagcagcaccaaagcagccataaacaatatgtaaataaacagatgtggctgtattccagtacaactttacctacaaaaacaggcatcagaccagcttgccaacttgtggcatagactgtttgctaccgactcggaccgatg

SEQ ID NO: 781 - DNA, 203 bp, Homo sapiens
ggcgcgccagtcctctaaggcactgagcgtatcatgttaaagatgagcgggtggcagcgacagagccaaaatcagagctggaacctgaggagagagtgttcaagaaggaagtgtatcttcatacatcaccacacctgaaagcaggcatcagaccagcttgccaacttgtggcatagactgtttgctaccgactcggaccgatg

SEQ ID NO: 782 - DNA, 203 bp, Homo sapiens
ggcgcgccagtcctgggggaacgcgggagtcgggcccgacctgagccacgcgggcttggtgcccacctgtgcgcgccgcctgcgaagaaggaacggtctggggagaaggcgccgccggccgcccccgtccccaccgcggccgtcgctggagagttcgagccgcctagcgcccctggagctccccaacccgactcggaccgatg

SEQ ID NO: 783 - DNA, 203 bp, Homo sapiens
ggcgcgccagtcctactgccgcggccctgctgctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctgcgactcggaccgatg

SEQ ID NO: 784 - DNA, 203 bp, Homo sapiens
ggcgcgccagtcctgaccggaggagcggggccgggagctgcgaggagccctccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccacgactcggaccgatg

SEQ ID NO: 785 - DNA, 203 bp, Homo sapiens
ggcgcgccagtcctagggctggtgctggccctgcccacgcctagggctccggcgcgtcacgggcctcagctgggattcccgcgcccctcggacggccacgagactcggacatctttccaggaacagcgtgaggaggacagaagcacccaacaggactgctcaagccacctgcgaacactgctgctacccgactcggaccgatg

SEQ ID NO: 786 - DNA, 203 bp, Homo sapiens
ggcgcgccagtcctgtttctggacccggccaccccccgcgtccgcaccgccgcccccgagggacgagtgacagcggccgccgcgctcggtccagtcttcccggctggaaggtattgttgcagcatctggcagtgagactgaggatgaggacagcatggacattcccttggacctttcttcatccgctgcgactcggaccgatg

SEQ ID NO: 787 - DNA, 203 bp, Homo sapiens
ggcgcgccagtcctacatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcacgactcggaccgatg

SEQ ID NO: 788 - DNA, 203 bp, Homo sapiens
ggcgcgccagtcctggctgtttcctggccgaggtgggtcggtagtagcgatggcgggtctgactgacttgcagcggctacaggcccgagtggaagagctggagcgctgggtgtacgggccgggcggggcgcgcggctcacggaaggtggctgacggcctggtcaaggtgcaggtggctttggggaacacgactcggaccgatg

SEQ ID NO: 789 - DNA, 203 bp, Homo sapiens
ggcgcgccagtccttcgtttacctcttcattctactctaaaggcatcgttattaggaaaatcctgttgtgaataagaaggattccacagatcacataccagagcggttttgcctcagctgctctcaactttgtaatcttgtgaagaagctgacaagcttggctgattgcagtgcactatgaggactgacgactcggaccgatg

SEQ ID NO: 790 - DNA, 203 bp, Homo sapiens
ggcgcgccagtcctaggtactctgtgtcatttttgatactgtaggtatcttatttcatttatctttattcttaatgtacgaattcataatatttgattcagaacagatttatcactaattaacagagtgtcaattatgctaacatctcatttactgattttaatttaaaacagtttttgttaacatgccgactcggaccgatg

SEQ ID NO: 791 - DNA, 203 bp, Homo sapiens
ggcgcgccagtcctacaatcctttgcggtggttcaagatggcggcgcccagtggcactgtgagcgattcggaaagtagtaacagcagtagcgatgcggaggagctggagcggtgccgcgaggcggcaatgccggcttggggcttggagcaacgcccgcacgtggcagggaagccaagagccggtgctgcgactcggaccgatg

SEQ ID NO: 792 - DNA, 203 bp, Homo sapiens
ggcgcgccagtcctggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggccgactcggaccgatg

SEQ ID NO: 793 - DNA, 203 bp, Homo sapiens
ggcgcgccagtcctatttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaacccgactcggaccgatg

SEQ ID NO: 794 - DNA, 203 bp, Homo sapiens
ggcgcgccagtcctatgtctggccgtggtaaaggtggaaaaggtttgggtaagggaggagctaagcgtcatcgcaaggttttgcgcgataacatccagggcatcactaagccagctatccggcgccttgctcgtcgcggcggtgtcaagcgaatttctggccttatctatgaggagactcgtggtgttcgactcggaccgatg

SEQ ID NO: 795 - DNA, 203 bp, Homo sapiens
ggcgcgccagtcctgtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttccgactcggaccgatg

SEQ ID NO: 796 - DNA, 203 bp, Homo sapiens
ggcgcgccagtcctggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttccgactcggaccgatg

SEQ ID NO: 797 - DNA, 203 bp, Homo sapiens
ggcgcgccagtcctctcatctttgtcagtgcacaaaatggcgccctacagcctactggtgactcggctgcagaaagctctgggtgtgcggcagtaccatgtggcctcagtcctgtgccaacgggccaaggtggcgatgagccactttgagcccaacgagtacatccattatgacctgctagagaagaacgactcggaccgatg

SEQ ID NO: 798 - DNA, 203 bp, Homo sapiens
ggcgcgccagtcctgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatccgactcggaccgatg

SEQ ID NO: 799 - DNA, 203 bp, Homo sapiens
ggcgcgccagtcctcctcttttccgtggcgcctcggaggcgttcagctgcttcaagatgaagctgaacatctccttcccagccactggctgccagaaactcattgaagtggacgatgaacgcaaacttcgtactttctatgagaagcgtatggccacagaagttgctgctgacgctctgggtgaagaacgactcggaccgatg

SEQ ID NO: 800 - DNA, 203 bp, Homo sapiens
ggcgcgccagtcctgctccgctgaatccgcccgcgcgtcgccgccgtcgtcgccgccccccgtcccggcccccctgggttccctcagcccagccctgtccagcccggttcccgggaggatgaagttcgtgtacaaagaagagcatccgttcgagaagcgccgctctgagggcgagaagatccgaaagacgactcggaccgatg

SEQ ID NO: 801 - DNA, 203 bp, Homo sapiens
ggcgcgccagtcctgagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtggcgactcggaccgatg

SEQ ID NO: 802 - DNA, 203 bp, Homo sapiens
ggcgcgccagtccttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgtatgataccgactcggaccgatg

SEQ ID NO: 803 - DNA, 203 bp, Homo sapiens
ggcgcgccagtcctataagctgggtcccgatgccgcgagcggaatctcggcgctcccggaagtggcctgaaggccgcgcgccagtcccgagcagtgctcgctcctgctcggggcgctgcggccccgggcgtcgccatgaccagtgagctggacatcttcgtggggaacacgacccttatcgacgaggacgactcggaccgatg

SEQ ID NO: 804 - DNA, 203 bp, Homo sapiens
ggcgcgccagtcctagtgaaacagaaggggaggtgcagtttcagaacccagccagcctctctcttgctgcctagcctcctgccggcctcatcttcgcccagccaaccccgcctggagccctatggccaactgcgagttcagcccggtgtccggggacaaaccctgctgccggctctctaggagagccccgactcggaccgatg

SEQ ID NO: 805 - DNA, 203 bp, Homo sapiens
ggcgcgccagtcctgggcacgagggcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagcgactcggaccgatg

SEQ ID NO: 806 - DNA, 203 bp, Homo sapiens
ggcgcgccagtcctggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaatcgactcggaccgatg

SEQ ID NO: 807 - DNA, 203 bp, Homo sapiens
ggcgcgccagtcctgggcgcagagctggcgctctagcccacggagttggttaactcctctcaccggcccctggaaagggttccaagtcctttagtacccgacgctgtctgggaattccgggcgtttcggctccttggtcgcagaggcaggaggcacccgaccgcatgtctgtcatggacctcgccaatcgactcggaccgatg

SEQ ID NO: 808 - DNA, 203 bp, Homo sapiens
ggcgcgccagtcctgccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcacgactcggaccgatg

SEQ ID NO: 809 - DNA, 203 bp, Homo sapiens
ggcgcgccagtcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggcgactcggaccgatg

SEQ ID NO: 810 - DNA, 203 bp, Homo sapiens
ggcgcgccagtcctgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagcgactcggaccgatg

SEQ ID NO: 811 - DNA, 203 bp, Homo sapiens
ggcgcgccagtcctcgttgctgcccggaggctcctacgccacggcccgtcgggcccggcgccggaagtgagctgttccgaggcgccgccgggagctgccacgtccgagacctggagcagccaccgccgcaatcatggtgtcagtaattaacactgtggatacctcccatgaggacatgattcacgacgcgactcggaccgatg

SEQ ID NO: 812 - DNA, 203 bp, Homo sapiens
ggcgcgccagtccttgagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcgactcggaccgatg

SEQ ID NO: 813 - DNA, 203 bp, Homo sapiens
ggcgcgccagtcctcacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcccgactcggaccgatg

SEQ ID NO: 814 - DNA, 203 bp, Homo sapiens
ggcgcgccagtcctgcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtccgactcggaccgatg

SEQ ID NO: 815 - DNA, 203 bp, Homo sapiens
ggcgcgccagtcctcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccacccgactcggaccgatg

SEQ ID NO: 816 - DNA, 203 bp, Homo sapiens
ggcgcgccagtcctggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcacgactcggaccgatg

SEQ ID NO: 817 - DNA, 203 bp, Homo sapiens
ggcgcgccagtcctgcggcatgggcagtatccgccgccatcctcttccgtgaggcgcgctgagaccgggaccggccctcctgagaggatgccggtgcgggcgcccgcggagagggacccgtcgccatgggccgtgtgatccgtggacagaggaagggcgccgggtctgtgttccgcgcgcacgtgaagcgactcggaccgatg

SEQ ID NO: 818 - DNA, 203 bp, Homo sapiens
ggcgcgccagtcctcctttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattcgactcggaccgatg

SEQ ID NO: 819 - DNA, 203 bp, Homo sapiens
ggcgcgccagtcctccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagacgactcggaccgatg

SEQ ID NO: 820 - DNA, 203 bp, Homo sapiens
ggcgcgccagtcctcgaaaaagaagcagtcctgggctgtacccggcgcagctgggagcggctgcttcctccggggtcgtatctccgcccggcatggggctgctggacctttgcgaggaagtgttcggcaccgccgacctttaccgggtgctgggcgtgcgacgcgaggcctccgacggcgaggtccgacgactcggaccgatg

SEQ ID NO: 821 - DNA, 203 bp, Homo sapiens
ggcgcgccagtcctgatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaacgactcggaccgatg

SEQ ID NO: 822 - DNA, 203 bp, Homo sapiens
ggcgcgccagtcctcgccgccgtggtagcagcctcagccgtttctggagtctcgggcccacagtcaccgccgcttacctgcgcctcctcgagcctccggagtccccgtccgcccgcacaggccggttcgccgtctgcgtctcccccacgccgcctcgcctgccgccgcgctcgtccctccgggccgaccgactcggaccgatg

SEQ ID NO: 823 - DNA, 203 bp, Homo sapiens
ggcgcgccagtccttccaggttcacacaactggaacccatctccaggaacaaacagctggaacccatctcccgttgaagggaaactgccagatttttgtaagattcttcctcctgggcacctctaagatactgatggctctgcagaggacccattcattgcttctgcttttgctgctgaccctgctggcgactcggaccgatg

SEQ ID NO: 824 - DNA, 203 bp, Homo sapiens
ggcgcgccagtcctacagagctccctcccaggcccgcgaacttggccattcagccgccgctgtccccgctgcgcgccctcgcgcctctgcctgagaagccaggcgctgttcccccaccccagaagaggatggcaaaggtggctaaggacctcaacccaggagttaaaaagatgtccctgggccagctgcgactcggaccgatg

SEQ ID NO: 825 - DNA, 203 bp, Homo sapiens
ggcgcgccagtcctcgacgctgagatgggggcggcggcggcggaagcggatcgcactctctttgtgggcaaccttgaaacgaaagtgaccgaggagctccttttcgagcttttccaccaggctgggccagtaataaaggtgaaaattccaaaagataaggatggtaaaccaaagcagtttgcgtttgtcgactcggaccgatg

SEQ ID NO: 826 - DNA, 203 bp, Homo sapiens
ggcgcgccagtccttcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcacgactcggaccgatg

SEQ ID NO: 827 - DNA, 203 bp, Homo sapiens
ggcgcgccagtcctccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggcccgactcggaccgatg

SEQ ID NO: 828 - DNA, 203 bp, Homo sapiens
ggcgcgccagtcctgggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattcgactcggaccgatg

SEQ ID NO: 829 - DNA, 203 bp, Homo sapiens
ggcgcgccagtcctggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcacgactcggaccgatg

SEQ ID NO: 830 - DNA, 203 bp, Homo sapiens
ggcgcgccagtcctaggagctgagtgggccccggccctcagcccgtcccgccggacccgctttcctcaactctccatcttctcctgccgaccgagatcgccgaggcggcctcaggctccctagccccttccccgtcccttccccgcccccgtccccgccccgggggccgccgccacccgcctcccacccgactcggaccgatg

SEQ ID NO: 831 - DNA, 203 bp, Homo sapiens
ggcgcgccagtcctgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggcgactcggaccgatg

SEQ ID NO: 832 - DNA, 203 bp, Homo sapiens
ggcgcgccagtcctgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtccgactcggaccgatg

SEQ ID NO: 833 - DNA, 203 bp, Homo sapiens
ggcgcgccagtccttcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactaccgactcggaccgatg

SEQ ID NO: 834 - DNA, 203 bp, Homo sapiens
ggcgcgccagtcctcgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattcgactcggaccgatg

SEQ ID NO: 835 - DNA, 203 bp, Homo sapiens
ggcgcgccagtcctgatccacaagtatatcctgagttcacttacctcttgggtggcagcacacatcggtccaccctgcttgtccagaaactgttaagagttggaagttcagaagaaaaaaaaaaggaattgaatgatctggcacgggaccctccagcacagtgttcagcaggtcctgttggagatgatcgactcggaccgatg

SEQ ID NO: 836 - DNA, 203 bp, Homo sapiens
ggcgcgccagtcctgactgtctacattagtaattcccaacttgggtccgaaagtgaacttttgctgaagcgaagtagctaaccgcttccatgtgcaaggcaggttccagacttcggggtgaggaggattaactgaaggaccccaggggaaccggtgtgctcactgatccgcctccagggccaccgccacgactcggaccgatg

SEQ ID NO: 837 - DNA, 203 bp, Homo sapiens
ggcgcgccagtcctacgcggtgccgcggggcgggagtagaggcggagggaggggacacgggctcattgcggtgtgcgccctgcactctgtccctcactcgccgccgacgacctgtctcgccgagcgcacgccttgccgccgccccgcagaaatgcttcggttacccacagtctttcgccagatgagaccgactcggaccgatg

SEQ ID NO: 838 - DNA, 203 bp, Homo sapiens
ggcgcgccagtcctcatgcctgaaccagctaagtcagctcctgctccgaagaagggttccaagaaggctgtgaccaaggcgcagaagaaggatggcaagaagcgcaagcgcagtcgtaaggagagctactccgtgtatgtgtacaaggtgctaaaacaggttcaccccgatactggcatctcatccaacgactcggaccgatg

SEQ ID NO: 839 - DNA, 203 bp, Homo sapiens
ggcgcgccagtcctgacgtgtctttcaggaagaggagctggtgagaagacagcgaaatggcgcctccggcccccggcccggcctccggcggctccggggaggtagacgagctgttcgacgtaaagaacgccttctacatcggcagctaccagcagtgcataaacgaggcgcagcgggtgaagctatcacgactcggaccgatg

SEQ ID NO: 840 - DNA, 203 bp, Homo sapiens
ggcgcgccagtcctggggcggtgcagaggcggcaggaagatggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactcggaccgatg

SEQ ID NO: 841 - DNA, 203 bp, Homo sapiens
ggcgcgccagtcctgccctggatccggcgtcagggcgaccgggcggacgaggtggagccagagtctgtcaggcgggttggtgaagggcgcggggccgggcacggcgttgggagtgcgcggcagggaccggccaggcgggctgcaggcacctcagagcccgggacaccccctcaacgtccgcaggcgcgcgactcggaccgatg

SEQ ID NO: 842 - DNA, 203 bp, Homo sapiens
ggcgcgccagtcctaggcggagctgggtgcgagcgccctaccgctttcgctttcccttcgcggtgcccactccactccttgtgcggcgctaggccccccgtcccggtcatggccatgctcagggtccagcccgaggcccaagccaaggtggatgtgtttcgtgaagacctctgtaccaagacagagaacgactcggaccgatg

SEQ ID NO: 843 - DNA, 203 bp, Homo sapiens
ggcgcgccagtcctagcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacgactcggaccgatg

SEQ ID NO: 844 - DNA, 203 bp, Homo sapiens
ggcgcgccagtcctctctttccagccagcgccgagcgatgggcatctctcgggacaactggcacaagcgccgcaaaaccgggggcaagagaaagccctaccacaagaagcggaagtatgagttggggcgcccagctgccaacaccaagattggcccccgccgcatccacacagtccgtgtgcggggagcgactcggaccgatg

SEQ ID NO: 845 - DNA, 203 bp, Homo sapiens
ggcgcgccagtcctcgggcgggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggacgactcggaccgatg

SEQ ID NO: 846 - DNA, 203 bp, Homo sapiens
ggcgcgccagtccttccgcttccgtccacttggcgagtgagacgctgatgggaggatggacgtactggtgtctgagtgctccgcgcggctgctgcagcaggaagaagagattaaatctctgactgctgaaattgaccggttgaaaaactgtggctgtttaggagcttctccaaatttggagcagttaccgactcggaccgatg

SEQ ID NO: 847 - DNA, 203 bp, Homo sapiens
ggcgcgccagtcctgggtagccgactggggtctcctggcgacgaccatggcgggggatgtgggcggtcgcagctgcacggactcggaactgctgctgcacccggagctgctgtcccaggagttccttctcctcactctggagcagaagaacatagctgttgaaactgatgtaagagtaaacaaagacacgactcggaccgatg

SEQ ID NO: 848 - DNA, 203 bp, Homo sapiens
ggcgcgccagtcctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgcgactcggaccgatg

SEQ ID NO: 849 - DNA, 203 bp, Homo sapiens
ggcgcgccagtcctgcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggacgactcggaccgatg

SEQ ID NO: 850 - DNA, 203 bp, Homo sapiens
ggcgcgccagtcctgcggaggcaggaggagcagtctcattgttccgggagccgtcaccacagtaggtccctcggctcagtcggcccagcccctctcagtcctccccaacccccacaaccgcccgcggctctgagacgcggccccggcggcggcggcagcagctgcagcatcatctccaccctccagcccgactcggaccgatg

SEQ ID NO: 851 - DNA, 203 bp, Homo sapiens
ggcgcgccagtcctcgctctcctttcgttgcctgatcgccgccatcatgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcgactcggaccgatg

SEQ ID NO: 852 - DNA, 203 bp, Homo sapiens
ggcgcgccagtcctgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgactcggaccgatg

SEQ ID NO: 853 - DNA, 203 bp, Homo sapiens
ggcgcgccagtcctgacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggcgactcggaccgatg

SEQ ID NO: 854 - DNA, 203 bp, Homo sapiens
ggcgcgccagtcctccgtgagtctgaccttaggtgtctcgtgtctggggttgatccgagctgtcgccgccgccgccgcaatgggcaaaacggccaactctccgggttcgggagcccgacccgacccggtgcggagcttcaatcgctggaagaaaaaacacagccataggcagaacaaaaagaagcagtcgactcggaccgatg

SEQ ID NO: 855 - DNA, 203 bp, Homo sapiens
ggcgcgccagtcctagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgtggcgtggccctggggacgccgactcggaccgatg

SEQ ID NO: 856 - DNA, 203 bp, Homo sapiens
ggcgcgccagtcctcagaggtcagacggtctagcgctgcgtgggccatggtgcagctccgaccgcgagcgtctcgcgccccggcgtcggcggaggcgatggtggacgagggccagctggcctcggaggaggaggaggcggagcacgggctgttgctcgggcagcccagcagcggcgcggccgccgagccgactcggaccgatg

SEQ ID NO: 857 - DNA, 203 bp, Homo sapiens
ggcgcgccagtcctgggctgcttggcagccaccggcctgcaactcaggaacccctccagaggccatggacaggctgccccgctgacggccagggtgaagcatgtgaggagccgccccggagccaagcaggagggaagaggctttcatagattctattcacaaagaataaccaccattttgcaaggacccgactcggaccgatg

SEQ ID NO: 858 - DNA, 203 bp, Homo sapiens
ggcgcgccagtcctggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgacgactcggaccgatg

SEQ ID NO: 859 - DNA, 203 bp, Homo sapiens
ggcgcgccagtcctaaacgacgctagctgcccacccctcttagttttccgcctccgacttccctaagggcatttccggttccggctgcgggccggtgaagatatggcggcgtctgcgtctgcagctgcaggggaggaggactgggtccttccctctgaagttgaagtattggagtccatctatctagacgactcggaccgatg

SEQ ID NO: 860 - DNA, 203 bp, Homo sapiens
ggcgcgccagtcctgcgcactcagggtctgaggcagctagtagccggagggtcaccatgaagttcaatcccttcgttacctgggaccgcagtaaaaaccgcaaacgtcacttcaatgccccctcacacgtgcgcaggaagatcatgtcatccccgctctccaaggagctgcggcagaagtacaatgtccgactcggaccgatg

SEQ ID NO: 861 - DNA, 203 bp, Homo sapiens
ggcgcgccagtcctctctcttccacaggaggcctacacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtgcgactcggaccgatg

SEQ ID NO: 862 - DNA, 203 bp, Homo sapiens
ggcgcgccagtcctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgccgactcggaccgatg

SEQ ID NO: 863 - DNA, 203 bp, Homo sapiens
ggcgcgccagtcctaatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgccgactcggaccgatg

SEQ ID NO: 864 - DNA, 203 bp, Homo sapiens
ggcgcgccagtcctcccctcccttagcgggggcgcgcggcgctgaggaccgcacggaaacggggaagtcaggtggccgctgccgccgccgccgccgcggtttgtcgccagaaggaagatggcggatctggaggagcagttgtctgatgaagagaaggtgcgtatagcagcaaaattcatcattcatgccgactcggaccgatg

SEQ ID NO: 865 - DNA, 203 bp, Homo sapiens
ggcgcgccagtcctatgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggcccgcgcgcccgtctacatggcggcggtcctcgagtaccgactcggaccgatg

SEQ ID NO: 866 - DNA, 203 bp, Homo sapiens
ggcgcgccagtccttctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaacccgactcggaccgatg

SEQ ID NO: 867 - DNA, 203 bp, Homo sapiens
ggcgcgccagtccttcagcggaagtgagggcggttgaggctgggcggcccaaggtggaaggaggggccgtgaggtgagagagtccgggagcccgagcttgagatggcctgatatgaaggagtcacgcctcccgcctcccggagctgcccagtggctgccttgtccttcaagtgcaggagctggttcaacgactcggaccgatg

SEQ ID NO: 868 - DNA, 203 bp, Homo sapiens
ggcgcgccagtcctgcccggaaacggaagtctcgttctttttcgtccttttccccggttgctgcttgctgtgagtgtctctagggtgatacgtgggtgagaaaggtcctggtccgcgccagagcccagcgcgcctcgtcgccatgcctcggaaaattgaggaaatcaaggacttcctgctcacagccccgactcggaccgatg

SEQ ID NO: 869 - DNA, 203 bp, Homo sapiens
ggcgcgccagtcctcagaggcagcggttggaggcgcggtgggtgtctgcgggggtctcgcggggcggctgcggtgtttcaccgggaaaggctcgaggagagcgcggctcacgagagataacccagctgtgctccctggaaccttcaatttcaaggcctccctgcctctactaggcgccttagctcactcgactcggaccgatg

SEQ ID NO: 870 - DNA, 203 bp, Homo sapiens
ggcgcgccagtcctgcggaaaccggaagcggcggctgtccgcggtgccggctgggggcggagaggcggcggtgggctccctggggtgtgtgagcccggtgatggagccgggcccgacagccgcgcagcggaggtgttcgttgccgccgtggctgccgctggggctgctgctgtggtcggggctggccccgactcggaccgatg

SEQ ID NO: 871 - DNA, 203 bp, Homo sapiens
ggcgcgccagtccttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctcgactcggaccgatg

SEQ ID NO: 872 - DNA, 203 bp, Homo sapiens
ggcgcgccagtcctaagaatcgcgggcctgtctgcaagacttgagttcaggactcccaatccttcgccatccgaacctggagggcatccagtcgacacctacaggggtcggacatgtccaaggctaactgagaggccttccagacgcttcatttttgttgtttgggtttgcggcagggcacaaagaggcgactcggaccgatg

SEQ ID NO: 873 - DNA, 203 bp, Homo sapiens
ggcgcgccagtcctagaggaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcccgactcggaccgatg

SEQ ID NO: 874 - DNA, 203 bp, Homo sapiens
ggcgcgccagtcctctcattgacttccttcctgttctaactgccagtactcagaagtcagagttgagagacagaggcaccccggacagagacgtgaagcactgaataaatagatcagaatgactgaaaaagccccagagccacatgtggaggaggatgatgatgatgagctggacagcaagctcaattcgactcggaccgatg

SEQ ID NO: 875 - DNA, 203 bp, Homo sapiens
ggcgcgccagtccttctgattggcaccggctcccattccggctccagcctccaatccgacccccatttcggctgcagcctcggacctagctccggccctcggtctatccggttgcatcctccctccctgttccggatcttatcttgcgccagcgcctactccaggatcccgtagccagacctcaagcccgactcggaccgatg

SEQ ID NO: 876 - DNA, 203 bp, Homo sapiens
ggcgcgccagtcctggtttaaccccgcctcttgcgtcggcgccttccttttcctccctgtcgccaccgaggtcgcacgcgtgagacttctccgccgcctccgccgcagacgccgccgcgatgcgctacgtcgcctcctacctgctggctgccctagggggcaactcctcccccagcgccaaggacatccgactcggaccgatg

SEQ ID NO: 877 - DNA, 203 bp, Homo sapiens
ggcgcgccagtcctactaagaccgcaaggcattcatttcctcctacggtggatgcggacgccgggaggaggagagccccagagagaggagctgggagcggaggcgcagagaacacgtagcgactccgaagatcagccccaatgaacatgtcagtgttgactttacaagaatatgaattcgaaaagcagcgactcggaccgatg

SEQ ID NO: 878 - DNA, 203 bp, Homo sapiens
ggcgcgccagtcctaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagcgactcggaccgatg

SEQ ID NO: 879 - DNA, 203 bp, Homo sapiens
ggcgcgccagtcctccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccgactcggaccgatg

SEQ ID NO: 880 - DNA, 203 bp, Homo sapiens
ggcgcgccagtcctgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgaccgactcggaccgatg

SEQ ID NO: 881 - DNA, 203 bp, Homo sapiens
ggcgcgccagtcctagctgtcgcgtctggtcgtggtctggcggagctgcggttggcttgtggcgtctccgccgccgccgccctcccttcctcttccccatcttcttctctcggtcccgggagcccccgcccggagagagtcgcggttgctgatcgtggtgcttgagtagagccgtggttggtgacagccgactcggaccgatg

SEQ ID NO: 882 - DNA, 203 bp, Homo sapiens
ggcgcgccagtcctgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatcgactcggaccgatg

SEQ ID NO: 883 - DNA, 203 bp, Homo sapiens
ggcgcgccagtcctaacgagacatctagtacggggctcacaggtaacagaactctgatcagatccgccccggctcccacacagctataaggttgcctgcctgcctgcacagaaatgacgaaggacaaaaacagcccagggctgaagaaaaagtcccagtcggtggatattaatgctccagggttcaaccgactcggaccgatg

SEQ ID NO: 884 - DNA, 203 bp, Homo sapiens
ggcgcgccagtcctcgccgctcaccgcagccccctcctggcgacccgcaagtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcacgactcggaccgatg

SEQ ID NO: 885 - DNA, 203 bp, Homo sapiens
ggcgcgccagtcctgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccgactcggaccgatg

SEQ ID NO: 886 - DNA, 203 bp, Homo sapiens
ggcgcgccagtcctttccggtgcgtcgtttacgccagtttgaaccaaagacgcccaaggttgaggccgagttccagagcatggggtctcggttgtcccagccttttgagtcctatatcactgcgcctcccggtaccgccgccgcgcccgccaaacctgcgcccccagctacacccggagcgccgacctcgactcggaccgatg

SEQ ID NO: 887 - DNA, 203 bp, Homo sapiens
ggcgcgccagtcctgaggcggccccacgctgctttcccagaaggctgtgcgtgctcctcgcttcctccgcggtcttccgagcggtcgcgtgaactgcttcctgcaggctggccatggcgcttcacgttcccaaggctccgggctttgcccagatgctcaaggagggagcgaaacacttttcaggattacgactcggaccgatg

SEQ ID NO: 888 - DNA, 203 bp, Homo sapiens
ggcgcgccagtcctgcagggagctgggacagtcctgggtcaggcaaggactctgtgatgcttccctgctccctcgcctttctctgcatctgatcctgggatgtcctagccaccatggctttccagctgagcaggatcatgcggccagatgatgccaacgtggccggcaatgtccacggggggaccatccgactcggaccgatg

SEQ ID NO: 889 - DNA, 203 bp, Homo sapiens
ggcgcgccagtcctgggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacgactcggaccgatg

SEQ ID NO: 890 - DNA, 203 bp, Homo sapiens
ggcgcgccagtccttctgcgccgccatgtcgcggaggctgctgccccgggcggagaagcggcgtcggcggctggagcagaggcagcagccggacgagcagcggaggcggtcgggagcgatggtgaagatggcggcggcgggcggcggaggcggcggtggccgctactacggcggcggcagtgagggcgcgactcggaccgatg

SEQ ID NO: 891 - DNA, 203 bp, Homo sapiens
ggcgcgccagtcctctcacgtgacaaagctcccggaggtgggagccctgggccaaaatggcggcctacctgcagtggcggcgcttcgttttcttcgacaaggagctggtgaaggagccgctgagcaatgatggggccgctcccggggccacacctgcttctggatccgctgcttccaagttcctttgccgactcggaccgatg

SEQ ID NO: 892 - DNA, 203 bp, Homo sapiens
ggcgcgccagtcctagtccgacgccgactgaggcacgagcgggtgacgctgggcctgcagcgcggagcagaaagcagaacccgcagagtcctccctgctgctgtgtggacgacacgtgggcacaggcagaagtgggccctgtgaccagctgcactggtttcgtggaaggaagctccaggactggcgggcgactcggaccgatg

SEQ ID NO: 893 - DNA, 203 bp, Homo sapiens
ggcgcgccagtcctccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagccccccgactcggaccgatg

SEQ ID NO: 894 - DNA, 203 bp, Homo sapiens
ggcgcgccagtcctccgcctcctccacggccactccgcctcttccctcccttcgtcccttcttcctctcccttttttccttcttccttcccctcctcgccgccaccgcccaggaccgccggccgggggacgagctcggagcagcagccagaaagcataacccctactgtagaactaaatgcactgtgccgactcggaccgatg

SEQ ID NO: 895 - DNA, 203 bp, Homo sapiens
ggcgcgccagtcctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgcgactcggaccgatg

SEQ ID NO: 896 - DNA, 203 bp, Homo sapiens
ggcgcgccagtcctaagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattgcgactcggaccgatg

SEQ ID NO: 897 - DNA, 203 bp, Homo sapiens
ggcgcgccagtcctatatgatccgctcggcttcctgggtctggctgctgccgcccgccggtgtccgcccgtgtcgcgccggggcaccaaggagccgttggagggtccgggcggaggcccgctcgtgtggaagtcgtcgacgccgccgctcgtccgtcctcccgtccgttctcgctcccggccgccatccgactcggaccgatg

SEQ ID NO: 898 - DNA, 203 bp, Homo sapiens
ggcgcgccagtcctgacgagacaccgaagcagaggatacaggaggattaaaggattcaggaaagcaagcagccctccggagaagctgtcgaaattcaagactggcaagagaagcaaattcaacctctcacaccgatcatttctcattccctgaaaagaagagattgtttccccagggaagtgaaaatacgactcggaccgatg

SEQ ID NO: 899 - DNA, 203 bp, Homo sapiens
ggcgcgccagtcctgttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggcgactcggaccgatg

SEQ ID NO: 900 - DNA, 203 bp, Homo sapiens
ggcgcgccagtccttttcctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggcgactcggaccgatg

SEQ ID NO: 901 - DNA, 203 bp, Homo sapiens
ggcgcgccagtcctgttcgctgcagcatcctcaggcttcacgttggagcctcttgattgtggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 902 - DNA, 203 bp, Homo sapiens
ggcgcgccagtcctgagaactcacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcacgactcggaccgatg

SEQ ID NO: 903 - DNA, 203 bp, Homo sapiens
ggcgcgccagtcctgggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccgactcggaccgatg

SEQ ID NO: 904 - DNA, 203 bp, Homo sapiens
ggcgcgccagtcctctccccccgctaccctaactttgccaggcaccttttcccttccatccatcttaaaggaaggaagggacgggctgagttccccgacgagagacacacccagattttcctgcagcttggggagaggtcctcccaggagccttggtccctcctggcctgccggagtccttagccaggcgactcggaccgatg

SEQ ID NO: 905 - DNA, 203 bp, Homo sapiens
ggcgcgccagtccttgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagccccgactcggaccgatg

SEQ ID NO: 906 - DNA, 203 bp, Homo sapiens
ggcgcgccagtcctgcgctcgccacgcccatgcctccgtcgctgcgcggcccaccccggatgtcagccccccgcgccgaccagaatccgtgaacatggcgaacgaggttatcaagtgcaaggctgcagttgcttgggaggctggaaagcctctctccatagaggagatagaggtggcacccccaaaggcgactcggaccgatg

SEQ ID NO: 907 - DNA, 203 bp, Homo sapiens
ggcgcgccagtcctgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcgagattcgactcggaccgatg

SEQ ID NO: 908 - DNA, 203 bp, Homo sapiens
ggcgcgccagtcctccccacccgcttccggccgcggctcggttctcccgcctccgcctccgccgcggctcgtggttgtcccgccatggcactgtcgcgggggctgccccgggagctggctgaggcggtggccgggggccgggtgctggtggtgggggcgggcggcatcggctgcgagctcctcaagaacgactcggaccgatg

SEQ ID NO: 909 - DNA, 203 bp, Homo sapiens
ggcgcgccagtcctcaagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgccgactcggaccgatg

SEQ ID NO: 910 - DNA, 203 bp, Homo sapiens
ggcgcgccagtcctgccggcctttggtctccaggacttgtcccagcagcccctcgaactgagaattacaccatcggacccctggctctgaggccttcagacttggactgtgtcacactgccaggcttccagggctccaacttgcagacggcctgttgtgggacagtctctgtaatcgcgaaagcaacccgactcggaccgatg

SEQ ID NO: 911 - DNA, 203 bp, Homo sapiens
ggcgcgccagtcctctggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagaccgactcggaccgatg

SEQ ID NO: 912 - DNA, 203 bp, Homo sapiens
ggcgcgccagtcctccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagccgactcggaccgatg

SEQ ID NO: 913 - DNA, 203 bp, Homo sapiens
ggcgcgccagtcctgccgcggccgacggtagttcgcttccccgagagtgcgcggaggcccgggtgcgaggagggcctgtttctcttcagccctggttcattcacctcggggaccgagggccccgccgtcaggagccggcgaccgtgccctggtgcgagctgtgatggtcattgtcctccagagcagtgcgactcggaccgatg

SEQ ID NO: 914 - DNA, 203 bp, Homo sapiens
ggcgcgccagtcctcgcttgacttgcttccagacaaaggttgtctcaagtttgttgctcaaaccgagttctggagaacgccatcagctcgctgcttaaaattaaaccacaggttccattatgggtcgacttgatgggaaagtcatcatcctgacggccgctgctcaggggattggccaagcagctgcccgactcggaccgatg

SEQ ID NO: 915 - DNA, 203 bp, Homo sapiens
ggcgcgccagtcctctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactccgactcggaccgatg

SEQ ID NO: 916 - DNA, 203 bp, Homo sapiens
ggcgcgccagtcctctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggatcccctaacaacagtgagagagcaatgcgagccgactcggaccgatg

SEQ ID NO: 917 - DNA, 203 bp, Homo sapiens
ggcgcgccagtcctggggtccttggctgggcggggcttgctcgcggtggcttgtggctccttcctgcggtgcttctctctttcgctcaggcccgtggcgccgacaggatgggcaagtgtcgtggacttcgtactgctaggaagctccgtagtcaccgacgagaccagaagtggcatgataaacagtatcgactcggaccgatg

SEQ ID NO: 918 - DNA, 203 bp, Homo sapiens
ggcgcgccagtcctgtttcctcttttaccaaggacccgccaacatgggccgcgttcgcaccaaaaccgtgaagaaggcggcccgggtcatcatagaaaagtactacacgcgcctgggcaacgacttccacacgaacaagcgcgtgtgcgaggagatcgccattatccccagcaaaaagctccgcaacacgactcggaccgatg

SEQ ID NO: 919 - DNA, 203 bp, Homo sapiens
ggcgcgccagtccttcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagcgactcggaccgatg

SEQ ID NO: 920 - DNA, 203 bp, Homo sapiens
ggcgcgccagtcctcaaacagtcgggaagaagcaccgtggctgctattatctgctctccgcgcctgacccctcccaggactcgtgatgccaaggccgctgcgagcggctacgaagagtcggggttgagccccagctgagccgagggctcgcactcttctggtctcccaggcccaacccacctgaagaacgactcggaccgatg

SEQ ID NO: 921 - DNA, 203 bp, Homo sapiens
ggcgcgccagtcctgcgctgtttccgcctcttgccttcggacgccggattttgacgtgctctcgcgagatttgggtctcttcctaagccggcgctcggcaagttctcccaggagaaagccatgttcagttcgagcgccaagatcgtgaagcccaatggcgagaagccggacgagttcgagtccggcatcgactcggaccgatg

SEQ ID NO: 922 - DNA, 203 bp, Homo sapiens
ggcgcgccagtccttcctgcgctggctgtggcacacccaccggtggcacacccctccctcgggtccagttcagcccacagactcctgggaggagagccagggccccagcctctcctttgaggagtgttgcagcctttctgtgtgccagatgcctagtgaagaaaagctgaaaccctggagctttgtgccgactcggaccgatg

SEQ ID NO: 923 - DNA, 203 bp, Homo sapiens
ggcgcgccagtcctgccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagcgactcggaccgatg

SEQ ID NO: 924 - DNA, 203 bp, Homo sapiens
ggcgcgccagtcctttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggcgactcggaccgatg

SEQ ID NO: 925 - DNA, 203 bp, Homo sapiens
ggcgcgccagtcctgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtcgactcggaccgatg

SEQ ID NO: 926 - DNA, 203 bp, Homo sapiens
ggcgcgccagtcctgattccagaagatactgtctggcgtgaaattagtctcagtagaaacataagtcccgcgcgtcttgtgctgcgcgtgcgcaagcttttgggccctcccgagaaagggaagtgcattctcgcttccgtagcggtctccgccggttggggggaagtaattccggttgttgcaccatgcgactcggaccgatg

SEQ ID NO: 927 - DNA, 203 bp, Homo sapiens
ggcgcgccagtcctttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagcgactcggaccgatg

SEQ ID NO: 928 - DNA, 203 bp, Homo sapiens
ggcgcgccagtcctcccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggcgactcggaccgatg

SEQ ID NO: 929 - DNA, 203 bp, Homo sapiens
ggcgcgccagtcctagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttcccgactcggaccgatg

SEQ ID NO: 930 - DNA, 203 bp, Homo sapiens
ggcgcgccagtcctggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgcgactcggaccgatg

SEQ ID NO: 931 - DNA, 203 bp, Homo sapiens
ggcgcgccagtccttccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaacgactcggaccgatg

SEQ ID NO: 932 - DNA, 203 bp, Homo sapiens
ggcgcgccagtccttgaagggcggatctcagtccctggctgctttggcatttggggaactgggactccctgtggggaggagaggaaagctggaagtcctggagggacagggtcccagaaggaggggacagaggagctgagagaggggggcagggcgttgggcaggggtccctcggaggcctcctggggcgactcggaccgatg

SEQ ID NO: 933 - DNA, 203 bp, Homo sapiens
ggcgcgccagtcctttgttcgcattataaaaggcacgcgcgggcgcgaggcccttctctcgccaggcgtcctcgtggaaggcccgggaccgcgggatgggtgtcggcgtgaccaggcctgagctccctgtctctcctcagtgacatcgtctttaaaccctgcgtggcaatccctgacgcaccgccgtgcgactcggaccgatg

SEQ ID NO: 934 - DNA, 203 bp, Homo sapiens
ggcgcgccagtcctggcggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcatcgactcggaccgatg

SEQ ID NO: 935 - DNA, 203 bp, Homo sapiens
ggcgcgccagtcctaccacagggtcttgcctccgcgcgccccgccctcgtcctcttgtgtagcctgaggcggcggtagcatggagggggagagtacgtcggcggtgctctcgggctttgtgctcggcgcactcgctttccagcacctcaacacggactcggacacggaaggttttcttcttggggaagcgactcggaccgatg

SEQ ID NO: 936 - DNA, 203 bp, Homo sapiens
ggcgcgccagtcctaggaaagtggagggggaggcggtggcgacgtccagcctgagaacctcaagagagggaggtgacgggacgctgagaggaagagacctgggaaattaagtttcttgcggagtacggtggggattgcagctgctgagcagggattctggaaagcattgcgtacctgagcccccagcacgactcggaccgatg

SEQ ID NO: 937 - DNA, 203 bp, Homo sapiens
ggcgcgccagtcctggtggcgctgttacatagcccgtagtcagaggcctttcagcccaggggccggcgcacgaaacctgtttggaggttatggatgataaacccaatcctgaagccctaagtgacagttcagagcgtcttttctcctttggcgtcatcgcagatgttcaatttgcagacttagaagatcgactcggaccgatg

SEQ ID NO: 938 - DNA, 203 bp, Homo sapiens
ggcgcgccagtcctgtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctcgactcggaccgatg

SEQ ID NO: 939 - DNA, 203 bp, Homo sapiens
ggcgcgccagtcctggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgactcggaccgatg

SEQ ID NO: 940 - DNA, 203 bp, Homo sapiens
ggcgcgccagtcctcccagccctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtcccgactcggaccgatg

SEQ ID NO: 941 - DNA, 203 bp, Homo sapiens
ggcgcgccagtcctcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccgactcggaccgatg

SEQ ID NO: 942 - DNA, 203 bp, Homo sapiens
ggcgcgccagtcctcggcggtggcgggagctgctgtctgagcagcggttggggaccgagcgaacttggcccaggagcccgggcctagggagaggcgcggcggcggcgggagcgcgaacggctggagctggccttcttcgccttctcctcggctgtggagccctggtggggggtctgcgcccggtcacccgactcggaccgatg

SEQ ID NO: 943 - DNA, 203 bp, Homo sapiens
ggcgcgccagtcctctagaagaactcgaccagtgagcaggcgaggaaggggcgggagccggggtcccggtagcttctagtaggttccagaaggcggcgcgtgcggttgggaacgcggagcggacggattcgattcaacggggttcgggaccgcgctgcgctatggagcaggtcaatgagctgaaggagcgactcggaccgatg

SEQ ID NO: 944 - DNA, 203 bp, Homo sapiens
ggcgcgccagtcctgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcacccgactcggaccgatg

SEQ ID NO: 945 - DNA, 203 bp, Homo sapiens
ggcgcgccagtccttcactcaccctggcacattcagcccccctaacccaccttgaacattgaccaccacacactccctggcacgctcttctcaccctcaacttctgccacctctccctgggcaatactgccagcctttccctaatctcagagctgcagccctgccctgtcactcacctcaaacctgcccgactcggaccgatg

SEQ ID NO: 946 - DNA, 203 bp, Homo sapiens
ggcgcgccagtcctggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcacccgactcggaccgatg

SEQ ID NO: 947 - DNA, 203 bp, Homo sapiens
ggcgcgccagtcctcgtttgtcgaggcctccggaacccccgccgcctcccggagcccctcgcccttggcagcctgtcaccgccccctgggcgggctcgaatgcgcgtccggtgaaggtgcaggcccggcgccgccactgccgcagccaggagatggttcgggcctagcggagccgggactggagcaaccgactcggaccgatg

SEQ ID NO: 948 - DNA, 203 bp, Homo sapiens
ggcgcgccagtcctcccgagccggggaggaaaagcagcgactcctcgctcgcatccccgggagccgcactccagactggcccggtagtcaggggctcaggagcagatcccgaggcaggctttgctcagcctccgacgagggctggccctttggaaggcgccttcaacagccggaccagacaggccacccgactcggaccgatg

SEQ ID NO: 949 - DNA, 203 bp, Homo sapiens
ggcgcgccagtcctccatctgtaagagctccttggtcactgccatggttccggcctgacggattcgtactacaactcccaagagtctaagcgcgcgtgaggactgcaggctccgagcggcgcctagccctctgggaattgtgttctgggtcaggcttgactgactctgagggaggccggcagtcgtgacgactcggaccgatg

SEQ ID NO: 950 - DNA, 203 bp, Homo sapiens
ggcgcgccagtcctgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagccgactcggaccgatg

SEQ ID NO: 951 - DNA, 203 bp, Homo sapiens
ggcgcgccagtcctgcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgactcggaccgatg

SEQ ID NO: 952 - DNA, 203 bp, Homo sapiens
ggcgcgccagtcctagcacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagcgactcggaccgatg

SEQ ID NO: 953 - DNA, 203 bp, Homo sapiens
ggcgcgccagtcctaagagtcccggacagtgcaaagcaaatgcaagaagaccccctccctagccgatgggaaatgccccagccgttgaaggcggaaataacggcctgtaggcaacggaactcccagcgttcgcaaaggagggaggagccggaaactcagggcgcgaggcctgtgggcccagcgggaagcgactcggaccgatg

SEQ ID NO: 954 - DNA, 203 bp, Homo sapiens
ggcgcgccagtcctcaccctacagcagttcaggctgtgtggttcgcaggaagcatacactggctttttgattcttgctagttcccagctcacagtttgggaggatccaacaccaacctttacgtgaagtggaggcccaaggacagtgaggagctgggtggtcccagcctggagctgtgccagcctgaccgactcggaccgatg

SEQ ID NO: 955 - DNA, 203 bp, Homo sapiens
ggcgcgccagtcctgagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaaccgactcggaccgatg

SEQ ID NO: 956 - DNA, 203 bp, Homo sapiens
ggcgcgccagtcctgcgcgctcgcagcttctcgctctcgcctgcctgcccgctcccttgcttgctcgcgctttcgctcgccctctcctcgaggatcgaggggactctgaccacagcctgtggctgggaagggagacagaggcggcggcggctcaggggaaacgaggctgcagtggtggtagtaggaagcgactcggaccgatg

SEQ ID NO: 957 - DNA, 203 bp, Homo sapiens
ggcgcgccagtcctatccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacacgactcggaccgatg

SEQ ID NO: 958 - DNA, 203 bp, Homo sapiens
ggcgcgccagtcctcagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgcccgactcggaccgatg

SEQ ID NO: 959 - DNA, 203 bp, Homo sapiens
ggcgcgccagtcctcctccggcagtggcttactcccggtgccaggttcttggagctgtgaggtgttcagcattatttaagatcacctatgcatcatctgaagccacagtcccaggtcatcttcatcaccttccccagtggaatgcctcctgtgttaaagcccacaacaacccctgtggaggaacaacccgactcggaccgatg

SEQ ID NO: 960 - DNA, 203 bp, Homo sapiens
ggcgcgccagtcctcgaccacggaaatttgacacctccgggcttggaagcagctctctcctccttccccgctgcttataaacctcagccctgaggctccagctcactctaccccatctccttgccgggtcagccctgacaaaggtcagctagccccttgaggacatcagctttggcctcagggtcctacgactcggaccgatg

SEQ ID NO: 961 - DNA, 203 bp, Homo sapiens
ggcgcgccagtcctacgccagggagctgtgaggcagtgctgtgtggttcctgccgtccggactctttttcctctactgagattcatctgtgtgaaatatgagttggcgaggaagatcgacctatcggcctagaccaagacgctacgtagagcctcctgaaatgattgggcctatgcggcccgagcagtcgactcggaccgatg

SEQ ID NO: 962 - DNA, 203 bp, Homo sapiens
ggcgcgccagtcctctctggtggagagagtgttgtctaaaacaagttccggaagggaggctgcccttcggggtccgagaaccaccggcctccccagtttgagggctgttaccccgtgcgcgcttcgacgttgctgctgttggctctcctcgcccctcgttcccttgggaaccgcctgggaactccgcccgactcggaccgatg

SEQ ID NO: 963 - DNA, 203 bp, Homo sapiens
ggcgcgccagtcctttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctcgggtccgtgcctccaagcgactcggaccgatg

SEQ ID NO: 964 - DNA, 203 bp, Homo sapiens
ggcgcgccagtcctacccaaagaaaggcaaagagtcctgcccggcaccggcgccgcgtgggccaaacctgcgcccgtggaggggcgcgcagagggcaccgggcgccgggagcaggcggcgcagcaccagcattgtgttagtgccgggaggccactgtgtcagcaagctgagagggaaactgaagcaagcgactcggaccgatg

SEQ ID NO: 965 - DNA, 203 bp, Homo sapiens
ggcgcgccagtcctatcggatggctgttacctcctcctaaaatgtctgcatttacccagataatcttccaatggaaatccatggttcaagtgccacctcttcaggaaagccatctgacttcaatcaggtcagccctgacaaaggtcagctagccccttgaggacatcagctttggcctcagggtcctacgactcggaccgatg

SEQ ID NO: 966 - DNA, 203 bp, Homo sapiens
ggcgcgccagtcctgagcagggagtcagagacgccccgttccaggacccttgtcaccgggagacaggagcggggaggatctgtggggtcctgggttcagcactctgccctgctgccgctgaggagaggtcagccctgacaaaggtcagctagccccttgaggacatcagctttggcctcagggtcctacgactcggaccgatg

SEQ ID NO: 967 - DNA, 203 bp, Homo sapiens
ggcgcgccagtcctcactgttggtaaagcccagcccttcccaacctgcaagctcaccttccaggactgggcccagcccatgctctccatatataagctgctgccccgagcctgattcctagtcctgcttctcttccctctctcctccagcctctcacactctcctcagctctctcatctcctggaacccgactcggaccgatg

SEQ ID NO: 968 - DNA, 203 bp, Homo sapiens
ggcgcgccagtcctgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaaccgactcggaccgatg

SEQ ID NO: 969 - DNA, 203 bp, Homo sapiens
ggcgcgccagtcctgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatcgactcggaccgatg

SEQ ID NO: 970 - DNA, 203 bp, Homo sapiens
ggcgcgccagtcctaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgccgactcggaccgatg

SEQ ID NO: 971 - DNA, 203 bp, Homo sapiens
ggcgcgccagtcctttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtcgactcggaccgatg

SEQ ID NO: 972 - DNA, 203 bp, Homo sapiens
ggcgcgccagtcctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctcccccgactcggaccgatg

SEQ ID NO: 973 - DNA, 203 bp, Homo sapiens
ggcgcgccagtcctggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgaaaaggaagcaaatgagctgcgactcggaccgatg

SEQ ID NO: 974 - DNA, 203 bp, Homo sapiens
ggcgcgccagtcctgttcgcgttcgccccgcctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatgcgactcggaccgatg

SEQ ID NO: 975 - DNA, 203 bp, Homo sapiens
ggcgcgccagtcctgggggctggaatactgtaccttgatcttagggcctggaaaaatcaggtaggtaactctctggtcctaggtggaggtgtaggggaggttgggccagggatgccttcactgtgtctctctggtcttgccaccccagaccgagggacacacaggcactgctgtctgcaacacaagcacgactcggaccgatg

SEQ ID NO: 976 - DNA, 203 bp, Homo sapiens
ggcgcgccagtcctctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgaccgactcggaccgatg

SEQ ID NO: 977 - DNA, 203 bp, Homo sapiens
ggcgcgccagtcctccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagacgactcggaccgatg

SEQ ID NO: 978 - DNA, 203 bp, Homo sapiens
ggcgcgccagtcctaaagtggctgaatgagaaatgtagattgcagagggcaactggtgtgtttatatgcctgacattatttgggttttcccccctcaggcagaagctgaggaagattgtcattctgatactgtcagagcagatgatgatgaagaaaatgaaagtcctgctgaaacagatctgcaggcacgactcggaccgatg

SEQ ID NO: 979 - DNA, 203 bp, Homo sapiens
ggcgcgccagtccttggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgcgactcggaccgatg

SEQ ID NO: 980 - DNA, 203 bp, Homo sapiens
ggcgcgccagtcctcgctcgccggccgggcgccccaagcaactacaacttccatcacgctctgcgaggccttgatctgcaggcttttgcaggggaaggagtggggcgaacatggctgaaggaagccgaggtggccctacgtgtagcggggtgggtggcaggcaggacccagtctccggcagtggcggccgactcggaccgatg

SEQ ID NO: 981 - DNA, 203 bp, Homo sapiens
ggcgcgccagtcctctggtaggagagcgccgcgggcggatggaggcgactcttcgccccgcctgagctcaggaggggctagcgcggagcgcgggtcccgcctccagccgcgggagcggccgcgcgagccaccactggaggaggaggaggaggagcggacgtcggcttctccccgcgggagcccccagccgactcggaccgatg

SEQ ID NO: 982 - DNA, 203 bp, Homo sapiens
ggcgcgccagtcctcgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagcgactcggaccgatg

SEQ ID NO: 983 - DNA, 203 bp, Homo sapiens
ggcgcgccagtcctggggaggaggaagagggggagcaggaagaggggcagaaggaagaagaagagggggaggagaaagagatagaagagtaagaggagggggaagaaagacaaggggaaggggaggaggaggaggacggggaggagcttcgccgcggcctgctccgcccagccggggtcggtggccgccgactcggaccgatg

SEQ ID NO: 984 - DNA, 203 bp, Homo sapiens
ggcgcgccagtcctttccgggttttgtgtcgaatctgcggcggcgacccggcgccgcgtcacgcggtggtgaatgtgcggcagcacgcgcgccgcgtcgtttacgcggcgatttcatcatgctccgagccgggcggcgcgcgccgcttccgtcgccaccctctctggacagcccagggccgcaggctccgactcggaccgatg

SEQ ID NO: 985 - DNA, 203 bp, Homo sapiens
ggcgcgccagtccttggagggaagggggcgggcagacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaaccgactcggaccgatg

SEQ ID NO: 986 - DNA, 203 bp, Homo sapiens
ggcgcgccagtcctggcccaccgccgcccaggcaaggccgccctgccttgggcgcagcgctgccatggctgggggccgtggggcccccgggcgcggccgggacgagcctccggagagctacccgcaacgacaggaccacgagctacaggccctggaggccatctacggcgcggacttccaagacctgccgactcggaccgatg

SEQ ID NO: 987 - DNA, 203 bp, Homo sapiens
ggcgcgccagtcctctgcgactcgaccccgccatcctcaggtcccctccgcctgccagatcttttctcggatccccgctctcccaccacctgctcacgagatcccgcggatctagaacccagggtcccccggggccccccggccgggtcccgggtgggctccaggcggccggtccccggcctcccccccgactcggaccgatg

SEQ ID NO: 988 - DNA, 203 bp, Homo sapiens
ggcgcgccagtcctcccacgtcggccaacctcctgcagctggtgcgctcgtccggagacatccaggagggcgacctggtggaggtggtgctgtcggcctcggccaccttcgaggacttccagatccgcccgcacgccctcacggtgcactcctatcgggcgcctgccttctgtgatcactgcggggagcgactcggaccgatg

SEQ ID NO: 989 - DNA, 203 bp, Homo sapiens
ggcgcgccagtcctgcggcagctcttttccttcttcctccacttcccctaccctccaccgtccgggagccgccgccaccgccgccgaggagtcaggaagttcaagatggccgccgcggagacccagtcgctacgggagcagccagagatggaagatgctaattctgaaaagagtataaatgaagaaaacgactcggaccgatg

SEQ ID NO: 990 - DNA, 203 bp, Homo sapiens
ggcgcgccagtcctctggagccgctggagttcggacttctgcaactgttggcactttgggggcttggcttagcgctctgctgtttacccgtctctcctcgctgcctcggaaccaaagctcccggccccctccgccctcgcgcgcccacccaccgccgccggggagcggcccggcccgcactcagcacccgactcggaccgatg

SEQ ID NO: 991 - DNA, 203 bp, Homo sapiens
ggcgcgccagtcctccggcttccccgccccgccccgtccccgggcgtctccattttggtctcaggtgtggactcggcaagaaccagcgcaagagggaagcagagttatagctaccccggccgcggagccggctcactgcactacccccgcccccttctttcctccagacgccgaagtcgcgggcgctccgactcggaccgatg

SEQ ID NO: 992 - DNA, 203 bp, Homo sapiens
ggcgcgccagtcctgccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagaccgactcggaccgatg

SEQ ID NO: 993 - DNA, 203 bp, Homo sapiens
ggcgcgccagtcctatgcaggccttcccacaagggcccggcagcatgacaaggtgaaggcagagtatgtgcatctcaaccatccgctcaccctcgtgaccagagagcgcgatttggccgtgaaggagaaacaccagctccaagccaagctggagaacctagaacaggtcctgaagcatatgcgagaggcgactcggaccgatg

SEQ ID NO: 994 - DNA, 203 bp, Homo sapiens
ggcgcgccagtcctaggcccagtggccgagcggcgtcgtggggttaccccgcccgcgccagcgctgcatccctggccgctacccggggagagccggaggatgaattgaacctcgcagccgctgctatctccagtgctcatcacagggtgtggtgtctatctgaagaatattttactttcaaaggaaagcgactcggaccgatg

SEQ ID NO: 995 - DNA, 203 bp, Homo sapiens
ggcgcgccagtcctactacttctcccccggactccttggtagtctgttagtgggagatccttgttgccgtcccttcgcctccttcaccgccgcagaccccttcaagttctagtcatgcgtgagtgcatctccatccacgttggccaggctggtgtccagattggcaatgcctgctgggagctctactgcgactcggaccgatg

SEQ ID NO: 996 - DNA, 203 bp, Homo sapiens
ggcgcgccagtcctagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttcgactcggaccgatg

SEQ ID NO: 997 - DNA, 203 bp, Homo sapiens
ggcgcgccagtcctcggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaaggcgactcggaccgatg

SEQ ID NO: 998 - DNA, 203 bp, Homo sapiens
ggcgcgccagtcctatatggaggtgaagggtgagatcgggaaacaaagggtatggccccctagttcccaaagggagcagggagatgggaatagaattgaaggtaggttttaggctacttgggaggaggaatatttaggtaattgtggagactttctcctgtgtgatgaaggcggcagacactgtgatccgactcggaccgatg

SEQ ID NO: 999 - DNA, 203 bp, Homo sapiens
ggcgcgccagtcctattttctttttttttttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtagattggttgtttcattcgactcggaccgatg

SEQ ID NO: 1000 - DNA, 203 bp, Homo sapiens
ggcgcgccagtcctgcccgtccccgtcccctgcggccgccaacgccgcccggactggagccctgacattgctgcgctcggggggctccaggcagcccgtatcggggcctttatttctcgtcggcggcgccctgcaccgcgcctcgcaaagccaaacaccagagcaccctagaaggtttaactaaaagacgactcggaccgatg

SEQ ID NO: 1001 - DNA, 203 bp, Homo sapiens
ggcgcgccagtcctgagtattgcctttggcccccacccccacgggtccccgcgctccgtcttccttctgactgggggactccgcgggacggcgttcccggcgcgcactgtaccccttgccgccccttccccttcatgttggacctgacctcccgcggacaagtggggacgtcccggaggatggccgagcgactcggaccgatg

SEQ ID NO: 1002 - DNA, 203 bp, Homo sapiens
ggcgcgccagtcctggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaacgactcggaccgatg

SEQ ID NO: 1003 - DNA, 203 bp, Homo sapiens
ggcgcgccagtcctgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagcatccgactcggaccgatg

SEQ ID NO: 1004 - DNA, 203 bp, Homo sapiens
ggcgcgccagtcctcagccctaggccctgcgcgagctgccccgccctaccccctccagcgtcctgtcgcctcctcgcccgacttcggcctgtccctctctcacgcgctcagtcctcgctcttcgccccccgcagctatcggcactcggtctcccgcgcctggcgggctccgcccgagcctctgggccccgactcggaccgatg

SEQ ID NO: 1005 - DNA, 203 bp, Homo sapiens
ggcgcgccagtcctacctgttgtctctcacctctacattggatcacatggtcacctgcctcatggaaatgccttttttaaaacttcgatttgcagaactccactatttttatacctagctacagttttgagaaagaagaatcagaaccctgacccacttacggttgctgggacaattccccctcccgccgactcggaccgatg

SEQ ID NO: 1006 - DNA, 203 bp, Homo sapiens
ggcgcgccagtcctagatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccgactcggaccgatg

SEQ ID NO: 1007 - DNA, 203 bp, Homo sapiens
ggcgcgccagtcctccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggcgactcggaccgatg

SEQ ID NO: 1008 - DNA, 203 bp, Homo sapiens
ggcgcgccagtcctctccgactctcggcacctggcctccagctttcggaactatggaggccgcgcccgggacccccccgccgccgccatcagagtcgccgccgccgccatcgccgccgccgccatcaacgccttcgcctcctccgtgttcccccgacgcccgcccggccaccccgcacctcctccacccgactcggaccgatg

SEQ ID NO: 1009 - DNA, 203 bp, Homo sapiens
ggcgcgccagtcctcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtacccccgcgcgccggcggtggagctcctgcagacgactcggaccgatg

SEQ ID NO: 1010 - DNA, 203 bp, Homo sapiens
ggcgcgccagtcctcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttcgactcggaccgatg

SEQ ID NO: 1011 - DNA, 203 bp, Homo sapiens
ggcgcgccagtcctcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatcgactcggaccgatg

SEQ ID NO: 1012 - DNA, 203 bp, Homo sapiens
ggcgcgccagtccttggatttgtctttctcagcaccttggcgaagccttgggtttctttcttaaaggactgatttttagaactccacatttgagtgtgaagtgagggggtctctctccctccttctccttcctctgtgattcaccttcctttttaccctgccctgcggcggctccgccccttaccttccgactcggaccgatg

SEQ ID NO: 1013 - DNA, 203 bp, Homo sapiens
ggcgcgccagtcctcacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggccgactcggaccgatg

SEQ ID NO: 1014 - DNA, 203 bp, Homo sapiens
ggcgcgccagtccttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgcgactcggaccgatg

SEQ ID NO: 1015 - DNA, 203 bp, Homo sapiens
ggcgcgccagtcctcccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctggattgaacaggagggtgtcacagtgaagagcacgactcggaccgatg

SEQ ID NO: 1016 - DNA, 203 bp, Homo sapiens
ggcgcgccagtccttgcccgagtgagcggggggcctgggcctctgcccttaggaggcaactcccacgcaggccgcaaaggcgctctcgcggccgagaggcttcgtttcggtttcgcggcggcggcggcgttgttggctgaggggacccgggacacctgaatgcccccggccccggctcctccgacgcgcgactcggaccgatg

SEQ ID NO: 1017 - DNA, 203 bp, Homo sapiens
ggcgcgccagtcctggcgtgccacctcgccgcgcagctttacgaacctagagcagcgccgccccgcctcctgtctccgtcctcacctccccgccccctcccagcttcgcgtctcctagctcgacgcgcccgctataatcacgtgattgcctcatccgggtcttttgcgttctctttccctctcccaaccgactcggaccgatg

SEQ ID NO: 1018 - DNA, 203 bp, Homo sapiens
ggcgcgccagtcctgcgtgctgactgagctagtcttggggtcctggagaagggggctggaggcatgcccacagcctcccccccatgagcttggggctggcgagggcacaggaggtggagctgacactagagacggttatccagacactggagagcagcgtcctgtgccaggagaaaggcttgggcgcgcgactcggaccgatg

SEQ ID NO: 1019 - DNA, 203 bp, Homo sapiens
ggcgcgccagtcctgagccgctggcgccactagagaagggcgagcggcgcggcagagtgcggcgcagcgcagctcctgaggttttggttatgaacaggattcggattcacgtcttgccaaccaatcgggggaggatcactccagtgcccaggtctcaggaacctctgtcttgtgcattcactcatcgtcgactcggaccgatg

SEQ ID NO: 1020 - DNA, 203 bp, Homo sapiens
ggcgcgccagtcctggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgcgactcggaccgatg

SEQ ID NO: 1021 - DNA, 203 bp, Homo sapiens
ggcgcgccagtcctcgattcaggggagggagcaactggagcctcaggccctccagagtagtctgcctgaccaccctggagcccacagaagcccaggacgtctcccgcgaagcctccccgtgtgtggctgaggatggctgagcagcagggccgggagcttgaggctgagtgccccgtctgctggaaccccgactcggaccgatg

SEQ ID NO: 1022 - DNA, 203 bp, Homo sapiens
ggcgcgccagtcctttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaacgactcggaccgatg

SEQ ID NO: 1023 - DNA, 203 bp, Homo sapiens
ggcgcgccagtcctgcggcagtagcagcagcgccgggtcccgtgcggaggtgctcctcgcagagttgtttctcgagcagcggcagttctcactacagcgccaggacgagtccggttcgtgttcgtccgcggagatctctctcatctcgctcggctgcgggaaatcgggctgaagcgactgagtccgcgcgactcggaccgatg

SEQ ID NO: 1024 - DNA, 203 bp, Homo sapiens
ggcgcgccagtcctctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagccgactcggaccgatg

SEQ ID NO: 1025 - DNA, 203 bp, Homo sapiens
ggcgcgccagtcctcggcgccggaggaggaagtggtgaggttgttgctccttcagcgcctatcgctggctcttggggcgcagagaggggccgcagtctccgcggctgcgtcgagctcccttgcagtcccctccatgttccccggcgccactactccccttcctaaggccgccgcttaccccggggtctcgactcggaccgatg

SEQ ID NO: 1026 - DNA, 203 bp, Homo sapiens
ggcgcgccagtcctaagcagttccgggaaaccccgcgtgctgccgggatcgcgtctcagtccatcaggggggggagggggtggcgcgcgcgccatttctagtcgttttcaaagcgcctcgcgctgattctcacgggcccggctgccggcccccgctctgccctgcataataaaatggctaatcaggtgcgactcggaccgatg

SEQ ID NO: 1027 - DNA, 203 bp, Homo sapiens
ggcgcgccagtcctgcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacccgactcggaccgatg

SEQ ID NO: 1028 - DNA, 203 bp, Homo sapiens
ggcgcgccagtcctcgaaggaacctgacccaggctctgtgaggaggcaaggttttcaggggacaggccaacccagaggacaggattccctggaggccacagaggagcaccaaggagaagatctgcctgtgggtcttcattgcccagctcctgcccacactcctgcctgctgccctgacgagagtcatccgactcggaccgatg

SEQ ID NO: 1029 - DNA, 203 bp, Homo sapiens
ggcgcgccagtcctgttggtgacgtcaccgcgttcaccagcccggaagtgcgcgtggcggcggtggcggctgcggcaacagcggggccgatgtgtagttggtgactgcctctccagatgctgaggtgcctgtatcattggcacaggccagtgctgaaccgtaggtggagtaggctgtgccttctgaagcgactcggaccgatg

SEQ ID NO: 1030 - DNA, 203 bp, Homo sapiens
ggcgcgccagtcctcggcgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagcgactcggaccgatg

SEQ ID NO: 1031 - DNA, 203 bp, Homo sapiens
ggcgcgccagtcctgcttttgctgcttcctcattttctcttgcagccgccatgattctgaggccttcccagctatgtggaactatgactgtgatgatcctcttgtgtctgccttgcctcaggcatccttcagcagttcttccgagctctccagcagtcatggtcctggatttgcaaggctgaatagaacgactcggaccgatg

SEQ ID NO: 1032 - DNA, 203 bp, Homo sapiens
ggcgcgccagtcctgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttccgactcggaccgatg

SEQ ID NO: 1033 - DNA, 203 bp, Homo sapiens
ggcgcgccagtcctcggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcgactcggaccgatg

SEQ ID NO: 1034 - DNA, 203 bp, Homo sapiens
ggcgcgccagtcctgtggtgggactcgcgtcgcggccgcggagacgtgaagctctcgaggctcctcccgctgcgggtcggcgctcgccctcgctctcctcgccctccgccccggccccggccccgcgcccgccatggagaagactgagctgatccagaaggccaagctggccgagcaggccgagcgctcgactcggaccgatg

SEQ ID NO: 1035 - DNA, 203 bp, Homo sapiens
ggcgcgccagtcctgagtgctcgcagctcatacctgtggctgtgtatccgtggccacagctggttggcgtcgccttgaaatcccaggccgtgaggagttagcgagccctgctcacactcggcgctctggttttcggtgggtgtgccctgcacctgcctcttcccccattctcattaataaaggtatcccgactcggaccgatg

SEQ ID NO: 1036 - DNA, 203 bp, Homo sapiens
ggcgcgccagtcctctgccggctgagcgggcctggaggaagtgagcagcggggctcctgcctcccggcctggtccccgaagaccccagaagaacccggaacttgcttccattcggaatccagggaccaccctttgcactcagtaggcctttgttttcctgcgtggaaagcggttgggcttgggaggcgcgactcggaccgatg

SEQ ID NO: 1037 - DNA, 203 bp, Homo sapiens
ggcgcgccagtcctgctgtcagcctccctggctgttagtaccttctttcccggagtcctggtccacgagttggatttactgctgtcgcgggtgggcctcacgccattccctgtccctcggccccctgagtgagtccggtctcccggcgaaagtgagcgaggtttgcccggagcgcgcacgaggggaaacgactcggaccgatg

SEQ ID NO: 1038 - DNA, 203 bp, Homo sapiens
ggcgcgccagtccttccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggcgactcggaccgatg

SEQ ID NO: 1039 - DNA, 203 bp, Homo sapiens
ggcgcgccagtcctgcgcaactcattggcgccaagatggcgatggagatgaggcttccagtggctcgcaagcctcttagcgagagactgggccgcgacactaagaaacatctagtggtgccgggggatacaatcactacggacacaggattcatgcggggccatggaacgtatatgggagaagagaagcgactcggaccgatg

SEQ ID NO: 1040 - DNA, 203 bp, Homo sapiens
ggcgcgccagtcctggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacgactcggaccgatg

SEQ ID NO: 1041 - DNA, 203 bp, Homo sapiens
ggcgcgccagtcctgggctcgggtaaccggagtgctggtatctaatcgtcgctcaaaagctcctaggtgcgcgggtggatataattcccggcttctcgagaagacactacagcctcaaggaggtatatcccgtgccttacctgactgggggctctgagtccagttgtgttgtcttcaacttagacacccgactcggaccgatg

SEQ ID NO: 1042 - DNA, 203 bp, Homo sapiens
ggcgcgccagtcctaagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgccgactcggaccgatg

SEQ ID NO: 1043 - DNA, 203 bp, Homo sapiens
ggcgcgccagtccttggcgtggagagtttggggatctacagcagccaaaggcttgtccctgactttatatggctgctcctggcgagcgactgagtcgtccgtgaggaaaaagaggcgaggcttttccgagatcgtctcagcgatggcgcttcggtcgcggttttgggggttgttctcggtttgcaggacgactcggaccgatg

SEQ ID NO: 1044 - DNA, 203 bp, Homo sapiens
ggcgcgccagtcctcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctcgactcggaccgatg

SEQ ID NO: 1045 - DNA, 203 bp, Homo sapiens
ggcgcgccagtcctaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgccgactcggaccgatg

SEQ ID NO: 1046 - DNA, 203 bp, Homo sapiens
ggcgcgccagtccttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacaccgactcggaccgatg

SEQ ID NO: 1047 - DNA, 203 bp, Homo sapiens
ggcgcgccagtcctgcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcgactcggaccgatg

SEQ ID NO: 1048 - DNA, 203 bp, Homo sapiens
ggcgcgccagtcctaatttgaattggggcgtgtctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgcgactcggaccgatg

SEQ ID NO: 1049 - DNA, 203 bp, Homo sapiens
ggcgcgccagtcctcgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaacgactcggaccgatg

SEQ ID NO: 1050 - DNA, 203 bp, Homo sapiens
ggcgcgccagtcctgcctccgcgcgccaaagtcaaaccccgacacccgccggcgggccggtgagctcactagctgacccggcaggtcaggatctggcttagcggcgccgcgagctccagtgcgcgcacccgtggccgcctcccagccctctttgccggacgagctctgggccgccacaagactaaggacgactcggaccgatg

SEQ ID NO: 1051 - DNA, 203 bp, Homo sapiens
ggcgcgccagtcctcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaagggttgaatgcaccctcaggcacgacccgactcggaccgatg

SEQ ID NO: 1052 - DNA, 203 bp, Homo sapiens
ggcgcgccagtcctccacgctcgtgccgctccccccccgcgctcccagttgacgctctgggccgccacctccgcggaccctgagcgcaagagccaagccgccagcgctgcgatgtgggccacgctgccgctgctctgcgccggggcctggctcctgggagtccccgtctgcggtgccgccgaactgtgcgactcggaccgatg

SEQ ID NO: 1053 - DNA, 203 bp, Homo sapiens
ggcgcgccagtcctgaaaacctgaatacggaactgaagcagcagctcagtttctcactccgaagtggcagcagccagagagggagtcggtgtggacgcgaggagccgggcgcttagaacagaggcttgcacaggtggagatgtggaagtctgtagtgggccatgatgtgtctgtttccgtggagaccccgactcggaccgatg

SEQ ID NO: 1054 - DNA, 203 bp, Homo sapiens
ggcgcgccagtcctaacgctcagcgaaattgactgccccactgtcatctgcctctcaatttggtactctgtaactctgtgaccaccaagaagcctttttccgtcccccacaaagctctttttggaaaattccctacgggagctgaattttaagcccatttactttataggaagaaacagaaaggcagccgactcggaccgatg

SEQ ID NO: 1055 - DNA, 203 bp, Homo sapiens
ggcgcgccagtcctgcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagcgactcggaccgatg

SEQ ID NO: 1056 - DNA, 203 bp, Homo sapiens
ggcgcgccagtcctgtgttcctcttttcctcggttcccagtgttctggcaggtaaggaacgccggctcttcgcctctcagcgcggcttgtcctttgttccggacgcccgctcctcagccctgcggctcctggggtcgctgctgcatcccgcacgcctccaccggctgcagacccatggccgagcgcggcgactcggaccgatg

SEQ ID NO: 1057 - DNA, 203 bp, Homo sapiens
ggcgcgccagtcctggaagaagaaagaaaaaggaccagaaccgtgaactgaagggacagggaacagccagacgagagcttcagccatcacgaggatgatttcggaacctggagaaaatgtaagttaaatatatctacactctgatcctatctcaagagagagatattttactcatttcctggttgtgacgactcggaccgatg

SEQ ID NO: 1058 - DNA, 203 bp, Homo sapiens
ggcgcgccagtcctcagttcctgcgcgtgcgcgcttggcctccctagtgcgggctggcagtgcgggcagagcccggctgagaggggcggccctggaggagacggaggccgcgggtgggcccgaggcgcaagaggaagatgaggacgaagaagaggcgctgccgcactccgaggccatggacgtgttcccgactcggaccgatg

SEQ ID NO: 1059 - DNA, 203 bp, Homo sapiens
ggcgcgccagtccttcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcagcgactcggaccgatg

SEQ ID NO: 1060 - DNA, 203 bp, Homo sapiens
ggcgcgccagtcctaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgcccgactcggaccgatg

SEQ ID NO: 1061 - DNA, 203 bp, Homo sapiens
ggcgcgccagtcctagggactgttctcttcagtgagtggcaggtgtccggaggctgcactgcagcgtagccgcttgggcgggcggccagtggcgactacagcagggactggctgccaacccctccggctacgggccccttaccgagctcccagactggtcatatgcggatggccgccctgctcccccacgactcggaccgatg

SEQ ID NO: 1062 - DNA, 203 bp, Homo sapiens
ggcgcgccagtcctggagggccctgagggaggggtcagacgctttaggaaagagttaatgcgaagagggggaggggataggacgaagaaaccgaagggaaagctcagggccgccaacttccagctgcagcggcgactttcagtttcatttccacggaccctcctgcctgggccgcagccgccgccgcgcgactcggaccgatg

SEQ ID NO: 1063 - DNA, 203 bp, Homo sapiens
ggcgcgccagtccttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagacgactcggaccgatg

SEQ ID NO: 1064 - DNA, 203 bp, Homo sapiens
ggcgcgccagtccttgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatccgactcggaccgatg

SEQ ID NO: 1065 - DNA, 203 bp, Homo sapiens
ggcgcgccagtcctggaaaaccgcagcggggtagcgcgggcgctgccggaacttgtagttccacctcccgccgcgctaaatagccggaaacgggggcggccagaacagagaactaccgaggcgaagcacctgtggaatcctctcaagaggaacagtcattgtgtgaaggttcaaattcagctgttagccgactcggaccgatg

SEQ ID NO: 1066 - DNA, 203 bp, Homo sapiens
ggcgcgccagtcctggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctcgactcggaccgatg

SEQ ID NO: 1067 - DNA, 203 bp, Homo sapiens
ggcgcgccagtcctcttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatcgactcggaccgatg

SEQ ID NO: 1068 - DNA, 203 bp, Homo sapiens
ggcgcgccagtcctcgccgtcatttcggagcgactcagcgcctgcccgccctctcgccgcgtcgccggtgcctgcgcctcccgctccacctcgcttcttctctcccggccgaggcccgggggaccagagcgagaagcggggaccatgttccgacgcaagttgacggctctcgactaccacaaccccgccgactcggaccgatg

SEQ ID NO: 1069 - DNA, 203 bp, Homo sapiens
ggcgcgccagtcctgcagcccagctgacgacagaccacagcggcatccggcagcccccagtcgtcgtcacacacggtgccccacaggccactgtgcaggatctccactcggccctgacacagggtggagccagccatcctgagacgtccgtacagcccgtactggtggagtgtcaggaggccactctgcgactcggaccgatg

SEQ ID NO: 1070 - DNA, 203 bp, Homo sapiens
ggcgcgccagtccttgcaggtaccatggagctgagctataggctcttcatctgcctcctgctctggggtagtactgagctgtgctacccccaacccctctggctcttgcagggtggagccagccatcctgagacgtccgtacagcccgtactggtggagtgtcaggaggccactctgatggtcatggtcgactcggaccgatg

SEQ ID NO: 1071 - DNA, 203 bp, Homo sapiens
ggcgcgccagtcctagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccacccgactcggaccgatg

SEQ ID NO: 1072 - DNA, 203 bp, Homo sapiens
ggcgcgccagtcctgtcctcagttccttagtgactctaaataaagtaacagcagacatcgggctggggagtgactccgtgtgtgcccggccctcgtctcaccgcataaagtcttttgactcccttggatcacagtctttgcacactcggacttcaaaactgttccagggccagtatcggagtttggaccgactcggaccgatg

SEQ ID NO: 1073 - DNA, 203 bp, Homo sapiens
ggcgcgccagtcctagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattcgactcggaccgatg

SEQ ID NO: 1074 - DNA, 203 bp, Homo sapiens
ggcgcgccagtcctccagctcgggccttagaacttctgaacgggcagtgcgggtaggccctgcttagcccttcccggaggacacctgaccaaaagaggaagatagtcttgggacccttgcatggtgtttcaaagggtggtgaagaactaaggtagaagaatacatgttcacttccagtgaacaagagccgactcggaccgatg

SEQ ID NO: 1075 - DNA, 203 bp, Homo sapiens
ggcgcgccagtcctaggtttccgcttccgctcttccctggtccagtccaccctggcggggtcgcagggttgggatggcggctggaggcgatcatggttcgcccgacagctaccgctcacctcttgcctcccgctatgccagcccggagatgtgcttcgtgtttagcgacaggtataaattccggacatcgactcggaccgatg

SEQ ID NO: 1076 - DNA, 203 bp, Homo sapiens
ggcgcgccagtcctgattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaacgactcggaccgatg

SEQ ID NO: 1077 - DNA, 203 bp, Homo sapiens
ggcgcgccagtcctccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgcgactcggaccgatg

SEQ ID NO: 1078 - DNA, 203 bp, Homo sapiens
ggcgcgccagtcctgacaccccctgggatcacactgagcttgccacatccccaaggcggccgaaccctccgcaaccaccagcccaggttaatccccagaggctccatggagttccctggcctggggtccctggggacctcagagcccctcccccagtttgtggatcctgctctggtgtcctccacacccgactcggaccgatg

SEQ ID NO: 1079 - DNA, 203 bp, Homo sapiens
ggcgcgccagtcctgggtgcgagctggagactccgcgggagcgcggccgggaggcttcgccccggagctggcccgacgcctcccgagctggcagggctctcggcggaggtcggagcgtgggcttcctcctcccgccagggaaaacagagaggatgaaggcctatctaaagagcgcagaaggcttttttcgactcggaccgatg

SEQ ID NO: 1080 - DNA, 203 bp, Homo sapiens
ggcgcgccagtcctgccccgcacgcactggcgagctgggagcgccaccacggctttcaaaaaacccgcacacaccaagataataatgtgtcgttcgctcgtttcgcgcaagcggagtcgcgtccgccttcccgagctccggcacacagacctcaggccgctctcgcgctctccggggccccgagaacacgactcggaccgatg

SEQ ID NO: 1081 - DNA, 203 bp, Homo sapiens
ggcgcgccagtcctggcaggtggtagccttcccgcccttctggcctctccatcccctgctgcgggggaccgcgcaagcgcagtgagtactgcacgttgtcgcgggccagtaacgtcatcagacgtgtgtgtgtccctgcggcgctaagaaggggagactgaggctgaggctggggaacatcgggcagccgactcggaccgatg

SEQ ID NO: 1082 - DNA, 203 bp, Homo sapiens
ggcgcgccagtcctaggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggccgccatggcatcagatgaaggcaaactttcgactcggaccgatg

SEQ ID NO: 1083 - DNA, 203 bp, Homo sapiens
ggcgcgccagtccttcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacaggggatgtccagctcgccgctgtccaacgactcggaccgatg

SEQ ID NO: 1084 - DNA, 203 bp, Homo sapiens
ggcgcgccagtccttgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtcccccgactcggaccgatg

SEQ ID NO: 1085 - DNA, 203 bp, Homo sapiens
ggcgcgccagtcctagtttcgtccgagctcagtagagttttgctgttaagactgcgcgaggagctagagagagcggagagcgctgagccgggccgcacccgccgagccgtcttgatactgatggacattgtgtgggccagaggcagggatggttggctatgaccccaaaccagatggcaggaataacacgactcggaccgatg

SEQ ID NO: 1086 - DNA, 203 bp, Homo sapiens
ggcgcgccagtcctggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactcgactcggaccgatg

SEQ ID NO: 1087 - DNA, 203 bp, Homo sapiens
ggcgcgccagtcctgacagcggcgtggcggcggcggtggcggtagcgacggcacgccgtagggcggtcagaaggtttccggttccggtgtaacgttcgggctccgtctcaggggctgaagtttgtgaggtgtagtattgagtcctgtttgagctattgttctctttttcctgaaaaatggcactgtcacgactcggaccgatg

SEQ ID NO: 1088 - DNA, 203 bp, Homo sapiens
ggcgcgccagtcctaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagcccgactcggaccgatg

SEQ ID NO: 1089 - DNA, 203 bp, Homo sapiens
ggcgcgccagtcctaacgcaggggcggaaccgcatgactggcagtggcatcagcgatggcggctgcgtcggggtcggttctgcagcgctgtatcgtgtcgccggcagggaggcatagcgcctctctgatcttcctgcatggctcaggtgattctggacaaggattaagaatgtggatcaagcaggtttcgactcggaccgatg

SEQ ID NO: 1090 - DNA, 203 bp, Homo sapiens
ggcgcgccagtcctcctcccgccggcccgcgccgctgcactcgccctctcctctcgccccccggcaaactttcggcccctccccgcccctcgcccgttattcgtcgtggctcaagcccggccacgccgccccaagggctcctcccgacctcccggcctgccgctccggccactgcgggatccagaaaccgactcggaccgatg

SEQ ID NO: 1091 - DNA, 203 bp, Homo sapiens
ggcgcgccagtcctctcaacctccgtggctagtcttgacgtggcgggttgctttccaaaatggcgcgggtgctgaaggctgcagccgcgaatgccgtagggcttttttccagacttcaagctcccattccaacagtaagagcttcttccacatcacagcccttggatcaagtgacaggttctgtgtggcgactcggaccgatg

SEQ ID NO: 1092 - DNA, 203 bp, Homo sapiens
ggcgcgccagtcctaaaggaaccgggttgtcttgggccgggcagggcgggtggtgactctcaaaaggaaataggatcatggcagcagatgatgacaatggtgatggaacaagtttatttgatgtcttttctgcttctcctcttaagaacaatgatgaaggctcactggacatatacgctgggttggaccgactcggaccgatg

SEQ ID NO: 1093 - DNA, 203 bp, Homo sapiens
ggcgcgccagtcctgcttttcaccctctaccctcccctcagcctggccttttcttccgccctcacagccaccgcgacccaacgctgaggaaagaccccgacttgtggtgtccttccccttgcccaaactggccacgaaaggacatatagcgagagagaaagaggattttctgccgtctcttggcaaaacgactcggaccgatg

SEQ ID NO: 1094 - DNA, 203 bp, Homo sapiens
ggcgcgccagtcctcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtccgactcggaccgatg

SEQ ID NO: 1095 - DNA, 203 bp, Homo sapiens
ggcgcgccagtcctagttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccgcgactcggaccgatg

SEQ ID NO: 1096 - DNA, 203 bp, Homo sapiens
ggcgcgccagtcctctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggcgactcggaccgatg

SEQ ID NO: 1097 - DNA, 203 bp, Homo sapiens
ggcgcgccagtcctgactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgcccgactcggaccgatg

SEQ ID NO: 1098 - DNA, 203 bp, Homo sapiens
ggcgcgccagtcctataacacccggccccgccgggcggccgcgggtgggtagaggtgcgcgcctgggacctgaacatggacttcccgtgcctctggctagggctgttgctgcctttggtagctgcgctggatttcaactaccaccgccaggaagggatggaagcgtttttgaagactgttgcccaaaacgactcggaccgatg

SEQ ID NO: 1099 - DNA, 203 bp, Homo sapiens
ggcgcgccagtcctgatgatgtcagcactgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgcgactcggaccgatg

SEQ ID NO: 1100 - DNA, 203 bp, Homo sapiens
ggcgcgccagtcctgcgtcacgcagcgcacgtcgccgcgcgcctgcgctcttttccacgtgcgaaagccccggactcgtggagttgtgaacgccgcggactccggagccgcacaaaccagggctcgccatgaagccaggattcagtccccgtgggggtggctttggcggccgagggggctttggtgaccgactcggaccgatg

SEQ ID NO: 1101 - DNA, 203 bp, Homo sapiens
ggcgcgccagtcctaggaaggaagtggggccctgcggcgcccagccaccccctgacggcttccccacgggaggacgcgaggccccggcccagccatggccccctggcgcaaagctgacaaggagcggcacggcgtggccatatacaacttccaaggcagcggagccccccagctctccctgcagatcgcgactcggaccgatg

SEQ ID NO: 1102 - DNA, 203 bp, Homo sapiens
ggcgcgccagtcctacagcatggagtggggttacctgttggaagtgacctcgctgctggccgccttggcgctgctgcagcgctctagcggcgctgcggccgcctcggccaaggagctggcatgccaagagatcaccgtgccgctgtgtaagggcatcggctacaactacacctacatgcccaatcagtcgactcggaccgatg

SEQ ID NO: 1103 - DNA, 203 bp, Homo sapiens
ggcgcgccagtcctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatcgactcggaccgatg

SEQ ID NO: 1104 - DNA, 203 bp, Homo sapiens
ggcgcgccagtcctcgaagtcgctgcgctcagtgcgcaggcgcgaagaagctggcaggggcacgagccgggggcgggtttgaagacgcgtcgttgggttttggaggccgtgaaacagccgtttgagtttggctgcgggtggagaacgtttgtcaggggcccggccaagaaggaggcccgcctgttacgcgactcggaccgatg

SEQ ID NO: 1105 - DNA, 203 bp, Homo sapiens
ggcgcgccagtcctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacagtcgactcggaccgatg

SEQ ID NO: 1106 - DNA, 203 bp, Homo sapiens
ggcgcgccagtcctgccaggttactggccactgctcacctaggcgctagcaaacttctgccaagatcggaactgagtactaaacagcctccacagttctccctggtgccgtctccggcttggcgccgcatcctcctctgggctcgcgatggccgcgtcccctcccgctgcggacgggtcctttggtaccgactcggaccgatg

SEQ ID NO: 1107 - DNA, 203 bp, Homo sapiens
ggcgcgccagtcctagtgctaagcaaatacaggaaccaaaaaggtttatagaggctgccttatgctgtctcatccagttcctttgcggtcctcttcttcagcacatgccaaagctgttcctcacggcctgtgagacaagagcatcttggatgtaggacaatggaagagttagatgccttattggaggacgactcggaccgatg

SEQ ID NO: 1108 - DNA, 203 bp, Homo sapiens
ggcgcgccagtcctcggcgcctataaagtcgccctccgcccggacgtaaacaaacctcgcctggctcccagctggtgctgaagctcgtcagttcaccatccgccctcggcttccgcggggcgctgggccgccagcctcggcaccgtcctttcctttctccctcgcgttaggcaggtgacagcagggaccgactcggaccgatg

SEQ ID NO: 1109 - DNA, 203 bp, Homo sapiens
ggcgcgccagtcctgagtcctgctagatccccgcaagctaggccagctcctcccactgcctcccttcctctttctcctcctcttactcctttccagccagaccttggctgtctacaggatgggggacaccctgagccccggacatggcaaccacagagagagcagcccttttctttcccccttggaggcgactcggaccgatg

SEQ ID NO: 1110 - DNA, 203 bp, Homo sapiens
ggcgcgccagtcctagcacccgtaggtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcgactcggaccgatg

SEQ ID NO: 1111 - DNA, 203 bp, Homo sapiens
ggcgcgccagtcctcgaaggggcgtggccaagcgcaccgcctcggggcggggccggcgttctagcgcatcgcggccgggtgcgtcactcgcgaagtggaatttgcccagacaagcaacatggctcggaaacgcgcggccggcggggagccgcggggacgcgaactgcgcagccagaaatccaaggccacgactcggaccgatg

SEQ ID NO: 1112 - DNA, 203 bp, Homo sapiens
ggcgcgccagtcctaagtgtgcagcagatcttcttccgggcggacgtggagccggaagcggaggttccgggctccgggatgaaaggagggaacgcagacagctggcagagagagaagttggctagcatggaatcaccagaggagcctggagcatccatggatgagaactactttgtgaactacactttcgactcggaccgatg

SEQ ID NO: 1113 - DNA, 203 bp, Homo sapiens
ggcgcgccagtcctccgccgcggtcgaggatcctggaggtttgtccccgccgccccgacgcttccgccgggtccgtcggcacgtcggccctgcctcccggaccaccctgcggggcgcaccagcgatctggggtgcggggctcggcctccctgcgctcctggctgacggtgtgaccttgggtcttaacccgactcggaccgatg

SEQ ID NO: 1114 - DNA, 203 bp, Homo sapiens
ggcgcgccagtcctaggcatcggcgcggtcagcctcgtcgcgcgcccacgcccccacgccggctcttcccggggtccttccgtgcgcgttgatatgattggccggcgaatcgtggttctcttttcctccttggctgtctgaagatagatcgccatcatgaacgacaccgtaactatccgcactagaaacgactcggaccgatg

SEQ ID NO: 1115 - DNA, 203 bp, Homo sapiens
ggcgcgccagtcctcaacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccggcgactcggaccgatg

SEQ ID NO: 1116 - DNA, 203 bp, Homo sapiens
ggcgcgccagtccttgcattttgctccggagcgtccagagtcctggccctgagcgggaatcgcagtggccgaggctgagcggcaggcggatcgccccgaccctcactcctggcgtctgagtctctggcgtagcccatgctgagtgggcggctggtcctgggtctggtctccatggctggccgcgtttgcgactcggaccgatg

SEQ ID NO: 1117 - DNA, 203 bp, Homo sapiens
ggcgcgccagtcctgtcttaaccatgaacttctctggaggagggaggcaggaagcagcagggtccaggggtagaagggctcccagaccccgagaacaggaccgagacgtgcagctgtccaaggctctgtcctatgccctgcgccatggggccttgaagctggggcttcccatgggagctgatggcttccgactcggaccgatg

SEQ ID NO: 1118 - DNA, 203 bp, Homo sapiens
ggcgcgccagtcctagtcatccccaaaacgaggggatatcagcttaccgaggccgcaggttttcctagtccctacctcatagatatgtaggacatccccgggcccggaatgcggctctctgaccctctctgtgccctcccccgccccccgaaccaggcttggcgggcggaggcgccagcggatgtctccgactcggaccgatg

SEQ ID NO: 1119 - DNA, 203 bp, Homo sapiens
ggcgcgccagtcctcttgccgcgctgcactccaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcccgactcggaccgatg

SEQ ID NO: 1120 - DNA, 203 bp, Homo sapiens
ggcgcgccagtcctcccccacacaccccagccgaggcccggaaggggccaggcgcgcttccgtctccgccggggatgcacggagggcggagctgcggcccgaggacgcgacgcgagcccagttccggcgaggaggccgcgccagtgacagcgatggcggcggagtcggcgctccaagttgtggagaagcgactcggaccgatg

SEQ ID NO: 1121 - DNA, 203 bp, Homo sapiens
ggcgcgccagtcctatgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagcgactcggaccgatg

SEQ ID NO: 1122 - DNA, 203 bp, Homo sapiens
ggcgcgccagtcctactggtgggaactggattttgcggctgcagaggacttccccaaattttgccacattaacagctgactgcacatctgagccccgaggtgaagcagggcctcaggtagccagggaactggttgagcagaggaaatcggagagacctttttttttgtcatgaacaggctcagtgtgacgactcggaccgatg

SEQ ID NO: 1123 - DNA, 203 bp, Homo sapiens
ggcgcgccagtcctggccgcccactgaggatctgctggctgcagcgagtggaaggacctgctcggctggaacgttttttttttttttccctcccaggcgacgtccgatgggtgtgtcgggcaggaggtgatatttgacaggctgcgcgcgggcgagctgccgcggagcacccggcaggggctgacagccgactcggaccgatg

SEQ ID NO: 1124 - DNA, 203 bp, Homo sapiens
ggcgcgccagtcctgcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgcgactcggaccgatg

SEQ ID NO: 1125 - DNA, 203 bp, Homo sapiens
ggcgcgccagtcctagtctgggacgcgccgccgccatgatcatccctgtacgctgcttcacttgtggcaagatcgtcggcaacaagtgggaggcttacctggggctgctgcaggccgagtacaccgagggggatgcgctggatgccctgggcctgaagcgctactgctgccgccggatgctgctggcccgactcggaccgatg

SEQ ID NO: 1126 - DNA, 203 bp, Homo sapiens
ggcgcgccagtcctctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgacgactcggaccgatg

SEQ ID NO: 1127 - DNA, 203 bp, Homo sapiens
ggcgcgccagtcctgattcgcccacccactgtgccaacatggcggcgcccaggtcctaattcgggaaacgtgcaccttgactaattcggttttctgtggctacgagagcaggcttggcgggcggaggcgccagcggatgtctcatgcaaggatcgtctctgtggctaagcctcactttccgctccgcccgactcggaccgatg

SEQ ID NO: 1128 - DNA, 203 bp, Homo sapiens
ggcgcgccagtccttgacaggcatgagccaccgcgcctggccccttcttttgaatgggcctccttgcgtttccgtttcaatgccccgtgctacttttttgggagccccaaggctgtactgtttgattgactcctttttttcccctttctttttaacctaaattaaagctgccactgcagagccccgcccgactcggaccgatg

SEQ ID NO: 1129 - DNA, 203 bp, Homo sapiens
ggcgcgccagtcctacttccgggcgcggcgccggcttgctgccactgcagagccccgccatggaagacacgccgttggtgatatcgaagcagaagacggaggtggtgtgcggggtccccacccaggtggtgtgtacggccttcagcagtcacatcctggtggtggtgacccagtttgggaagatgggccgactcggaccgatg

SEQ ID NO: 1130 - DNA, 203 bp, Homo sapiens
ggcgcgccagtccttccccgcgcgggttcgcgtcgcgtctgcagtggccgaggctgctgcctgccgggcagatgggtccgccttgttccggctgcagctttcgccgccggggcttgctggctgtcgggaactagtcaactggagtttttgttgacttcccacggaaacatgccctgaactgtcacagacgactcggaccgatg

SEQ ID NO: 1131 - DNA, 203 bp, Homo sapiens
ggcgcgccagtcctaaatcagcatgtttattatttttaaaaaattagggcctggattttgacaatgtcaagatttaccgtatatccctgtttgtttggatacaccagtgacgtccacttctagaagacaaagttatattacttaaacaaccaaagatggagtctcgctcttcgcccaggctggagtgccgactcggaccgatg

SEQ ID NO: 1132 - DNA, 203 bp, Homo sapiens
ggcgcgccagtcctacgcgcgcttggccgcccgacgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcgggaaaaaacgactcggaccgatg

SEQ ID NO: 1133 - DNA, 203 bp, Homo sapiens
ggcgcgccagtcctttcctcgcgttaccctccttccggacagcaccccctcccttctccggtagctcctacccctgcctgtgcgggcctcgtccccgcgcccagccctcggtgctgcctccgacagcgccgcgctctctcagccgcccccctgcccctcgggcccccctctctgctgcccctggcgcccgactcggaccgatg

SEQ ID NO: 1134 - DNA, 203 bp, Homo sapiens
ggcgcgccagtcctagagcgcgcgtcgtggaacgtcttggttgccacggcaagcgcgcgcgcgaggccttgggaacctcgggaccggcccccggcgagcgcagcggcgcccagtagtcatcttagtgggatttggggaagcaacagggctgtgtggggtaacctgccacctttaagtggaaatcagaacgactcggaccgatg

SEQ ID NO: 1135 - DNA, 203 bp, Homo sapiens
ggcgcgccagtccttggctgagttcttcctttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcgactcggaccgatg

SEQ ID NO: 1136 - DNA, 203 bp, Homo sapiens
ggcgcgccagtccttgtcccctcgcgcagtcaccgagcgcagatcccgcgctctcgattggaacgcctccccatcactcagccacactcaggggctggacgcctcactcccgtttccgagccataaaaggtctaggaccgcttcccccgagccagcagaacatccagtcatggataaaaatgagctggcgactcggaccgatg

SEQ ID NO: 1137 - DNA, 203 bp, Homo sapiens
ggcgcgccagtcctggcggggaggggccgggggcctcggggacccaagcgcgagggaaaggcctggccgagagcgggccggagcccaggcctggcgcggcggcgcccgccagaacatccagtcatggataaaaatgagctggttcagaaggccaaactggccgagcaggctgagcgatatgatgacatcgactcggaccgatg

SEQ ID NO: 1138 - DNA, 203 bp, Homo sapiens
ggcgcgccagtcctacagatccgccatgacaaaggaggagagtcggggacttgagccgtggctccgacttgggcggagcctggaggggggtggttgcgatacggggaccggagaatttgcactttaaagtccgggtctgcccgttttcgtttcacagtaaccgacgtctcaagtcagaacatccagtccgactcggaccgatg

SEQ ID NO: 1139 - DNA, 203 bp, Homo sapiens
ggcgcgccagtccttgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggcgactcggaccgatg

SEQ ID NO: 1140 - DNA, 203 bp, Homo sapiens
ggcgcgccagtcctcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaaccgactcggaccgatg

SEQ ID NO: 1141 - DNA, 203 bp, Homo sapiens
ggcgcgccagtcctagtaagccagcgtggctacgccatcacgaccggcggtggcacatgcgcaatagcgagacgctggagcgcggcgtaggtggctgccgagtcttttcctgtttagggtcttatcctggcattgagggcgccggactggcgcttttggccgacttggcattgggtgggcggcttcttcgactcggaccgatg

SEQ ID NO: 1142 - DNA, 203 bp, Homo sapiens
ggcgcgccagtccttaagtgcactttttgctgatacttcatttctaatcttgtagaaaatttcagctgtagcccttggactagaagctgaaataacagaagctgtgtacgatgcattagggtattgaagaaaattaacttttgaattaaatatttggaatataaggaaataaggaaagttgactgaaacgactcggaccgatg

SEQ ID NO: 1143 - DNA, 203 bp, Homo sapiens
ggcgcgccagtccttcaagaggcgacgaggaagcggccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagacgactcggaccgatg

SEQ ID NO: 1144 - DNA, 203 bp, Homo sapiens
ggcgcgccagtcctgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatgtttcgaaatcagtatgacaatgatgcgactcggaccgatg

SEQ ID NO: 1145 - DNA, 203 bp, Homo sapiens
ggcgcgccagtcctaccttcccggccagcggtagcaactgcagaactgcaggagactatctttctagacaaggcagttgaggaggagggagcgcttgagggggactggcctggcgtgcactccgcacctcggggacattattgcgcgtggaacggctgcttttggaagactattgcccagaagaaaagcgactcggaccgatg

SEQ ID NO: 1146 - DNA, 203 bp, Homo sapiens
ggcgcgccagtcctcctcccacctcccgggaaccctggctgagtgtgcgtgtgtgggagcgcgagagccccccgacagccaccccttggggcgcgcggctgcagttagggccttggcccctccaccagaggaaggtgctgccacgtgtctgctccttctgaacctccaggtttctgctacgttgcccccgactcggaccgatg

SEQ ID NO: 1147 - DNA, 203 bp, Homo sapiens
ggcgcgccagtccttcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagccgactcggaccgatg

SEQ ID NO: 1148 - DNA, 203 bp, Homo sapiens
ggcgcgccagtcctccgctccctggcgtgactcggcactgagagtcccgggagaagactcggcggtcgccacctcttctgtccaggcctcggccttcctgagcatctctccttcctctcccagatcgtcttctccttcagtttcaaagccagtggcgtcgcggccaccctgccgggctctctgtgaggcgactcggaccgatg

SEQ ID NO: 1149 - DNA, 203 bp, Homo sapiens
ggcgcgccagtcctccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgcccgactcggaccgatg

SEQ ID NO: 1150 - DNA, 203 bp, Homo sapiens
ggcgcgccagtccttcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacacgactcggaccgatg

SEQ ID NO: 1151 - DNA, 203 bp, Homo sapiens
ggcgcgccagtcctatggagactgaaagtgagagtagcactttaggggatgacagtgtcttctggttggagtctgaagttataatccaggtgactgactgtgaagaggaagaaagggaagagaagttcaggaagatgaagtcctcagtacattctgaagaagatgattttgttccagagctacatagacgactcggaccgatg

SEQ ID NO: 1152 - DNA, 203 bp, Homo sapiens
ggcgcgccagtcctttgagtatttccgtccaatcaaaaggagactgtaagaggaggaggaggaggagatgactggggagcgggagctggagaatactgcccagttactctagcgcgccaggccgaaccgcagcttcttggcttaggtacttctactcacagcggccgattccgaggccaactccagcacgactcggaccgatg

SEQ ID NO: 1153 - DNA, 203 bp, Homo sapiens
ggcgcgccagtcctgcgcgcgcttgggcgcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggcgactcggaccgatg

SEQ ID NO: 1154 - DNA, 203 bp, Homo sapiens
ggcgcgccagtcctagggctgaggcataaaactgccagagggtctcaaggcaggcaaagaagaaccatgaggctcatcctgcctgtgggtttgattgctaccactcttgcaattgctcctgtccgctttgacagggagaaggtgttccgcgtgaagccccaggatgaaaaacaagcagacatcataaacgactcggaccgatg

SEQ ID NO: 1155 - DNA, 203 bp, Homo sapiens
ggcgcgccagtcctcgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgacccgactcggaccgatg

SEQ ID NO: 1156 - DNA, 203 bp, Homo sapiens
ggcgcgccagtccttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagcccgactcggaccgatg

SEQ ID NO: 1157 - DNA, 203 bp, Homo sapiens
ggcgcgccagtccttgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtggtgactctcaaaaggaaataggatccgactcggaccgatg

SEQ ID NO: 1158 - DNA, 203 bp, Homo sapiens
ggcgcgccagtcctgctccgcccccgcgccgccggccctagtctgcctgttttcgactcgcgctccggctgctgtcacttggctctctggctggagcttgaggacgcaaggagggtttgtcactggcagactcgagactgtaggcactgccatggcccctgtgctcagtaaggactcggcggacatcgcgactcggaccgatg

SEQ ID NO: 1159 - DNA, 203 bp, Homo sapiens
ggcgcgccagtcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatcgactcggaccgatg

SEQ ID NO: 1160 - DNA, 203 bp, Homo sapiens
ggcgcgccagtcctgccgacttggaaatgtgaacgcaagaagcaggcttgatttttttttctccccccttctctctctctctctctctctctcttcctctctccctctttctcctctctcacccacactcacgcacacctccaaaccgcacacccagacgcacacgcataccccagcgcccggcagttcgactcggaccgatg

SEQ ID NO: 1161 - DNA, 203 bp, Homo sapiens
ggcgcgccagtcctgggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggacgactcggaccgatg

SEQ ID NO: 1162 - DNA, 203 bp, Homo sapiens
ggcgcgccagtcctgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagcccgactcggaccgatg

SEQ ID NO: 1163 - DNA, 203 bp, Homo sapiens
ggcgcgccagtcctaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggcccgactcggaccgatg

SEQ ID NO: 1164 - DNA, 203 bp, Homo sapiens
ggcgcgccagtcctcaccctcgcgatctgtcaagtctgtccccaggggaggtccccctttcgggaggaagtttttaaggggatttctcaaaatcacccccgcgcttccttcactccttccttagagccggaggtcggtgagggcccgcggaatcatctatctcgcccccgtcgcagcgcgcagggacccgactcggaccgatg

SEQ ID NO: 1165 - DNA, 203 bp, Homo sapiens
ggcgcgccagtcctctgcgtcagccagcccagctatttaagcaggctggcatcagcaaacacagcttccaaacccagggcttgcgcttgcctttgcctcttccacactaatgacagactgccccactgagaagggtctagcggagcacaggtcaccagctgggcaacattcagaaagttagtcttcctcgactcggaccgatg

SEQ ID NO: 1166 - DNA, 203 bp, Homo sapiens
ggcgcgccagtcctaaaaactgcgggaagcaggaaagagcacaacaggtttctctctatttccggtgtattgtatcctcacgtttccggagattgacgttgctcttgtgttctcgcgagaggcgggaaagggcgcagggtttgaaacatggcggacgacgtagaccagcaacaaactaccaacactgtcgactcggaccgatg

SEQ ID NO: 1167 - DNA, 203 bp, Homo sapiens
ggcgcgccagtcctaattgtatatgagcgcgagcggcgggctcttgggtcttttttagcgccatctgctcgcggcgccgcctcctgctcctcccgctgctgctgccgctgccgccctgagtcactgcctgcgcagctccggccgcctggctccccatactagtcgccgatatttggagttcttacaaccgactcggaccgatg

SEQ ID NO: 1168 - DNA, 203 bp, Homo sapiens
ggcgcgccagtcctgcggcgcagcttcagggcagcgcgggctgcagcggcggcggcggttagggctgtgtagggcgaggcctcccccttcctcctcgccatcctactcctccctcctcgtcatcctcccccttcgtcctcctcgccttcctcctcctcgtcaggctcgacccagctgtgagcggcaagcgactcggaccgatg

SEQ ID NO: 1169 - DNA, 203 bp, Homo sapiens
ggcgcgccagtcctcttgatgagcttgacaaagacgatagtacccatgagtctctgtctcaagaatcagagtcggaagaagatgggattcatgtagattcacaaaaggctcttgttttaaaagaaaagggcaataaatacttcaaacaaggaaaatatgatgaagcaattgactgctacacaaaaggccgactcggaccgatg

SEQ ID NO: 1170 - DNA, 203 bp, Homo sapiens
ggcgcgccagtcctatcgctacgcccacttggtggcctataaaggaagcgggcgaaccccggcagccctacacaacttggggcccctctcctctccagcccttctcctgtgtgcctgcctcctgccgccgccaccatgaccacctccatccgccagttcacctcctccagctccatcaagggctcctccgactcggaccgatg

SEQ ID NO: 1171 - DNA, 203 bp, Homo sapiens
ggcgcgccagtcctcgtctcggtgccagtgtcgaggttctttctgcttagctacccggagccgactacggaggaggacacctgagtttacgtctcttccatctgctgctcacctcagctgcctgggtccccgacgagagccaggtgacacttaactccgccatctgcgttttgagcactgttctcatacgactcggaccgatg

SEQ ID NO: 1172 - DNA, 203 bp, Homo sapiens
ggcgcgccagtcctggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctgggcgactcggaccgatg

SEQ ID NO: 1173 - DNA, 203 bp, Homo sapiens
ggcgcgccagtcctctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggcgactcggaccgatg

SEQ ID NO: 1174 - DNA, 203 bp, Homo sapiens
ggcgcgccagtcctgcggagcagtggaaccgagactgccccgcggagccgccgctagacttcgggctccttgaggatattcagttttgtatgtttgaatatcctctcaccatgttcagcataaagtaccattcttaatgattatcctcaacaagacaggtgtgagagggttgctgttgtattgcaatccgactcggaccgatg

SEQ ID NO: 1175 - DNA, 203 bp, Homo sapiens
ggcgcgccagtcctggggccggatccccggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccgactcggaccgatg

SEQ ID NO: 1176 - DNA, 203 bp, Homo sapiens
ggcgcgccagtcctcttcctctccaggatccccaaggctaggaggccaacctactaacagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 1177 - DNA, 203 bp, Homo sapiens
ggcgcgccagtcctagctccgcgggcccggctgggcgagtgtctggccctttaagggccgcccccgaggaggtgccaggcccgggtggcgccgtccgtccttcctggtcctgcgggtccaggactgtccgcggggttgagggaaggggccgtgcccggtgccagcccaggtgctcgcggcctggctcccgactcggaccgatg

SEQ ID NO: 1178 - DNA, 203 bp, Homo sapiens
ggcgcgccagtcctggggcaagacagctccaccaggagtcaggagtgaatcccctctgggaacgaggcactaggaagaagaacttccagcccaggagaaataacatctgctttgctgccgagctcagaggagaccccagacccctcccgcagccagagggctggagcctgctcagaggtgctttgaagcgactcggaccgatg

SEQ ID NO: 1179 - DNA, 203 bp, Homo sapiens
ggcgcgccagtcctgctgttggcagctgtgttgctgggcctggtgctgctggtggtgctgctgctgcttctgaggcactggggctggggcctgtgccttatcggctggaacgagttcatcctgcagcccatccacaacctgctcatgggtgacaccaaggagcagcgcatcctgaaccacgtgctgcacgactcggaccgatg

SEQ ID NO: 1180 - DNA, 203 bp, Homo sapiens
ggcgcgccagtcctgggagtgaacggagagcgtagtgaccatcatgttttagcacaaccccctcagaccactctgtggagaacagactgtcagggaacgtgggtggaggcagagagaccagaaagattccaggacagagatgacagaggcttaggccatggagcctcctcaacaagcccaagagtgagcgactcggaccgatg

SEQ ID NO: 1181 - DNA, 203 bp, Homo sapiens
ggcgcgccagtcctttccttacaccaatcggaacgtgcaggggtggggagctggccaatcaggcgcggagggcggggccgggcggggttccacctggcggctggctctcagtcccctcgctgtagtcgcggagctgtgtctgttcccaggagtccttcggcggctgttgtgtcgggagcctgatcgcgcgactcggaccgatg

SEQ ID NO: 1182 - DNA, 203 bp, Homo sapiens
ggcgcgccagtcctctgtgcggtcacttccggcccgggagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacacagcaatcgactcggaccgatg

SEQ ID NO: 1183 - DNA, 203 bp, Homo sapiens
ggcgcgccagtcctgtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctcgactcggaccgatg

SEQ ID NO: 1184 - DNA, 203 bp, Homo sapiens
ggcgcgccagtcctaagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatgcgactcggaccgatg

SEQ ID NO: 1185 - DNA, 203 bp, Homo sapiens
ggcgcgccagtcctacggaaacagaaattgctttgcggcccgcacggaaattgctttccttcggcttccgttcttggtccatgtgagagaagctggctgctgaaatgactgcgaaccggcttgcagagagccttctggctttgagccaacaggaagaactagcggatttgccaaaagactacctcttgcgactcggaccgatg

SEQ ID NO: 1186 - DNA, 203 bp, Homo sapiens
ggcgcgccagtccttggtggtccggttatgggaaaagaagcctcgtgggagagcagagcctgaaaaaggactgcgcggactgacttcttggctactgaaagcaaagctccactgttccaggcacgattctgccttctctcaaatggcataactcaggactctgcaaattcccagaaacaggaggaaaacgactcggaccgatg

SEQ ID NO: 1187 - DNA, 203 bp, Homo sapiens
ggcgcgccagtcctccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctccgactcggaccgatg

SEQ ID NO: 1188 - DNA, 203 bp, Homo sapiens
ggcgcgccagtcctgtctctttcttagtttgatttgctagctggtttaatctgttttgtgtagtgccttggagcttacgcatttttttttttttccctccattcgaattcactaagagcaagcatgagggatatgagagtgaacatggctgcagtttttcctgcttaagcttgctttgatccttttaacgactcggaccgatg

SEQ ID NO: 1189 - DNA, 203 bp, Homo sapiens
ggcgcgccagtcctatgagagaagaggagcggcgctcaggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggaccgactcggaccgatg

SEQ ID NO: 1190 - DNA, 203 bp, Homo sapiens
ggcgcgccagtcctttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaatactgagctgagatttgcgaagagcagcagccgactcggaccgatg

SEQ ID NO: 1191 - DNA, 203 bp, Homo sapiens
ggcgcgccagtcctgtcttacctcgttgtggcgtcagaaccgccgtcgctcgctcccttctcggcagtggtacctgttcccggtgtccctgaggacgtgcgggccaggtttgcggggccaagtgttgcggcgacgcacctcacgtcgagaatcgggaggaggagactgcaaggataggcccaggagtacgactcggaccgatg

SEQ ID NO: 1192 - DNA, 203 bp, Homo sapiens
ggcgcgccagtcctcagattttaattgcaattgatcaggtttatattattgtacctccagagacctcctagagccagaacccggctggcttgctgtttcctttagagcagcgcatatcattatttggtgttctggtggaggacttttctgatggcagaaattagtttctctgggttcatcaggacgggcgactcggaccgatg

SEQ ID NO: 1193 - DNA, 203 bp, Homo sapiens
ggcgcgccagtcctgaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctgaggagaaaggcggacgactcggaccgatg

SEQ ID NO: 1194 - DNA, 203 bp, Homo sapiens
ggcgcgccagtcctcggcacctcattcatttctaccggtctctagtagtgcagcttcggctggtgtcatcggtgtccttcctccgctgccgcccccgcaaggcttcgccgtcatcgaggccatttccagcgacttgtcgcacgcttttctatatacttcgttccccgccaaccgcaaccattgacgcccgactcggaccgatg

SEQ ID NO: 1195 - DNA, 203 bp, Homo sapiens
ggcgcgccagtcctcggttcttaagcggcagcgcgctgcgggcgccgagtgtcgggcgcggcaggaggacgaggcagggcgggcgggcgctctaagggttctgctctgactccaggttgggacagcgtcttcgctgctgctggatagtcgtgttttcggggatcgaggatactcaccagaaaccgaaacgactcggaccgatg

SEQ ID NO: 1196 - DNA, 203 bp, Homo sapiens
ggcgcgccagtcctggagcagccgacgtggccgcaggggaccgtgcctgggggggtctgcgcggggccgctgactcgcgaggttctctgtcgcctgccgccctcgctccttttctccccttctagagtgttacggtgactcttgggtccgaaggggacggacgtcctcccacgtaccatttagaagaacgactcggaccgatg

SEQ ID NO: 1197 - DNA, 203 bp, Homo sapiens
ggcgcgccagtcctgcctggtgatatgcagctgtacctgtgacatcataattgcaccctccgacatgatatctcttccaaatgcttgatgaaaaaggtgggaggatcacttgagccagggagttgaaggctgcagtgagccctgtttttgccaccacactccagcttgggattgattcctaaagactccgactcggaccgatg

SEQ ID NO: 1198 - DNA, 203 bp, Homo sapiens
ggcgcgccagtcctagctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagcgactcggaccgatg

SEQ ID NO: 1199 - DNA, 203 bp, Homo sapiens
ggcgcgccagtcctggccgcagctccccggcggaggcaagaggtggttgggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttctcgactcggaccgatg

SEQ ID NO: 1200 - DNA, 203 bp, Homo sapiens
ggcgcgccagtcctatttgcacaatatttgtgcggggtatgggggtgggtttttaaatctcgtttctcttggacaagcacagggatctcgttctcctcattttttgggggtgtgtggggacttctcaggtcgtgtccccagccttctctgcagtcccttctgccctgccgggcccgtcgggaggcgcccgactcggaccgatg

SEQ ID NO: 1201 - DNA, 203 bp, Homo sapiens
ggcgcgccagtcctgcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccacccgactcggaccgatg

SEQ ID NO: 1202 - DNA, 203 bp, Homo sapiens
ggcgcgccagtcctctccgaggccgtgagcgcaaagcctcaggccccggctccctcctgagctgcgccgtgccaggccgcccgccgggatgcagtgggccgtgggccggcggtgggcgtgggccgcgctgctcctggctgtcgcagcggtgctgacccaggtcgtctggctctggctgggtacgcagacgactcggaccgatg

SEQ ID NO: 1203 - DNA, 203 bp, Homo sapiens
ggcgcgccagtccttcgagaaaggggctcagcggcggcggaagcggagggggaccaccgtggagagcgcggtcccagcccggccactgcggatccctgaaaccaaaaagctcctgctgcttctgtaccccgcctgtccctcccagctgcgcagggccccttcgtgggatcatcagcccgaagacagggcgactcggaccgatg

SEQ ID NO: 1204 - DNA, 203 bp, Homo sapiens
ggcgcgccagtcctatgagtcttctagctaaacctatgagctttgaaaccacagcaatcactttcttcatcatccttctaatttgcctcatttgcatcctcctcttattggtggtttttttatataaatgtttccaaggcaggaaaggtaaagagacaaagaaagtgccttgtacagatgcaaacggacgactcggaccgatg

SEQ ID NO: 1205 - DNA, 203 bp, Homo sapiens
ggcgcgccagtcctagagtcttaaaatcctgctctggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttacgactcggaccgatg

SEQ ID NO: 1206 - DNA, 203 bp, Homo sapiens
ggcgcgccagtcctcttgcccggcgcgacctgatgatgccgagcccaggccggttccggcgaagttaaaccctcggagctggcctcggactgctggggcgttaccccttcggccacccccgctgaccatggcagtgtttcatgacgaggtggaaatcgaggacttccaatatgacgaggactcggagacgactcggaccgatg

SEQ ID NO: 1207 - DNA, 203 bp, Homo sapiens
ggcgcgccagtcctaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgcgactcggaccgatg

SEQ ID NO: 1208 - DNA, 203 bp, Homo sapiens
ggcgcgccagtcctggccgcggcgtcgcgtcggaacgtgactggatggtagtgtgctggccggtctgcctccgggagaaccgagcgcttccggtggtttggctttgaatgacagcaagaactctgtctttaatggcttcattggtagcgtatgatgattcggactcggaggctgagacagagcatgcacgactcggaccgatg

SEQ ID NO: 1209 - DNA, 203 bp, Homo sapiens
ggcgcgccagtcctgcgcctaaagcgccccgtgccgcttaacgcggtctctcatagccgctcgccttcctttcacttcctgttccttcagaaagcgctgtgccttggaccaaccttacttcttactattgacagctcagctaactcctattcatccttcaaaacccatctctggtggtttggctttgacgactcggaccgatg

SEQ ID NO: 1210 - DNA, 203 bp, Homo sapiens
ggcgcgccagtcctcgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggacgactcggaccgatg

SEQ ID NO: 1211 - DNA, 203 bp, Homo sapiens
ggcgcgccagtcctcagttactttcaggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaacccgactcggaccgatg

SEQ ID NO: 1212 - DNA, 203 bp, Homo sapiens
ggcgcgccagtccttgagccccggggctgcgtttcctgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacacgactcggaccgatg

SEQ ID NO: 1213 - DNA, 203 bp, Homo sapiens
ggcgcgccagtcctctctctttcactgcaaggcggcggcaggagaggttgtggtgctagtttctctaagccatccagtgccatcctcgtcgctgcagcgacacacgctctcgccgccgccatgactgagcagatgacccttcgtggcaccctcaagggccacaacggctgggtaacccagatcgctaccgactcggaccgatg

SEQ ID NO: 1214 - DNA, 203 bp, Homo sapiens
ggcgcgccagtcctgaaaggccccaggggctattttttgcaggaacggtcactccctaaatccaggcagggaaagggaggagtctgagccgagtcacgccccttctcctgtaaacttgggtcgcctctagcttagcgagcgctggagtttgaagagcgggcagtggctgcacacgccaaactttccctcgactcggaccgatg

SEQ ID NO: 1215 - DNA, 203 bp, Homo sapiens
ggcgcgccagtcctcgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgcgactcggaccgatg

SEQ ID NO: 1216 - DNA, 203 bp, Homo sapiens
ggcgcgccagtcctcctcaatcggcgggacagcagggcgcgtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagcccgactcggaccgatg

SEQ ID NO: 1217 - DNA, 203 bp, Homo sapiens
ggcgcgccagtcctagcggtctcccgcccgcggcgccatcgcgccattcctagttaaggcggcacagggccgaggcgtagtgtgggtgactcctccgttccttgggtcccgtcgtctgtgatactgcagcgcagccatggcagaaccgcagcccccgtccggcggcctcacggacgaggccgccctcacgactcggaccgatg

SEQ ID NO: 1218 - DNA, 203 bp, Homo sapiens
ggcgcgccagtccttcgtgcgcctgcagcccttggttcttggaaacgccggcgccttgttcagggctggtggggctggggcgcaaggtgcagctgacaatgcccgagaggagccgcagcctctggtggagttcggtcgggtgtgggggtagtcaaggaaagaagcaaagggaatacctcctctgaaaacgactcggaccgatg

SEQ ID NO: 1219 - DNA, 203 bp, Homo sapiens
ggcgcgccagtccttttctcccaggccccgcccctccgtccctcaccgcaccacccctaaagacgctagcgctgcgatggcggaggccgtggagcgcactgacgagctggtccgggagtacctgctcttccgcgggttcacgcacacactgcggcagctggacgccgagatcaaggcggacaaggagacgactcggaccgatg

SEQ ID NO: 1220 - DNA, 203 bp, Homo sapiens
ggcgcgccagtcctttgtgggagtcgtagtccgcggtgaggcccagtgcgcaggcgcagtttgccggccgccatcgcgcactggggctccgggcggctgggaccggcctggggtagctgcgcagcaggtgggtcggtcccggggatgcagcgcgggggtcagagagcgaccccaacagggtagacgggcgactcggaccgatg

SEQ ID NO: 1221 - DNA, 203 bp, Homo sapiens
ggcgcgccagtcctgccttctgcccggccccttcgcccacgtgaagaacgccagggagctgtgaggcagtgctgtgtggttcctgccgtccggactctttttcctctactgagattcatctgtgtgaaatatgagttggcgaggaagatcgacctatcggcctagaccaagacgctacgtagagcctccgactcggaccgatg

SEQ ID NO: 1222 - DNA, 203 bp, Homo sapiens
ggcgcgccagtccttagagctgagcagttgtccgcgtgcgcaggcggaagtcccggattgaggcgccgccatttttgctgcccggacgcggagcgagaggctgagagagtcggagacactatccgcttccatccgtcgcgcagaccctgccggagccgctgccgctatggatgatcgagaggatctggcgactcggaccgatg

SEQ ID NO: 1223 - DNA, 203 bp, Homo sapiens
ggcgcgccagtccttattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggacccgactcggaccgatg

SEQ ID NO: 1224 - DNA, 203 bp, Homo sapiens
ggcgcgccagtcctactcgcacatgcgagcacattccttccttccttctcactctctcggcccttgacttctacaagcccatggaacatttctggaaagacgttcttgatccagcagggtggcccgccggtttctgagccttctgccctgcggggacacggtctgcaccctgcccgcggccacggacccgactcggaccgatg

SEQ ID NO: 1225 - DNA, 203 bp, Homo sapiens
ggcgcgccagtcctacaaagatctcttcacattctccgggactgcggtaccaaatatcagcacagcacttcttgaaaaaggatgtagattttaatctgaactttgaaccatcactgaggtggcccgccggtttctgagccttctgccctgcggggacacggtctgcaccctgcccgcggccacggacccgactcggaccgatg

SEQ ID NO: 1226 - DNA, 203 bp, Homo sapiens
ggcgcgccagtcctacggactgctaaaggtctcccctcccacctgcattgctctacaatctgtggcctcagcccttgccaactctgcctcttcccccgctgactgggcctctgcagagatgtgggcagctggtcaggatggccattcgggctcagcacagcaacgcagcccagactcagactggggaacgactcggaccgatg

SEQ ID NO: 1227 - DNA, 203 bp, Homo sapiens
ggcgcgccagtcctaagaaaggtaagggccctgggcgaggaaagcgcggccctttccgagtttggtgttttgcagcgaaaggaaatctcgctcttccgaaagtcctccagggcgagagaggaaagggcctagaatacctcctctgaaaaatggcagaagcagttttccatgccccaaagaggaaaagacgactcggaccgatg

SEQ ID NO: 1228 - DNA, 203 bp, Homo sapiens
ggcgcgccagtcctatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagcccgactcggaccgatg

SEQ ID NO: 1229 - DNA, 203 bp, Homo sapiens
ggcgcgccagtcctagacgcgacggtgctgggatcccgggagggagcggagcggacctgggcttggtcgcctccaagccggcgggaccgagtgctttaggccgcttgaaagaaagttgctccgacccgggaaaaggagaagatgaaggaagccaaggatgcccgctataccaatgggcacctcttcaccgactcggaccgatg

SEQ ID NO: 1230 - DNA, 203 bp, Homo sapiens
ggcgcgccagtcctgtcagacttcctgtccccgagaccaacgcgtgcgggccgaacccctccccccgccttcccccaacaatacaggacgccggggtccgcgccgcgtcctccctggtccccccgtccgattatgtctcggatcgaatccctcacgcgggcgcggatcgaccggagcagagagctggccgactcggaccgatg

SEQ ID NO: 1231 - DNA, 203 bp, Homo sapiens
ggcgcgccagtcctaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctcgactcggaccgatg

SEQ ID NO: 1232 - DNA, 203 bp, Homo sapiens
ggcgcgccagtcctgtaaggaggaaaactgaggcctgggagcaggaacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccacgactcggaccgatg

SEQ ID NO: 1233 - DNA, 203 bp, Homo sapiens
ggcgcgccagtcctgcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcacgactcggaccgatg

SEQ ID NO: 1234 - DNA, 203 bp, Homo sapiens
ggcgcgccagtcctgccggctgccccaggccagtggagtggcagccccagaactgggaccaccgggggtggtgaggcggcccggcactgggagctgcatctgaggcttagtccctgagctctctgcctgcccagactagctgcacctcctcattccctgcgcccccttcctctccggaagcccccaggcgactcggaccgatg

SEQ ID NO: 1235 - DNA, 203 bp, Homo sapiens
ggcgcgccagtccttctgggaattccgggcgtttcggctccttggtcgcagaggcaggaggcgtgcgtggcaggagggttcgggttatatactcctaggtcctgggacagaatagttacgacctctgggacaggaactcttctctcttttgttaataaacttccaactccctcctcagacccgaccgccgactcggaccgatg

SEQ ID NO: 1236 - DNA, 203 bp, Homo sapiens
ggcgcgccagtcctgcttcatttccgggtgaaactggcattgagggtactggggcgtgcgtgaggcgtttactgatgcttcctggtccggtggcctcggtcccggtaagccaggcatgaagatcacaaggcagaaacatgccaagaagcatcttggcttcttccgcaacaacttcggagtccgcgagccgactcggaccgatg

SEQ ID NO: 1237 - DNA, 203 bp, Homo sapiens
ggcgcgccagtcctagcccaagatttctagggcattggccgcgctgctgggtgatccctccgggctcaagttgcaagggggcgggccgggccggaggtggagtctcccgccaattgaagcctccgctataaattgaactccctgcactgctgaagcccagatgcctcgccaggccacgtcgcggttggcgactcggaccgatg

SEQ ID NO: 1238 - DNA, 203 bp, Homo sapiens
ggcgcgccagtcctgctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctacgactcggaccgatg

SEQ ID NO: 1239 - DNA, 203 bp, Homo sapiens
ggcgcgccagtcctatgaatatgcaagtgcgaggaagatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcgactcggaccgatg

SEQ ID NO: 1240 - DNA, 203 bp, Homo sapiens
ggcgcgccagtcctcctgcctcctcagatctcgtttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaatcatgcaaatcaagcgactcggaccgatg

SEQ ID NO: 1241 - DNA, 203 bp, Homo sapiens
ggcgcgccagtcctagtcaagttctcatgagttctcccaaaatccaccgctcttcctctttccctaagcagcctgagggttgactggattggtgaggcccgtgtggctacttctgtggaagcagtgctgtagttactggaagataaaagggaaagcaagcccttggtgggggaaagtgatctgtgaaacgactcggaccgatg

SEQ ID NO: 1242 - DNA, 203 bp, Homo sapiens
ggcgcgccagtcctcgctggaggcggtggcttcttatgcgggaggacgtggcggagggcctgactttgggagccgggggttgactggattggtgaggcccgtgtggctacttctgtggaagcagtgctgtagttactggaagataaaagggaaagcaagcccttggtgggggaaagtgatctgtgaaacgactcggaccgatg

SEQ ID NO: 1243 - DNA, 203 bp, Homo sapiens
ggcgcgccagtcctgagaagcccaggcagttgaggacaggagagagaaggctgcagacccagagggagggaggacagggagtcggaaggaggaggacagaggagggcacagagacgcagagcaagggcggcaaggaggagaccctggtgggaggaagacactctggagagagagggggctgggcagagcgactcggaccgatg

SEQ ID NO: 1244 - DNA, 203 bp, Homo sapiens
ggcgcgccagtcctttcttcggctacgaatctcgcgagaagtcaagttctcatgagttctcccaaaatccaccgctcttcctctttccctaagcagcctgaggtgatctgtgaaaatggttcgctattcacttgacccggagaaccccacgaaataacactcgtgaaactgctcaggccatcaagggtcgactcggaccgatg

SEQ ID NO: 1245 - DNA, 203 bp, Homo sapiens
ggcgcgccagtccttttttctcccagcaagctgtgcgacgcgccgggcctcctcgcctttgtgccatccgggtctctcgcgcgagcgatttagtctgaggcgaagcttcggagcggccggtactgttgaaagcgacaagtggaggcgccgctctagcggccgggactctgaactatggcggctagtgacgactcggaccgatg

SEQ ID NO: 1246 - DNA, 203 bp, Homo sapiens
ggcgcgccagtcctgacaaccggcgtggaggcgtggccacagccgcccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcgactcggaccgatg

SEQ ID NO: 1247 - DNA, 203 bp, Homo sapiens
ggcgcgccagtcctgtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgcgactcggaccgatg

SEQ ID NO: 1248 - DNA, 203 bp, Homo sapiens
ggcgcgccagtcctgacgggcgctttggagccggccccaggcagcgtgtgtcggtcgcctagtctggagaactagtcctcgactcacgagatgaagttttaccatgttggccaggctggtctcgaattcctgacctcaagtgatctgcccaccttgacctcccaaagtgctgggattacagtgcaaggcgactcggaccgatg

SEQ ID NO: 1249 - DNA, 203 bp, Homo sapiens
ggcgcgccagtcctgcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtccgactcggaccgatg

SEQ ID NO: 1250 - DNA, 203 bp, Homo sapiens
ggcgcgccagtcctctgagtcgctgtcgcggaggctggagcgctgccccggaagtcctcccccctgttccccgcccgcggcaaacatggcggtggactcggcgatggagctgttatttttagatacttttaaacacccgagcgctgagcaaagttctcatatagatgtggttcgttttccatgtgtggcgactcggaccgatg

SEQ ID NO: 1251 - DNA, 203 bp, Homo sapiens
ggcgcgccagtcctgtcatttattattattgctattagtgttacctattattttctttttgaacccacttattgcctaattagtcatagtttgacaattgcccttgtattccaccatgtcaaatataaatttacatagatgaagctcctgaaattattcttgggttaccattttgtgaagctattgatcgactcggaccgatg

SEQ ID NO: 1252 - DNA, 203 bp, Homo sapiens
ggcgcgccagtcctagattgtttcacatcaccagtgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatcgactcggaccgatg

SEQ ID NO: 1253 - DNA, 203 bp, Homo sapiens
ggcgcgccagtcctcggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgcgactcggaccgatg

SEQ ID NO: 1254 - DNA, 203 bp, Homo sapiens
ggcgcgccagtcctgcgcggtcgctcagcagtgacgtgacacgcagcccacggtctgtactgacgcgccctcgcttcttcctctttctcgactccatcttcgcggtagctgggaccgccgttcagtcgccaatatgcagctctttgtccgcgcccaggagctacacaccttcgaggtgaccggccaggcgactcggaccgatg

SEQ ID NO: 1255 - DNA, 203 bp, Homo sapiens
ggcgcgccagtcctgcgaagggaccgtctctgccaagcgcctgttggtaggaacctgcttggtcgcgtctgagggggcttgtaggtggctctggctgaaacaggcgcctgcgagagtctgtaggagggaaaccgccatggacgatcagggttgccctcggtgtaagaccaccaaatatcggaacccctcgactcggaccgatg

SEQ ID NO: 1256 - DNA, 203 bp, Homo sapiens
ggcgcgccagtccttttttcaaaagattcgttctgagccgtttaaaatgctcttgtgttctacgaagtctctttgcatccttgaacaccggggaatttccaggtatttcatttctcctgtcccctcccctccccaccccatctattaatattattcttttgaagattcttcgttgtcaagccgccaaacgactcggaccgatg

SEQ ID NO: 1257 - DNA, 203 bp, Homo sapiens
ggcgcgccagtccttcgccccgcgggccggccgagacgacgggaagttttatttgcagctcggagcctgtggcggatggtgggactctccggccctgtgcagtaaaagattgatctctgggctggtgaacataatctctgtcccagtcagaaaaggagagaggaaattagcagagcgattggtggagacgactcggaccgatg

SEQ ID NO: 1258 - DNA, 203 bp, Homo sapiens
ggcgcgccagtcctctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgagatcgtactgagaagcactccacacgactcggaccgatg

SEQ ID NO: 1259 - DNA, 203 bp, Homo sapiens
ggcgcgccagtcctgcgcgggaatggccggcccacgggtcgcaggagacgggacgccagtcctttggctccgttccgctggctccttcgtcagtactgacacctcgggcttgtagagcacttcacgcagtgcaaagcgccccccgtctatatcatatcgcctctcggtcctcctaaaagtcgtatgagcgactcggaccgatg

SEQ ID NO: 1260 - DNA, 203 bp, Homo sapiens
ggcgcgccagtcctccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacactcactcacacacacgactcggaccgatg

SEQ ID NO: 1261 - DNA, 203 bp, Homo sapiens
ggcgcgccagtcctttctggggtggctctagtctcatggccacaaagctctagcccaggcgccgcgaggcactggcattgagagcccaatgcatctcagcctcacgctgcagaagccagtggggctggggagccgcagcagcgtcgattttcttcacaagaagatgggaactgtgggctacaagtaggcgactcggaccgatg

SEQ ID NO: 1262 - DNA, 203 bp, Homo sapiens
ggcgcgccagtcctcccagaactttggtctcgtcccacccacccccgcccgcgccatggtctcgccctagggagccatcgataactctacgctcggcctcgatcgactcgctccggctcccctcgccgtcctggacacggcggagtgcggagccgcccgtaagctctagggcccgtgcaggccacacccgactcggaccgatg

SEQ ID NO: 1263 - DNA, 203 bp, Homo sapiens
ggcgcgccagtcctccgcccgcgccatggtctcgccctagggagccatcgataactctacgctcggcctcgatcgactcgctccggctcccctcgccgtcctggacacggcggagtgcggagccgcccgtaagatgctctgacctttgacccctgccgttcagctctagggcccgtgcaggccacacccgactcggaccgatg

SEQ ID NO: 1264 - DNA, 203 bp, Homo sapiens
ggcgcgccagtcctaggcggcgcgggcggcgcctcagcggaagagcgggcctctgggccgcagtgaccaacccccgcccctcaccccacgtggttggaggtttccagaagcgctgccgccaccgcatcgcgcagctctttgccgtcggagcgcttgtttgctgcctcgtactcctccatttatccgcccgactcggaccgatg

SEQ ID NO: 1265 - DNA, 203 bp, Homo sapiens
ggcgcgccagtcctatggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggcccgactcggaccgatg

SEQ ID NO: 1266 - DNA, 203 bp, Homo sapiens
ggcgcgccagtcctgcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtcgactcggaccgatg

SEQ ID NO: 1267 - DNA, 203 bp, Homo sapiens
ggcgcgccagtcctgtgcagcggctgccacggagctcgcagctgcggcttctgaggagtaagcggcgcggtagcgaaggccgccgaacctgcctggctagccggcgacttgagtgacgactcttttgaaacagatggtcaccatgtttagatattagcagtcccatatatgcatgtctgcatttgaaacgactcggaccgatg

SEQ ID NO: 1268 - DNA, 203 bp, Homo sapiens
ggcgcgccagtccttgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtcgactcggaccgatg

SEQ ID NO: 1269 - DNA, 203 bp, Homo sapiens
ggcgcgccagtccttctgaagagaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgcgactcggaccgatg

SEQ ID NO: 1270 - DNA, 203 bp, Homo sapiens
ggcgcgccagtcctgtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggcgactcggaccgatg

SEQ ID NO: 1271 - DNA, 203 bp, Homo sapiens
ggcgcgccagtcctaactcccaagccccacccctgggcttggcctgccttgccctgccgggaagtgatccccaaggcagggtgagagttccccatctgaggcgtttgttgcagctacctgcacttctagattcatcttcttgtgagccctgggcttaggagtcaccatggcaactgaagagttcatcacgactcggaccgatg

SEQ ID NO: 1272 - DNA, 203 bp, Homo sapiens
ggcgcgccagtccttgggcttggcctgccttgccctgccgggaagtgatccccaaggcagggtgagagttccccatctgaggcgtttgttgcagctacctgcacttctagatgctccccaggttcatcctgtgtcgtctcccccacctaccagtcatcttcttgtgagccctgggcttaggagtcacccgactcggaccgatg

SEQ ID NO: 1273 - DNA, 203 bp, Homo sapiens
ggcgcgccagtcctgtgcgctgctgcgcaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataacgactcggaccgatg

SEQ ID NO: 1274 - DNA, 203 bp, Homo sapiens
ggcgcgccagtccttagcaccacccgagccaatggcggcggccgaggggcggagggggctggcaggaggggagggagcgctggctttagagccacagctgcaaagattccgaggtgcagaagttgtctgagtgcgttggtcggcggcagtcgggccagacccaggactctgcgactttacatctttaacgactcggaccgatg

SEQ ID NO: 1275 - DNA, 203 bp, Homo sapiens
ggcgcgccagtccttagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtcgactcggaccgatg

SEQ ID NO: 1276 - DNA, 203 bp, Homo sapiens
ggcgcgccagtcctcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctccgactcggaccgatg

SEQ ID NO: 1277 - DNA, 203 bp, Homo sapiens
ggcgcgccagtcctgcgcatggtgagtaggttggtccgaagtttgaaccggacagaagcgctggtcggcgtctggcggttattgttcaaaactacaactccattttgacactttctcacttgtaccgatcttcagacgccctccttcttcatgagaatgatgccatccataagatctgtgcaaaactgcgactcggaccgatg

SEQ ID NO: 1278 - DNA, 203 bp, Homo sapiens
ggcgcgccagtcctagagcgcagggagcagccggtggctcggcggcggcggcggcggcggcggcggcgtcggcgtcgtctacctccagcttctcctccctcctcctccgtctcctcctctctctctccatctgctgtggttatggcctgtcgctggagcacaaaagagtctccgcggtggaggtctgccgactcggaccgatg

SEQ ID NO: 1279 - DNA, 203 bp, Homo sapiens
ggcgcgccagtccttggagccggcttgacagggtctgagggggagtggagaactgggcgaggaggttcccgtgggtgagcgcgtacgggatggctggctcgcaggacggccgaaggtggtggttggtgggagcagccagcgacgagcccgtagacactcgtacgcgtgcgggctgacgtgcgcgctaccgactcggaccgatg

SEQ ID NO: 1280 - DNA, 203 bp, Homo sapiens
ggcgcgccagtcctgtgatttggcgggagtcttgaccgccgccgggctcttggtacctcagcgcgagcgccaggcgtccggccgccgtggctatgttcgtgtccgatttccgcaaagagttctacgaggtggtccagagccagagggtccttctcttcgtggcctcggacgtggatgctctgtgtgcgcgactcggaccgatg

SEQ ID NO: 1281 - DNA, 203 bp, Homo sapiens
ggcgcgccagtcctcggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatcgactcggaccgatg

SEQ ID NO: 1282 - DNA, 203 bp, Homo sapiens
ggcgcgccagtcctcagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctcgactcggaccgatg

SEQ ID NO: 1283 - DNA, 203 bp, Homo sapiens
ggcgcgccagtcctacgccgtggcgtgccgcaggacgcgacggctgcagaacatccgccgcaccgctgggggccaacgttgtgggaccgaggagtccgaggtggcgactgagtgagatacccagctgtgcggagctaggacgcggaacatcccagaggccagcatcaacatgtttccatccttggggacgactcggaccgatg

SEQ ID NO: 1284 - DNA, 203 bp, Homo sapiens
ggcgcgccagtcctgcctgcgcacgcaccgggccggggactgggtggcctggtgtgtgggcgcggcagggcgcaggcgcaggcgcagtgtgcgtccgcgtctgaggggagggatgtgggggaagcgacggcccccggtttgtttgggctgtgggcggtgcgcagcggagagcccgggaaaagcgggaacgactcggaccgatg

SEQ ID NO: 1285 - DNA, 203 bp, Homo sapiens
ggcgcgccagtcctccacccctacccgtgtaggccaccgagtgaggcccatggactggggagggctgtgcctgacgactcctgtgtccctctatgagggcccagcgccctgaccctcctgcctaggtttctaccttttctctctgtctttggccagctgggggagggggtagaggccgggtgagcaaccgactcggaccgatg

SEQ ID NO: 1286 - DNA, 203 bp, Homo sapiens
ggcgcgccagtcctatagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcgactcggaccgatg

SEQ ID NO: 1287 - DNA, 203 bp, Homo sapiens
ggcgcgccagtcctagtgcccgccgggaaaatgcgaccgtccacaaagtgaaatggccgcccgggacgagctcggcctcggcggggattctcttgaggccatgcccgtgccggccgccagaggtcgcccgaggatcacgaatgggcccgaggagctggctgccccttcccccgcggccttggctgattcgactcggaccgatg

SEQ ID NO: 1288 - DNA, 203 bp, Homo sapiens
ggcgcgccagtcctctggagggccgcactcccgttccagccaggctgagccttctgtcccctgcctctggggcctgggaaccccccttcttctttctcctgaatggcacccccgccctagaatccagacaccgagtttcccactgtggctggttcaaggagctccctggtgacagtctgtggctgagccgactcggaccgatg

SEQ ID NO: 1289 - DNA, 203 bp, Homo sapiens
ggcgcgccagtcctggagccgtccgcctacgggggccgggacgtcgcctgcgcgtctctcgttttcggacggctgcagcatcgcggtggggatcgaaagcgggggcttctgggacgcagctctggagacgcggcctcggaccagccatttcggtgtagaagtggcagcacggcagactggtcaaacaacgactcggaccgatg

SEQ ID NO: 1290 - DNA, 203 bp, Homo sapiens
ggcgcgccagtcctggtgctgggaggccttagaacgccgtggcgtgccgcaggacgcgacggctgcagaacatccgccgcaccgctgggggccaacgttgtgggaccgaggagtccgaggtggcgactgagtgagatacccagctgtgcggagctaggacgcggaacatcccagaggccagcatcaaccgactcggaccgatg

SEQ ID NO: 1291 - DNA, 203 bp, Homo sapiens
ggcgcgccagtcctccgggaggctgagactgcattgttgggatttgatgcactaatctcctgtctccgccgcctttccctctgttcggtctcttgccctccctcccttcgtctgtccttcctccgtgtgtttgtctatcctcctctgtccctcctctttcctctccttgctttctttggttttctgcacgactcggaccgatg

SEQ ID NO: 1292 - DNA, 203 bp, Homo sapiens
ggcgcgccagtcctcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctcgactcggaccgatg

SEQ ID NO: 1293 - DNA, 203 bp, Homo sapiens
ggcgcgccagtcctaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagcgactcggaccgatg

SEQ ID NO: 1294 - DNA, 203 bp, Homo sapiens
ggcgcgccagtcctcttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgacgactcggaccgatg

SEQ ID NO: 1295 - DNA, 203 bp, Homo sapiens
ggcgcgccagtcctccggattcccctgcggcttcgatccctttccactgggtattgagattggcgaggggagaggcgcagaaacggcgtactctagtgcagtggttcaatctcggctcactgcaacctccgcctccccgattcaagcgattctcctgcgtcagcctccccagtagctgagactacaggcgactcggaccgatg

SEQ ID NO: 1296 - DNA, 203 bp, Homo sapiens
ggcgcgccagtcctggaccaaagaaacgcgagcttagccctgggtagcgcggccaatggccgtggagcagcccctgtaaactggctcgggcgcccccacgcccgcccttccttcttctcccagcattgccccccccacgtttcagcacagcgctggccgcagtctgacaggaaagggacggagccaagcgactcggaccgatg

SEQ ID NO: 1297 - DNA, 203 bp, Homo sapiens
ggcgcgccagtccttctctcccgctgttggctggcaggatcttttggcagtcctgtggcctcgctccccgcccggatcctcctgaccctgagattcgcgggtctcacgtcccgtgcacgccttgcttcggcctcagttaagcctttgtggactccaggtccctggtgagattagaaacgtttgcaaaccgactcggaccgatg

SEQ ID NO: 1298 - DNA, 203 bp, Homo sapiens
ggcgcgccagtcctggaggcctgcgtccggaaagtcagtagaattcatcacaagagagctacaagagcctggaagaagctgaagactgctaccctccatccttactcaccctggacctgagagacctcttcaatcaggtggagcaaggccctctcctgtcctgccccaaggctggcacagacttgagccgactcggaccgatg

SEQ ID NO: 1299 - DNA, 203 bp, Homo sapiens
ggcgcgccagtcctagtgggtgggaagagcccccaagagctctgtgcgggattctaggctcccctgtgacagccgcggcaggaagcaggcgggcgctccccggccacaggcctgttgttctcggaagggagaaagctggacatttccccacgtaactcccagctctgggcctagagtgcgtgcatggccgactcggaccgatg

SEQ ID NO: 1300 - DNA, 203 bp, Homo sapiens
ggcgcgccagtcctctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtccgactcggaccgatg

SEQ ID NO: 1301 - DNA, 203 bp, Homo sapiens
ggcgcgccagtcctatttaactctgccagggatccgctgggctctgacgactgcggtagatccatggcttcctggacgttcacccgtagagtcatcctagcttaactcttgttccctggtctcagttcacaagcctcacctgtatcttcctggctcggaagataattgaaaccaagtctgacttctcacgactcggaccgatg

SEQ ID NO: 1302 - DNA, 203 bp, Homo sapiens
ggcgcgccagtcctttgcgccacaaccagggcagcgtaaactacagttcccagagagcgccgcgtcgggagcggagccttttctcgctaacaccgctcgccctctccgagtcagttccgcggtagaggtgacctgactctctgaggctcattttgcagttgttgaaattgtccccgcagttttcaatccgactcggaccgatg

SEQ ID NO: 1303 - DNA, 203 bp, Homo sapiens
ggcgcgccagtcctacttctgctttctgacttgattacaggcatctttcctttttcatgctgtgcaaaaacttgagctcagcctctcaccccaacacaattcaagacgcagccttgtcccagcatgagcgcagataacagcagcaccatctgtgtttgtagaagcgtgagacaggagcttggaattgccgactcggaccgatg

SEQ ID NO: 1304 - DNA, 203 bp, Homo sapiens
ggcgcgccagtcctcggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggtgctggggggaccctgatgtggcaccaaatgaacgactcggaccgatg

SEQ ID NO: 1305 - DNA, 203 bp, Homo sapiens
ggcgcgccagtcctccatccctgctgtgactcagctgtgacgttgaaccacacaagccagagagaagaagataaagtcatcagagctcctactcaccagagagtgaggcccaggccaggactccacaaggctggtcccctgccctggagcaacttaaacaggccctctggccagcctggaaccctgagcgactcggaccgatg

SEQ ID NO: 1306 - DNA, 203 bp, Homo sapiens
ggcgcgccagtcctttcaacctcgaataaaaactgcagccaacttccgaggcagcctcattgcccagcggaccccagcctctgccaggttgggtccgccatcctcgtcccgtcctccgccggcccctgccccgcgcccagggatcctccagctcctttcgcccgcgccctccgttcgctccggacacccgactcggaccgatg

SEQ ID NO: 1307 - DNA, 203 bp, Homo sapiens
ggcgcgccagtcctctgacaggagaaatagcagtgctgcccaggatcacagctcaccccgaggtggctgaggctggaattgggtgcccctttgcaggtgtcggctgctccttcaagggaagcccacagtctgtgcaagagcatgaggtcacctcccagacctcccacctaaacctgctgttggggttccgactcggaccgatg

SEQ ID NO: 1308 - DNA, 203 bp, Homo sapiens
ggcgcgccagtcctgtgcgaggggtggggctgcgggaggccctggagcgcggcggtgatggcggggccggtgaaggaccgcgaggccttccagaggctcaacttcctgtaccaggccgcccattgtgtccttgcccaggaccccgagaaccaggcgctggcgaggttttactgctacactgagaggaccgactcggaccgatg

SEQ ID NO: 1309 - DNA, 203 bp, Homo sapiens
ggcgcgccagtccttacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggccgactcggaccgatg

SEQ ID NO: 1310 - DNA, 203 bp, Homo sapiens
ggcgcgccagtcctgtggggttgacccgcacgtcccgccccgcctctcccttcgcgctccggacgggcgacggtagctcgagacccgggactccgcccgcctccccgcgagtatttgaggtccggggcggctccggcgcctctgcccgccgttctgctcgctcgctccccgctctggagtctgccatccgactcggaccgatg

SEQ ID NO: 1311 - DNA, 203 bp, Homo sapiens
ggcgcgccagtcctactctcattccacgttcttaactgttccattttccgtatctgcttcgggcttccacctcatttttttcgctttgcccattctgtttcagccagtcgccaagaatcatgaaagtcgccagtggcagcaccgccaccgccgccgcgggccccagctgcgcgctgaaggccggcaagcgactcggaccgatg

SEQ ID NO: 1312 - DNA, 203 bp, Homo sapiens
ggcgcgccagtcctttcatccaccagcagcctcagtcctcatcacctgtgtacggctccagtgccaaaacttccagtgtctccaaccctcaggacagtgttggctctccgtgctcccgagtgggtgaggaggagcacgtctacagcttccccaacaagcagaaatcagctgagccttcacccaccgtacgactcggaccgatg

SEQ ID NO: 1313 - DNA, 203 bp, Homo sapiens
ggcgcgccagtcctgaccagattgggtgcttggccgtccctgccattagcgcgtaacgagagactgcttgctgcggcagagacgccagaggtgcagctccagcagcaatggcagtgacggcgttggcggcgcggacgtggcttggcgtgtggggcgtgaggaccatgcaagcccgaggcttcggctcgcgactcggaccgatg

SEQ ID NO: 1314 - DNA, 203 bp, Homo sapiens
ggcgcgccagtccttggtgtgacttagtttttgattgctggatttcactggagtgaagtggtcgtttattggctggccctctgatatgaggtggtggtgaattggtgggcgtcagtgcagtaagtgagcgagccggacgtcgattgactggtcttcagaagcagaaggactccatgaaagatgacagacgactcggaccgatg

SEQ ID NO: 1315 - DNA, 203 bp, Homo sapiens
ggcgcgccagtcctacttaagcttcgacgcaggaggcggggctgctcagtcctccaggcgtcggtactcagcggtgttggaacttcgttgcttgcttgcctgtgcgcgcgtgcgcggacatggcctcaaacgattatacccaacaagcaacccaaagctatggggcctaccccacccagcccgggcagcgactcggaccgatg

SEQ ID NO: 1316 - DNA, 203 bp, Homo sapiens
ggcgcgccagtcctccttctggaaggttctaagatagggtataagaggcagggtggcgggcggaaaccggtctcattgaactcgcctgcagctcttgggttttttgtggcttccttcgttattggagccaggcctacaccccagcaaccatgtccaagggacctgcagttggtattgatcttggcacccgactcggaccgatg

SEQ ID NO: 1317 - DNA, 203 bp, Homo sapiens
ggcgcgccagtcctatttccggctcgaatgcccggcagccgtggcggctagagcgttcctccccagctcgaatgcccggcggccgaggcggctagagcgtcgcctcctcccggggaaccgcgtgtgaccttccagcccggggaccgatgctgccggcggccgctcgccccctgtgggggccttgccttcgactcggaccgatg

SEQ ID NO: 1318 - DNA, 203 bp, Homo sapiens
ggcgcgccagtcctctgtatgttccctgggttcctgagagaggacattgaggagtaggagtcggcgattaaggagatcggtacaattgggaagcctcctgtcagagcttccagcaatttcctcatcagaggtggacaagccctatgggctaagacagagggtcctcagaaaggagtgcggacgccgtccgactcggaccgatg

SEQ ID NO: 1319 - DNA, 203 bp, Homo sapiens
ggcgcgccagtcctgcggcaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggacgactcggaccgatg

SEQ ID NO: 1320 - DNA, 203 bp, Homo sapiens
ggcgcgccagtcctccagctcagagggagcaggggcccagccagggacggaccctcattcctcccagggaccccagacctctgtctctctcggctgagtatttgtgccaggaagactgcgtgcagaaggtgactgtctcagtggagctgggtcatctcaggccttggctccttgaacttttggccgcccgactcggaccgatg

SEQ ID NO: 1321 - DNA, 203 bp, Homo sapiens
ggcgcgccagtcctggctccacccagaggccagtcctgtgtgtctggggacaaggcgaaagagcagcagaagtgccccttctccaggatcaaggaactggggcggggggtgtttcctggaccccagtcctccgaatcagctcctagagtggaaccaggaaggattctggagccacagaagatagacagcgactcggaccgatg

SEQ ID NO: 1322 - DNA, 203 bp, Homo sapiens
ggcgcgccagtcctgctgctgccttaagacgtgcagcctgggccgtggctgtcactgcgttcggacccagacccgctgcaggcagcagcagcccccgcccgcgcagcagcatggagctctggggggcctacctcctcctctgcctcttctccctcctgacccaggtcaccaccgagccaccaacccagcgactcggaccgatg

SEQ ID NO: 1323 - DNA, 203 bp, Homo sapiens
ggcgcgccagtcctaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattcccgactcggaccgatg

SEQ ID NO: 1324 - DNA, 203 bp, Homo sapiens
ggcgcgccagtcctcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgcccgactcggaccgatg

SEQ ID NO: 1325 - DNA, 203 bp, Homo sapiens
ggcgcgccagtcctagaacaaatcattgtgggaagctgggaggagagagagagagaggaagtcggacgtgggcgaggggcggggtgtctggactggaacctctgggcccacatgccatggacaatattaccaggcagaaccaattctacgatacccaagtcatcaaacaagaaaacgagtcaggctaccgactcggaccgatg

SEQ ID NO: 1326 - DNA, 203 bp, Homo sapiens
ggcgcgccagtcctccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcacgactcggaccgatg

SEQ ID NO: 1327 - DNA, 203 bp, Homo sapiens
ggcgcgccagtcctcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagacgactcggaccgatg

SEQ ID NO: 1328 - DNA, 203 bp, Homo sapiens
ggcgcgccagtcctagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggcgactcggaccgatg

SEQ ID NO: 1329 - DNA, 203 bp, Homo sapiens
ggcgcgccagtcctgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagcccgactcggaccgatg

SEQ ID NO: 1330 - DNA, 203 bp, Homo sapiens
ggcgcgccagtcctaaagcctcggctacttccgagggggtgagtggcttcaccgccggtcccttgcagcgctgcctttcgatctctccacatctcggtggcgcgggatctcaagatgcgcctccacctgctcctgctgctcgcgctgtgcggtgcaggcaccaccgccgcggagctcagttacagcttcgactcggaccgatg

SEQ ID NO: 1331 - DNA, 203 bp, Homo sapiens
ggcgcgccagtcctaagcaccgataggctctgcctcccgaagaaaagggagccgcgcagcgcctacgggagtccggcggcagcagccggtaccggcaaccacgggcagctctcagggaatctccgtcgtgaggccagaggctccagtccccgcgagtccagatgcctgtccagcctccaagcaaagaccgactcggaccgatg

SEQ ID NO: 1332 - DNA, 203 bp, Homo sapiens
ggcgcgccagtcctttgaagcaaggttgtggagaaaagcaaaggagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattcgactcggaccgatg

SEQ ID NO: 1333 - DNA, 203 bp, Homo sapiens
ggcgcgccagtcctttgttcccagggtggcgcctgctctccatccaggccccattccggctcccacccgacgctgcttttgttcccacgtttcggggggcagctggcactgtgattcctgccccatgagtgcctagaggcacggagccaccagggatcaccccacgtgggacacagggcttggggaggcgactcggaccgatg

SEQ ID NO: 1334 - DNA, 203 bp, Homo sapiens
ggcgcgccagtcctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattcgactcggaccgatg

SEQ ID NO: 1335 - DNA, 203 bp, Homo sapiens
ggcgcgccagtcctcaattgataatcaaaggctaaatctcttctgggatccactgaatgccactagagggtctgctcgagagaattcctgattgaatgacaacggcgctaagaacaatccctgcccaagacgggtctggagcctgacttccgggtgtccatgaccctggcggctgcttcgggtccgcccgactcggaccgatg

SEQ ID NO: 1336 - DNA, 203 bp, Homo sapiens
ggcgcgccagtcctgctgtttagaactattgtaccgctgccagtgactgtctgtattagggttgggagcaggaacatggatttgaagacattaaaactgtttaattctcagttgagatgtggttggctcttatacatttggaataaagcatttatggcacatctcagggttccacaagatgaatggaccgactcggaccgatg

SEQ ID NO: 1337 - DNA, 203 bp, Homo sapiens
ggcgcgccagtcctctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaacgactcggaccgatg

SEQ ID NO: 1338 - DNA, 203 bp, Homo sapiens
ggcgcgccagtcctataaaaccagctgagtatttgtgccaggaagactgcgtgcagaaggccttggctccttgaacttttggccgccatgtgcttcccgaaggtcctctctgatgacatgaagaagctgaaggcccgaatggtgatgtcgagcctggcagagctggaggacgacttcaaagagggctacgactcggaccgatg

SEQ ID NO: 1339 - DNA, 203 bp, Homo sapiens
ggcgcgccagtcctacctgggaaaaggaagcacaaaaaggagaagcagcaacggctgctctgcttccttcccatctcgctcttgggtcatgcctggccagcagaaagcagctccataggggaggagagccacgcaggatctcacagctgcagtctaatagtaacacagaggattcagcagtggccacccgactcggaccgatg

SEQ ID NO: 1340 - DNA, 203 bp, Homo sapiens
ggcgcgccagtcctgccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggacgacttcaaagagggctacctggagacagtcgactcggaccgatg

SEQ ID NO: 1341 - DNA, 203 bp, Homo sapiens
ggcgcgccagtcctaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctcgactcggaccgatg

SEQ ID NO: 1342 - DNA, 203 bp, Homo sapiens
ggcgcgccagtcctggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcacgactcggaccgatg

SEQ ID NO: 1343 - DNA, 203 bp, Homo sapiens
ggcgcgccagtcctgtcttcaggtcccaatcctccgcttccgcgcttgcgcgccaagacggctcggatgccggcggtctctgctgaagagagaagatggcgcttgacggaccagagcagatggagctggaggaggggaaggcaggcagcggactccgccaatattatctgtccaagattgaagaactccgactcggaccgatg

SEQ ID NO: 1344 - DNA, 203 bp, Homo sapiens
ggcgcgccagtcctacaacgctgccgccgcgctccgtgggcaactcctactactgctgggctgggctgggctgggctgggctgcgccggagctcgcctgcacagatcagctccggagaggggaaaaccacgctcctcggaccaagcctcgggagctaagtgtttctgaaagatctatccagcactccgcgactcggaccgatg

SEQ ID NO: 1345 - DNA, 203 bp, Homo sapiens
ggcgcgccagtcctcgggagcgtgcccggtccccgcccctgttcccactctccttccacctgggaccggccggggctccgcagagccaaagctcgcttgtccccggaaccgccctgctgccgccgcctgcttcctctgctcgcggttagcccgtcagtccctgctctgtgcgcgcctccatctgggcccgactcggaccgatg

SEQ ID NO: 1346 - DNA, 203 bp, Homo sapiens
ggcgcgccagtcctttgatgtaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttccccgactcggaccgatg

SEQ ID NO: 1347 - DNA, 203 bp, Homo sapiens
ggcgcgccagtcctagctaggcgcgaggctcggagtgcggccagcgggcggaggcggtctcgcatcggcggcgacggagggctcaggcgtcgtcgtttgggtggggggccgctgaactgacaagcgacatttcagctcctttcacccgccggaaccccggagccggggcccgctcagccggcgttacccgactcggaccgatg

SEQ ID NO: 1348 - DNA, 203 bp, Homo sapiens
ggcgcgccagtcctcctagacggcggtgttgctccggcagcgttcctgggagccgagggccagagactaagttaaaaggcccctccccatcttcagaacagtcctgggttctgagcctgccatccaaggaactcaggaggaggagttgacagtctcttcgttcctaaccagtgtgggacgacttcagccgactcggaccgatg

SEQ ID NO: 1349 - DNA, 203 bp, Homo sapiens
ggcgcgccagtcctggacgatcctctctcagcgtccagcctagacggcggtgttgctccggcagcgttcctgggagccgagggccagagactaagtaacagtcctgggttctgagcctgccatccaaggaactcaggaggaggagttgacagtctcttcgttcctaaccagtgtgggacgacttcagccgactcggaccgatg

SEQ ID NO: 1350 - DNA, 203 bp, Homo sapiens
ggcgcgccagtcctgtcgtggacgatcctctctcagcgtccagcctagacggcggtgttgctccggcagcgttcctgggagccgagggccagagactaagttcctgggttctgagcctgccatccaaggaactcaggaggaggagttgacagtctcttcgttcctaaccagtgtgggacgacttcagccgactcggaccgatg

SEQ ID NO: 1351 - DNA, 203 bp, Homo sapiens
ggcgcgccagtcctggaacaggcgaggaaaagtagtcccttctcggcgattctgcggagggatctccgtggggcggtgaacgccgatgattatataaggacgcgccgggtgtggcacagctagttccgtcgcagccgggatttgggtcgcagttcttgtttgtggatcgctgtgatcgtcacttgacacgactcggaccgatg

SEQ ID NO: 1352 - DNA, 203 bp, Homo sapiens
ggcgcgccagtccttaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaagttgtgggacgacttcagccgactcggaccgatg

SEQ ID NO: 1353 - DNA, 203 bp, Homo sapiens
ggcgcgccagtcctaacatgttgagctctggcatagaagaggctggtggctattttgtccttgggctgcctgttttcaggcgccatgtcagaaccggctggggatgtccgtcagaacccatgcggcagcaaggcctgccgccgcctcttcggcccagtggacagcgagcagctgagccgcgactgtgacgactcggaccgatg

SEQ ID NO: 1354 - DNA, 203 bp, Homo sapiens
ggcgcgccagtccttgggaactgggaacactggagacctgatttctaactgacgctaccgtcgcggccgccgtaaaaggcccctccccatcttcagaacagtcctgggttctgagcctgccatccaaggaactcaggaggaggagttgacagtctcttcgttcctaaccagtgtgggacgacttcagccgactcggaccgatg

SEQ ID NO: 1355 - DNA, 203 bp, Homo sapiens
ggcgcgccagtcctcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgcccgactcggaccgatg

SEQ ID NO: 1356 - DNA, 203 bp, Homo sapiens
ggcgcgccagtccttcgcactcctcgcagttggactggtgggaactgggaacactggagacctgatttctaactgacgctaccgtcgcggccgccgaacagtcctgggttctgagcctgccatccaaggaactcaggaggaggagttgacagtctcttcgttcctaaccagtgtgggacgacttcagccgactcggaccgatg

SEQ ID NO: 1357 - DNA, 203 bp, Homo sapiens
ggcgcgccagtcctagcgccggaagtacggttttcggagggatcagactcagactcacgtcgcactcctcgcagttggactggtgggaactgggaacactggagacctgatttctaactgacgctaccgtcgcggccgccgtgtgggacgacttcagcatgtctcaggccaccaagaggaagcatgtgcgactcggaccgatg

SEQ ID NO: 1358 - DNA, 203 bp, Homo sapiens
ggcgcgccagtcctgaagcggctccgcgctctgcccgtttgggcctcccccgactcggactcgcgcccgtgggctcccgccgcgcccgcccggccccgcgccggccccgcgccccctcccccgtctcggcgccccctcctcaggagccgcgggtccccgccactttcgcacggccccggcccccgccgcgactcggaccgatg

SEQ ID NO: 1359 - DNA, 203 bp, Homo sapiens
ggcgcgccagtcctccggctgccgcctaggatgaatatcatggacttcaacgtgaagaagctggcggccgacgcaggcaccttcctcagtcgcgccgtgcagatgccaggatagaagaatttgtttatgagaaactggatagaaaagctccaagtcgtataaacaacccagaacttttgggacaatatcgactcggaccgatg

SEQ ID NO: 1360 - DNA, 203 bp, Homo sapiens
ggcgcgccagtcctcctccgcgaggtctccctgagtctttgaggacacagcctcgctggaggcagtttctggtgccagtgacggggtggcccgtgagctgatgacgaggactggcttttaatccttggtggtgattaagagaaagcttattggggcctgggagcagctccccgccgacccccaccacccgactcggaccgatg

SEQ ID NO: 1361 - DNA, 203 bp, Homo sapiens
ggcgcgccagtcctgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatcgactcggaccgatg

SEQ ID NO: 1362 - DNA, 203 bp, Homo sapiens
ggcgcgccagtcctgaacacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggccgactcggaccgatg

SEQ ID NO: 1363 - DNA, 203 bp, Homo sapiens
ggcgcgccagtccttaacctcggtgcccccttcaacctcccgccccaagcacctccagggtcgtcaggggtgtagttttgagtcgcgctcctaagcatccagacaggcaggacaccgtaacgacatctctgccgggagtcccttcagactgcggtctccagacaaaaatctacgtaccatcagaaactcgactcggaccgatg

SEQ ID NO: 1364 - DNA, 203 bp, Homo sapiens
ggcgcgccagtcctggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatccgactcggaccgatg

SEQ ID NO: 1365 - DNA, 203 bp, Homo sapiens
ggcgcgccagtcctttgtcttgcgcctgccttcctaacagccttcagttccccttctcccgtcagaccttcctgacctcccacctggttctctaggggcagggtggacaggaagcagctcagcccagcctgggagaggccaagggctgcctcctatcagagagcgcctgctcgctgtgcccccgggttcgactcggaccgatg

SEQ ID NO: 1366 - DNA, 203 bp, Homo sapiens
ggcgcgccagtcctaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccacccgactcggaccgatg

SEQ ID NO: 1367 - DNA, 203 bp, Homo sapiens
ggcgcgccagtcctgaaagggcgggaaaggcagttggagaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagcccgactcggaccgatg

SEQ ID NO: 1368 - DNA, 203 bp, Homo sapiens
ggcgcgccagtcctccccgacggcggcgctaacctctcggttattccaggatctttggagacccgaggaaagccgtgttgaccaaaagcaagacaaatgactcacagagaaaaaagatggcagaaccaagggcaactaaagccgtcaggttctgaacagctggtagatgggctggcttactgaaggaccgactcggaccgatg

SEQ ID NO: 1369 - DNA, 203 bp, Homo sapiens
ggcgcgccagtcctcggttctctctggactggtggcagcgcgcggccccgaaccgcgccccaggccggcaggcggggaaggagccggtgggggtagggggtgcggtggggggtggggaccctccggctcttgggggtcccagtccccgccggctgctgagcgggtggggtggtggaggagctgcagagcgactcggaccgatg

SEQ ID NO: 1370 - DNA, 203 bp, Homo sapiens
ggcgcgccagtcctatttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggacgactcggaccgatg

SEQ ID NO: 1371 - DNA, 203 bp, Homo sapiens
ggcgcgccagtcctgcccttcccgcctctggggaagggaacttccgcttgggaccgagggcagtaggctctcggctcctggtcccactgctgctcagcccagtggcctcacaggacaccagcttcccaggaggcgtctgacacagtatgatgatgaagatcccatggggcagcatcccagtactgatgcgactcggaccgatg

SEQ ID NO: 1372 - DNA, 203 bp, Homo sapiens
ggcgcgccagtcctgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagccgactcggaccgatg

SEQ ID NO: 1373 - DNA, 203 bp, Homo sapiens
ggcgcgccagtcctggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggcgactcggaccgatg

SEQ ID NO: 1374 - DNA, 203 bp, Homo sapiens
ggcgcgccagtccttggcgcgggcgggcccgtcccccctgcccctgggtcgctctttttaagctcccctgagccggtgctgcgctcctctaattgggactccgagccggggctatttctggcgctggcgcggctccaagaaggccatcccagccatcactcttccacctgctccttagagaagggaagcgactcggaccgatg

SEQ ID NO: 1375 - DNA, 203 bp, Homo sapiens
ggcgcgccagtcctacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctacgactcggaccgatg

SEQ ID NO: 1376 - DNA, 203 bp, Homo sapiens
ggcgcgccagtcctctcctacggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggcgactcggaccgatg

SEQ ID NO: 1377 - DNA, 203 bp, Homo sapiens
ggcgcgccagtcctctggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgacgactcggaccgatg

SEQ ID NO: 1378 - DNA, 203 bp, Homo sapiens
ggcgcgccagtcctgaaattgtagtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggcgactcggaccgatg

SEQ ID NO: 1379 - DNA, 203 bp, Homo sapiens
ggcgcgccagtccttgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggcccgactcggaccgatg

SEQ ID NO: 1380 - DNA, 203 bp, Homo sapiens
ggcgcgccagtcctcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagacgactcggaccgatg

SEQ ID NO: 1381 - DNA, 203 bp, Homo sapiens
ggcgcgccagtcctgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtcgactcggaccgatg

SEQ ID NO: 1382 - DNA, 203 bp, Homo sapiens
ggcgcgccagtccttcacttccctgtactctcatcgctctcggcctccgacacgaaaaggaagcaaatgagctgatggaagatctgtttgaaactagacagggtcttgccatgttctggaactcataggctcaagtaatcttcctgcctcaacctcccaaagtgctggaattacagttccaagatgagcgactcggaccgatg

SEQ ID NO: 1383 - DNA, 203 bp, Homo sapiens
ggcgcgccagtcctcaccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctgcgactcggaccgatg

SEQ ID NO: 1384 - DNA, 203 bp, Homo sapiens
ggcgcgccagtcctgtggagaaggcttgggctcgcgccgctgaagtcggcttacccgctggccgcctcctgacaagcgggagggatccgcggtggacccagggaagcggaggagcctggcggccaccccctcttcctcacttccctgtactctcatcgctctcggcctccgacacgttccaagatgagcgactcggaccgatg

SEQ ID NO: 1385 - DNA, 203 bp, Homo sapiens
ggcgcgccagtcctagtcagttaggtaacaggccacgggccccgggctcaggccactgcacggacccagggaacgggctgacagtccagcagaggcctcagcgaggcggcggcgctgcgcacaaacctgaggacctaggcgggtgaggcggaaccaaccctcctggccatgggaggggccgtggtggacgactcggaccgatg

SEQ ID NO: 1386 - DNA, 203 bp, Homo sapiens
ggcgcgccagtcctctgctgctgcctcccagggcgctggttcacagcacggtcccagcagggagaggctgagccggttggactagaccacccaaggtctcaggttgcagctccctggtgaggcggaaccaaccctcctggccatgggaggggccgtggtggacgagggccccacaggcgtcaaggccccgactcggaccgatg

SEQ ID NO: 1387 - DNA, 203 bp, Homo sapiens
ggcgcgccagtcctagtgcagagggagtgggacccacagctgctagcctccctccaaaccctcctgcctccaccagacaccaggtgaggcggaaccaaccctcctggccatgggaggggccgtggtggacgagggccccacaggcgtcaaggcccctgacggcggctggggctgggccgtgctcttcgcgactcggaccgatg

SEQ ID NO: 1388 - DNA, 203 bp, Homo sapiens
ggcgcgccagtcctccagggcagcgaggcgctggccggcagggggcgctgcggtgccagcctgaggctgggctgctccgcgaggatacagcggcccctgccctgtcctgtcctgccctgccctgtcctgtcctgccctgccctgccctgtcctgtcctgccctgccctgccctgtgtcctcagacaatcgactcggaccgatg

SEQ ID NO: 1389 - DNA, 203 bp, Homo sapiens
ggcgcgccagtcctccccggggactgagcatccggctcagagcggcttggcagaggcccactgctcagtggagcgtggaggacgaggaggaggccgtccacgagcaatgccagcatgagagagacaggcagcttcaggcccaggacgaggagggaggcggccatgtccccgagcggccgaagcaggagcgactcggaccgatg

SEQ ID NO: 1390 - DNA, 203 bp, Homo sapiens
ggcgcgccagtcctagctgggctttgtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttccgactcggaccgatg

SEQ ID NO: 1391 - DNA, 203 bp, Homo sapiens
ggcgcgccagtcctgaactgagctcgcatactaccgcttacgcatctaaccaaccgcccatctagctaacccgagcccctccaccgtcaactcaggttcggccggtccccggcccgcctgccggagccgtggtggcagccccgggaggagcactggcgtctgtttccttcgattctcgggattcgaagcgactcggaccgatg

SEQ ID NO: 1392 - DNA, 203 bp, Homo sapiens
ggcgcgccagtcctcggagggactttctgttagcagcatgagggcctgtggttagacctatagaggtatttcctttgatttaagccagaaagtcctgagagcggatcggggagcatttgcggatcggtcactttttcctcctttctgagtctcttatcccctaccacagggacggcccaggtggcaggcgactcggaccgatg

SEQ ID NO: 1393 - DNA, 203 bp, Homo sapiens
ggcgcgccagtcctggcagagtggcgcccgcgcgtgactcccccctgccggctgcggaggtgggggggggacggcgcccccgccgtgtgcgtggggcggggatggagcacgcgccctggagccccggagccagatgctctgacctttgacccctgccgttcagctctagggcccgtgcaggccacacccgactcggaccgatg

SEQ ID NO: 1394 - DNA, 203 bp, Homo sapiens
ggcgcgccagtccttctctcccggtttcagatccgcatttgctaccagcggcggccgcggcggagccaggccggtcctcagcgcccagcaccgccgctcccggcaacccggagcgcgcaccgcaggccggcggccgagctcgcgcatcccagccatcactcttccacctgctccttagagaagggaagcgactcggaccgatg

SEQ ID NO: 1395 - DNA, 203 bp, Homo sapiens
ggcgcgccagtcctccagcggaagtaattctttcgactgccccggaacccaccggagcaggcagctgggggtgggggggcggccctgggataggggctgtggcagtacgcggggacccggctgcggtggctgcgggactgacgaatggagaggagaaaacctatggtggctgtgaaggacctgatgcccgactcggaccgatg

SEQ ID NO: 1396 - DNA, 203 bp, Homo sapiens
ggcgcgccagtcctagcgagagccacaagccacagcgctgagctgcaggcgcggcgaaacttccctctacccgcccggcccgcggcgcgcaccgttggcgctggacgcttcctccttggaagcgcctctccctcagttatggagaaaacttgtatagatgcacttcctcttactatgaattcttcagacgactcggaccgatg

SEQ ID NO: 1397 - DNA, 203 bp, Homo sapiens
ggcgcgccagtcctccagagtgcattgcggggccgcttcctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatcgactcggaccgatg

SEQ ID NO: 1398 - DNA, 203 bp, Homo sapiens
ggcgcgccagtcctcaggaaagaaggacgcggcgtctggggagcacccaggcagcaagacggggcccgggctttcgacagtggggagtgtgacgcgcttgggaaaggcaggagcgccagcggtcgggctgctcttggctaacgagaggagtccgaggcggcggcgaggggcgaacgacccgacgcaagcgactcggaccgatg

SEQ ID NO: 1399 - DNA, 203 bp, Homo sapiens
ggcgcgccagtcctgcgcactctggggaaagcggagctgcaccccgccccgtattgctgctcagctcctcagctgtgcgtgcgagggacgtcgggggtggcgccgcagcagttgcccctggtaacgggggaggcagcaggaggaggaggaggaggagggactcggcgggaggatgggcttgctctcaacgactcggaccgatg

SEQ ID NO: 1400 - DNA, 203 bp, Homo sapiens
ggcgcgccagtcctgggagcggccagccttggccaatcaggaagcgggggagagcggcgcgagaagcggcggccgcgtcctcaagccggcacctgagcggcggagacggctgtagcacaaggatctgcatctccaatggatactgaggggtttggtgagctccttcagcaagctgaacagcttgctgccgactcggaccgatg

SEQ ID NO: 1401 - DNA, 203 bp, Homo sapiens
ggcgcgccagtcctgtttcccggcaggcctcgcgtcaagacggccggcgggacgggagctgcggcgctggctacgagagtgacccagtcagcgttggttcccgtcttggccatggcctcgttcgtgacagaagttttggcacactccgggaggctggaaaaggaggatctggggacccggatcagccgcgactcggaccgatg

SEQ ID NO: 1402 - DNA, 203 bp, Homo sapiens
ggcgcgccagtcctggtatgagagcttccagggagacccgccaagatctccaggcaggccgggccaggctctctgggattccggactggcttcgcccaactggaaccccctcgatgagggggccccaggcagaccttatatgagcatcccagccatcactcttccacctgctccttagagaagggaagcgactcggaccgatg

SEQ ID NO: 1403 - DNA, 203 bp, Homo sapiens
ggcgcgccagtcctgctcccaggcagctcctggtccacctctcatgtgtccactgggctgtgtggccaaatctggaggcaggagggagcctgcaggtagacacatggaaccttctcctctctagtgctgccagtctggtgagaacagctaacgctggtcctccccgcccctcctcctctggctacaagcgactcggaccgatg

SEQ ID NO: 1404 - DNA, 203 bp, Homo sapiens
ggcgcgccagtcctttttaaaagcttcagcttctccagcatctttgcattgtgaatatcttcctgcttctagtcaaagctttctctctagtgattggaatgctgctgtaagcctgattagaggtgcctgaggatatcaccttttacaaggaagccgtgtgtgcttgagaggatctttttaaatgcattcgactcggaccgatg

SEQ ID NO: 1405 - DNA, 203 bp, Homo sapiens
ggcgcgccagtcctcagctgtctctcccctgtccccacatgtcttctaagctgttggagccggccggcgctcacttgtcttcaggaagctcggagcctttggtggagccggggagaggaagggtgggtgcaagagtgaaaggcgagaggggactgcaagcatccgggtcggctcctggccggagcaagcgactcggaccgatg

SEQ ID NO: 1406 - DNA, 203 bp, Homo sapiens
ggcgcgccagtcctccgccatctccccgtaggtgaataccgcaagcctccgaatttggcgtggtgggcgactctcgtggaatgggcagctagacatcacaaccctacatttttaccctccatctctagattgaagtgttggggtgttgttttatcaaggaagctgattcatctgaaaactacattaagcgactcggaccgatg

SEQ ID NO: 1407 - DNA, 203 bp, Homo sapiens
ggcgcgccagtccttgcgccgcgccggccgctctagcaacccctggctgtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgacgactcggaccgatg

SEQ ID NO: 1408 - DNA, 203 bp, Homo sapiens
ggcgcgccagtcctcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcacccgactcggaccgatg

SEQ ID NO: 1409 - DNA, 203 bp, Homo sapiens
ggcgcgccagtcctcgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggaggcgactcggaccgatg

SEQ ID NO: 1410 - DNA, 203 bp, Homo sapiens
ggcgcgccagtcctggaggcggtgcggcgcggcgggtgcggttcagtcggtcggcggcggcagcggaggaggaggaggaggaggaggaggaggaggatgaggaggatgtgggccacgcaggggctggcggtggcgctggctctgagcgtgctgccgggcagccgggcgctgcggccgggcgactgcgacgactcggaccgatg

SEQ ID NO: 1411 - DNA, 203 bp, Homo sapiens
ggcgcgccagtcctctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgcccgactcggaccgatg

SEQ ID NO: 1412 - DNA, 203 bp, Homo sapiens
ggcgcgccagtcctgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaacgactcggaccgatg

SEQ ID NO: 1413 - DNA, 203 bp, Homo sapiens
ggcgcgccagtcctcgcaggcgccgccgccgccgcacttccgggtgccattgcaggatgcagaaagcctcagtgttgctcttcctggcctgggtctgcttcctcttctacgctggcattgccctcttcaccagtggcttcctgctcacccgtttggagctcaccaaccatagcagctgccaagagccccgactcggaccgatg

SEQ ID NO: 1414 - DNA, 203 bp, Homo sapiens
ggcgcgccagtcctctcccagcgttcgcaaaggagggaggagccggaaactcagggcgcgaggcctgtgggcccagcggtgaggcagcagctgggggcggggggagggcggacctagcttcccagggcaggtgattcgtcggccccggtggcggcggcgcgtgcgacggtcacctcggtttggggaagcgactcggaccgatg

SEQ ID NO: 1415 - DNA, 203 bp, Homo sapiens
ggcgcgccagtcctaaggaacaaagcaccctccccactgggctcctggttgcagagctccaagtcctcacacagatacgcctgtttgagaagcagcgggcaagaaagacgcaagcccagaggccctgccatttctgtgggctcaggtccctactggctcaggcccctgcctccctcggcaaggccacacgactcggaccgatg

SEQ ID NO: 1416 - DNA, 203 bp, Homo sapiens
ggcgcgccagtcctaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagacgactcggaccgatg

SEQ ID NO: 1417 - DNA, 203 bp, Homo sapiens
ggcgcgccagtcctggatttgggcgggaagcggagccccgccagcgcccgccctggcagctgcgggctccgcgccgaccctccggcttcccctctcccccctcggccccgtcaggtggacgcggatctgtcaacatgggtaaaggagaccccaacaagccgcggggcaaaatgtcctcgtacgccttccgactcggaccgatg

SEQ ID NO: 1418 - DNA, 203 bp, Homo sapiens
ggcgcgccagtccttctgcaactggacttctgctgtgagcacagactatattctggcctatgtcttgactccgtattcctgggaaagtgctcgactgagaccttgggagtcttgggaagtccaatgggtagggtagccgaatctgagggctgatccctgagggcactgggcagtaattggggcatgggcgactcggaccgatg

SEQ ID NO: 1419 - DNA, 203 bp, Homo sapiens
ggcgcgccagtccttcccttgacgaccctcctctctgggccccgcccctcccgcttcggggtcaagccccagagagcgccgcgaaaaccacatttcccagagtgcaccgcgacggcaggggtcctcagaccggcgctcgctcgccggcgccatccctatagagaagaacggaggtacggcctgtggtccgactcggaccgatg

SEQ ID NO: 1420 - DNA, 203 bp, Homo sapiens
ggcgcgccagtcctggctgggctgctctgtgatggcttccgggaggagggaggtggcctgctgtaggaaaatgctgggtggaagaagggagagaaggctggagaggtaggaaggaactgaagtatctgaagtgacaaggtgggtgtctggactcgtcgggtccccttccatctccctgctgcctccaccgactcggaccgatg

SEQ ID NO: 1421 - DNA, 203 bp, Homo sapiens
ggcgcgccagtcctgggaggctcaggagggcgagagtcatgacacggaggaactggaggggcaaaagctgaggggccccgaggagggactgagttgaatggccttaggggagagattcttcagaggaggcccctccagccactcagaacttcatcattccaaaaaaggagatccacacagttccagaccgactcggaccgatg

SEQ ID NO: 1422 - DNA, 203 bp, Homo sapiens
ggcgcgccagtcctcacagccatcttgggatctgggcaagtgagcgagctccttcctcaccgggctgactagcctctcctttccctgtccccctccatcgctgctctgcaggaagccagcccccagggccagtcccggaggggctgatccgcatctacagcatgaggttctgcccctattctcacaggcgactcggaccgatg

SEQ ID NO: 1423 - DNA, 203 bp, Homo sapiens
ggcgcgccagtcctgttccggcgccggctttggcggaggggtgggacttgcaccggcgtctcttcttctaactgcagtttgtggcagcgccattttgaatgtgcagctgcagcgggcgcctgtatccggtgtccgaggcgaactcagtaagatgatgttaagaggaaacctgaagcaagtgcgcattgcgactcggaccgatg

SEQ ID NO: 1424 - DNA, 203 bp, Homo sapiens
ggcgcgccagtcctcagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagcgactcggaccgatg

SEQ ID NO: 1425 - DNA, 203 bp, Homo sapiens
ggcgcgccagtcctatgtaaatccttgtttttcctggtgaggcaggggaggccatagccacaatgcttaactgcatgcatctaacatggggctggttttaaccccagcgctctgacctaaactgctcagctcccggaaattccaagggacctggtggccttagtctttcaggtggaacggtgtgcgaccgactcggaccgatg

SEQ ID NO: 1426 - DNA, 203 bp, Homo sapiens
ggcgcgccagtcctaaacgtcaggtatcttttaaatcgcgatagttttcgctgtgtcaggctttcttcggtggagctccgagggtagctaggttctaggtttgaaacagatgcagaatccaaaggcagcgcaaaaaacagccaccgattttgctatgtctctgagctgcgagataatcagacagctaacgactcggaccgatg

SEQ ID NO: 1427 - DNA, 203 bp, Homo sapiens
ggcgcgccagtcctcctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacacgactcggaccgatg

SEQ ID NO: 1428 - DNA, 203 bp, Homo sapiens
ggcgcgccagtccttttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagcgactcggaccgatg

SEQ ID NO: 1429 - DNA, 203 bp, Homo sapiens
ggcgcgccagtcctacatacacatacacatgcacacacacactcatatacacatgcagaagctgtgacacgtgcggaagctgtggtaagtgcatcctccttcagtctcagttctgaaaatagatcatcatggtggcaccaaagagtcacacagatgactgggctcctgggcctttctccagtaagccacgactcggaccgatg

SEQ ID NO: 1430 - DNA, 203 bp, Homo sapiens
ggcgcgccagtcctctgcgtggaacgattctgtggcgagtgccggccgaaagctaggtccggattgcacgtggagggccgcccgaagggcactctcggacattaacccgcattctggtgggtctagaggaaattgggggacgaagagtggcagcactgacctggtctgggacgtggggagaaggtacccgactcggaccgatg

SEQ ID NO: 1431 - DNA, 203 bp, Homo sapiens
ggcgcgccagtcctctccggacgggcgacggtagctcgagacccgggactccgcccgcctccccgcgagtatttgaggtccggggcggctccggcgcctctgcccgccgttctgctcgctcgctccccgctctggagtacgtgtctggcttgggagccgctcggacacgctggcttgggtctgccatccgactcggaccgatg

SEQ ID NO: 1432 - DNA, 203 bp, Homo sapiens
ggcgcgccagtcctggagctggagtccggctgggccgcagccgctgggagaccggcggttgccgtggggaccggtcgggcccctccctcctccggtcccccgccccaggtccttccccaccgagacgcgccgggggaccgcgggcgagtgcagccggtgacccggcgagaggcggcgccgctcccaagcgactcggaccgatg

SEQ ID NO: 1433 - DNA, 203 bp, Homo sapiens
ggcgcgccagtcctccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccacgactcggaccgatg

SEQ ID NO: 1434 - DNA, 203 bp, Homo sapiens
ggcgcgccagtcctaggtggacatttccatttgaattaaaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaagcgtctgccatccgactcggaccgatg

SEQ ID NO: 1435 - DNA, 203 bp, Homo sapiens
ggcgcgccagtcctggagttcggggaggcacagggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccgactcggaccgatg

SEQ ID NO: 1436 - DNA, 203 bp, Homo sapiens
ggcgcgccagtccttgccagagggcggggccgcaggagggcggggcgcgagcgagagctgggagaaggcagtgagcgagcaggcggcaggcagggtccgtgcggagcaggcgagcgagcgggaagacgcagccaccttcctcaccagccagcccacagcggtttgttccccttctcgggagtgcgccacgactcggaccgatg

SEQ ID NO: 1437 - DNA, 203 bp, Homo sapiens
ggcgcgccagtcctatgattgttccacataaagtcagaagggaggaaaggcgcacgcgcattggggacttgactctggaaagcgtccagaccaaggtcagcggagagtaggccgtcgctttcgggttctctcatcgcttcgtcgttcgccaatgtttgaggagaaggccagcagtccttcagggaagacgactcggaccgatg

SEQ ID NO: 1438 - DNA, 203 bp, Homo sapiens
ggcgcgccagtcctgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggccgactcggaccgatg

SEQ ID NO: 1439 - DNA, 203 bp, Homo sapiens
ggcgcgccagtcctcggaagaacttccttgattagcatagtatcgaccctggggccgcgctgcgaggcggaggttcggtcccagctggggtgaagtgtgcagaccggttgcgattgtggtcagacgcagcacctacttctaatctgaggacccgcgatttacacttttgctgaataggacactgtggacgactcggaccgatg

SEQ ID NO: 1440 - DNA, 203 bp, Homo sapiens
ggcgcgccagtcctctctcctgaacaaaggcgggaacagctctaggccagagtttctgggatgtgcctcaccgggtctcactgcctgcaaaggtagatggaacgcagctgagaggtctgacaagatgtaccaggtcccactaccactggatcgggatgggaccctggtacggctccgcttcaccatggcgactcggaccgatg

SEQ ID NO: 1441 - DNA, 203 bp, Homo sapiens
ggcgcgccagtcctccctgctaacaaagggagccacttccttcctctctgcacataccccatgtctcaccacgatgatggagctacagtgggacttggaatccagatgtgtgaaggatggagggttgaagccgcactcagcttcctgccccaccagaggaagtggggagagacggcaggtgcagtgatcgactcggaccgatg

SEQ ID NO: 1442 - DNA, 203 bp, Homo sapiens
ggcgcgccagtcctttgagcgtctccacccagtaagtgggcaagaggcggcaggaagtgggtacgcaggggcgcaaggcgcacagcctctagacgactcgctttccctccggccaacctctgaagccgcgtcctactttgacagctgcagggccgcggcctggtcttctgtgcttcaccatctacatacgactcggaccgatg

SEQ ID NO: 1443 - DNA, 203 bp, Homo sapiens
ggcgcgccagtcctggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggacccgactcggaccgatg

SEQ ID NO: 1444 - DNA, 203 bp, Homo sapiens
ggcgcgccagtcctcgggcgagcggagttagcagggctttactgcagagcgcgccgggcactccagcgaccgtggggatcagcgtaggtgagctgtggccttttgcgaggtgctgcagccatagctacgtgcgttcgctacgaggattgagcgtctccacccatcttctgtgcttcaccatctacatacgactcggaccgatg

SEQ ID NO: 1445 - DNA, 203 bp, Homo sapiens
ggcgcgccagtcctccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagccgactcggaccgatg

SEQ ID NO: 1446 - DNA, 203 bp, Homo sapiens
ggcgcgccagtcctgacgcgcggggccacactgcccgccccctagcctggcgctgggcctccgggacaagttggctgggtccgggcttggggactgcaacgcggtcttctgtgcttcaccatctacataatgaatcccagtatgaagcagaaacaagaagaaatcaaagagaatataaagaatagttccgactcggaccgatg

SEQ ID NO: 1447 - DNA, 203 bp, Homo sapiens
ggcgcgccagtcctggtttcattgtgttggccaggctggtctcgaactcctgacctcgtgatccgcccgccttggcctcccaaagtgctaggattacaagtgtgagccaccgcgtccggcctttcaaatggtatttttgattttcctcttccagtccttaaagcagctgatttagaagaatacaaatccgactcggaccgatg

SEQ ID NO: 1448 - DNA, 203 bp, Homo sapiens
ggcgcgccagtcctcgctgacgtcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgacgactcggaccgatg

SEQ ID NO: 1449 - DNA, 203 bp, Homo sapiens
ggcgcgccagtcctcggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctccgtggaggacccgccgcgccccccggccgactcggaccgatg

SEQ ID NO: 1450 - DNA, 203 bp, Homo sapiens
ggcgcgccagtcctagagggaccgagggccggaagtgacgccagctggcccgcttgaggcgtagggggtggcgctctccgttcggcggcgctcccatggcgcacattaccattaaccagtacctgcagcaggtgtacgaagccatcgacagcagagatggagcatcttgtgcagagttggtgtcttttcgactcggaccgatg

SEQ ID NO: 1451 - DNA, 203 bp, Homo sapiens
ggcgcgccagtcctcacttctgccgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacaggtactgctgggccggaaggtcgactcggaccgatg

SEQ ID NO: 1452 - DNA, 203 bp, Homo sapiens
ggcgcgccagtcctgtgtgaggggaacctgggagggcctcatgggggtccgagcttcgttcgagaacaactgtgagatcggctgctttgccaagctcaccaacacctactgtctggtagcgatcggaggctcagagaacttctacagtgtgttcgagggcgagctctccgataccatccccgtggtgccgactcggaccgatg

SEQ ID NO: 1453 - DNA, 203 bp, Homo sapiens
ggcgcgccagtcctcgcccctgtttcaagggataagaaaccctgcgacaaaacctcctccttttccaagcggctgccgaagatggcggaggtgcaggtcctggtgcttgatggtcgaggccatctcctgggccgcctggcggccatcgtggctaaacagtgaagtacctggctttcctccgcaagcggcgactcggaccgatg

SEQ ID NO: 1454 - DNA, 203 bp, Homo sapiens
ggcgcgccagtcctagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacggacccggcggccgactcggaccgatg

SEQ ID NO: 1455 - DNA, 203 bp, Homo sapiens
ggcgcgccagtcctagtagagtccagagcggggaagcgggcgcctgcgcagagacatagtgaccgtccgctcgccgccccgcctctgccaagccgcgccagcgcagtgaataacgagccagcagagacagcgtctgcgcagccgtggctgaggagcctgtggcggcagcggcgatggaaccagcggagcgactcggaccgatg

SEQ ID NO: 1456 - DNA, 203 bp, Homo sapiens
ggcgcgccagtcctccactcagagctgcagtagcctggaggttcagagagccgggctactctgagaagaagacaccaagtggattctgcttcccctgggacagcactgagcgagtgtggagagaggtacagccctcggcctacaagctctttagtcttgaaagcgccacaagcagcagctgctgagcccgactcggaccgatg

SEQ ID NO: 1457 - DNA, 203 bp, Homo sapiens
ggcgcgccagtcctgcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaacgactcggaccgatg

SEQ ID NO: 1458 - DNA, 203 bp, Homo sapiens
ggcgcgccagtcctcaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggcgactcggaccgatg

SEQ ID NO: 1459 - DNA, 203 bp, Homo sapiens
ggcgcgccagtcctcctctgaggaggcgttgtaagtccgcccagctccccacttgctgtgctctcactcaatgcgaagggaaccaaggtaccagggccaagtgggtccagacatccacacggattctgaaagggcaggtcaagcagactttgtccagccatcagccacggcctctcgacagcaccaagcgactcggaccgatg

SEQ ID NO: 1460 - DNA, 203 bp, Homo sapiens
ggcgcgccagtcctgagggctggcggcttttctggcgcgggccagggggaggaggagaaaggagctcccgggatcccctcgccccctcccccaactgcccggtgcggctggtgatcgccgagaagggcctggtgtgcgaggagcgggacgtgagcctgccacagagcgagcacaaggagccctggttccgactcggaccgatg

SEQ ID NO: 1461 - DNA, 203 bp, Homo sapiens
ggcgcgccagtcctcaccatgccgccacattatctccattcctccagtgcccgcctgacactggccctgaatcagggctggagggggcaggcatttctcatttactaaagtgctggatgcagcccttgaggttcggcagaagcagaaagctgcgtcttgaaagcgccacaagcagcagctgctgagcccgactcggaccgatg

SEQ ID NO: 1462 - DNA, 203 bp, Homo sapiens
ggcgcgccagtcctttatctccattcctccagtgcccgcctgacactggccctgaatcagggctggagggggcaggcatttctcatttactaaagtgctggatgcagcccttgaggttcggcagaagcagaaagctgcggtgagtctggctgtgtcttgaaagcgccacaagcagcagctgctgagcccgactcggaccgatg

SEQ ID NO: 1463 - DNA, 203 bp, Homo sapiens
ggcgcgccagtcctgctgactgccactaccagccggagccagggcctggtcgagacaactatttttgaggtatctgaggctaccccacagcactctctggcattggcaagactcgtggctgtgacccatgggcctctgaggaggcgttgtaagtccgcccagctccccacttgctgtgctctcactcacgactcggaccgatg

SEQ ID NO: 1464 - DNA, 203 bp, Homo sapiens
ggcgcgccagtccttctttttgtttgcacccgcctccgacccggaactgctttcttgggaagatggcggctgtgtcggtgtatgctccaccagttggaggcttctcttttgataactgccgcaggaatgccgtcttggaagccgattttgcaaagaggggatacaagcttccaaaggtccggaaaactcgactcggaccgatg

SEQ ID NO: 1465 - DNA, 203 bp, Homo sapiens
ggcgcgccagtcctagcacctaccagggtcgagctcacacacgtgcctacgacccgccgcggcgcctgcgcggtagcatcgcggagtcggtgctttagtacgccgctggcacctttactctcgccggccgcgcgaacccgtttgagctcggtatcctagtgcacacgccttgcaagcgacggcgccatcgactcggaccgatg

SEQ ID NO: 1466 - DNA, 203 bp, Homo sapiens
ggcgcgccagtcctgagcccggcctcaggccccgggccgcggagggtgcagcgccgggcctggcctcccgataaagaacaggaaaaagagaaaaaatcagtgagacggcgtcttgctgtgttgcccaggctggcctccaactcctgggctcaagtgatcctctggcatcagcctcctgagtagctgtgcgactcggaccgatg

SEQ ID NO: 1467 - DNA, 203 bp, Homo sapiens
ggcgcgccagtcctatcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgcgactcggaccgatg

SEQ ID NO: 1468 - DNA, 203 bp, Homo sapiens
ggcgcgccagtcctggcagagctggagctggagtaatgtgggtgggggcggcttgggaagaggctgagcccggccaagggagcagagggctgggactggctgggggttgggaggggaggaacgaagcaggaaggctgtcggatcgggggcccagggtgtccgagtgaactgggtgattcagagacacgcgactcggaccgatg

SEQ ID NO: 1469 - DNA, 203 bp, Homo sapiens
ggcgcgccagtcctacgcagagagaaagttacgaggttcgtggccgcggtttccccaggcagctggcgctggaggcttcggcgtcacgtgctgaaactcgttttcatcttcttggtttcatcttaataccaacgtcatgtctggttctaatggttccaaagaaaattctcacaataaggctcggacgtcgactcggaccgatg

SEQ ID NO: 1470 - DNA, 203 bp, Homo sapiens
ggcgcgccagtcctgagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtacgactcggaccgatg

SEQ ID NO: 1471 - DNA, 203 bp, Homo sapiens
ggcgcgccagtcctcctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagcccgactcggaccgatg

SEQ ID NO: 1472 - DNA, 203 bp, Homo sapiens
ggcgcgccagtcctagcggaagtcacttctcacacgcctttcttattggataccggcttttcatggggccgagcgccgctgggtaggcggaagtagccgcaggcatggcggcggctatgccgcttgctctgctcgtcctgttgctcctggggcccggcggctggtgccttgcagaacccccacgcgaccgactcggaccgatg

SEQ ID NO: 1473 - DNA, 203 bp, Homo sapiens
ggcgcgccagtcctggaccagagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagaggacctaatcgactcggaccgatg

SEQ ID NO: 1474 - DNA, 203 bp, Homo sapiens
ggcgcgccagtcctgcgggtttccgggtgggaggggccgggaatcggggccgtgaagggaagccctcgagggccggccgggagcccggaaaccgaggtcccccttcggccagttttaatccccccgccctcccctctgccccaggcccggcagccatggcggtggaaggaggaatgaaatgtgtgaagcgactcggaccgatg

SEQ ID NO: 1475 - DNA, 203 bp, Homo sapiens
ggcgcgccagtcctcgccgaccgagcctgctgctttcttgctactgcttcggcttcccggctaccccccggacggtgaaggcggcccagctgtggatggtcagatagcccttgtctcccgccgccaatctctggcccctagcagcacggagcagacggcggcagcagcagcagcaggcgaggaggaagcgactcggaccgatg

SEQ ID NO: 1476 - DNA, 203 bp, Homo sapiens
ggcgcgccagtcctgccggtggctggctgcgcacgcgcgccgcctcatttccggtgctctctctcgctgggtcgctcgggtcggcttcggtcgctaccgctcccgctctgccacccccgccaaccgccgctcgggcctccgtcgctgccgcgtcgctttctcgctccttggatcgcacatcctcccagcgactcggaccgatg

SEQ ID NO: 1477 - DNA, 203 bp, Homo sapiens
ggcgcgccagtcctgccgtcgcggagccgcgcagccctcggagcacgaatatatacagccctgctctgggacacacctccattggatttaaaagacagtcctcgtcagcactgactttcagctatggaatcgacggttgatgatgaagcgccggccgtgtaaatgaagatcgggtgaggagcaggacgcgactcggaccgatg

SEQ ID NO: 1478 - DNA, 203 bp, Homo sapiens
ggcgcgccagtcctgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttcgactcggaccgatg

SEQ ID NO: 1479 - DNA, 203 bp, Homo sapiens
ggcgcgccagtcctctgcaccaatagctgaggcgttcagggttgtccagggacgctaccctcacgtgtctggttccgagtgctgcgttcggctgtgctgggaagttgcgtagacagtggcctcgagaccctgcctgcctgaggaggcctcggttggatgcgaaggagctgcagcatccaggggacaagcgactcggaccgatg

SEQ ID NO: 1480 - DNA, 203 bp, Homo sapiens
ggcgcgccagtcctcaggcgggacgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctcgactcggaccgatg

SEQ ID NO: 1481 - DNA, 203 bp, Homo sapiens
ggcgcgccagtccttgccagtcccactgcctgcgcgcccacctgggccagtctccgcttgccgcgtcctcccatcccctagtctgcaggcctggtgcccttgaattcacccgcttctgttgcgttggggaccgcgagctgcactgcttcctgcccaagcccaagctcctcgcagcagtaggggacaagcgactcggaccgatg

SEQ ID NO: 1482 - DNA, 203 bp, Homo sapiens
ggcgcgccagtcctgctcagaggagcagggctgggagcgaggtgctgctggggcagtgtctgggcgggaagccgggccccagggcctgatgtgcctgtgggggcactccacagcccctgcccacaccctctcctccccgcctctgctgttctgctccctgccctgtgccctccacttgcagccagggacgactcggaccgatg

SEQ ID NO: 1483 - DNA, 203 bp, Homo sapiens
ggcgcgccagtcctactccactagggcacgcaggcgacgagcacactggcagagggcctcccgcagggcccactccccacctggctctcgccccaccatggcccgggaagcaggccaggtttgtgccaggcctgccgtgcccagggggaggaagggctctgtgttctttgcctgtgtctctgtggtgacgactcggaccgatg

SEQ ID NO: 1484 - DNA, 203 bp, Homo sapiens
ggcgcgccagtcctcccgggtccgcaaagccggtggcgcccggaggctgcacggagagcggtgcccgcgtcagagcctcgccctgtcaccaggctggagtacagtggcgcgatctcggctcactgcaacttccacctgctgggttcaagcaattcttctgacctcagtgaccgaaggaagagaccaagcgactcggaccgatg

SEQ ID NO: 1485 - DNA, 203 bp, Homo sapiens
ggcgcgccagtcctaaaaatacaaggaaccttgacccgctggtgtacctgttgtcaaagctcacggaagacaaagagactctgcagtacttacaacagaatgcaaaagaaagagctgagcttgcagccgctgctgtgggcagcagtaccaccagcatcaacgtccctgccgcggcctccaagatctcccgactcggaccgatg

SEQ ID NO: 1486 - DNA, 203 bp, Homo sapiens
ggcgcgccagtcctctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgcgactcggaccgatg

SEQ ID NO: 1487 - DNA, 203 bp, Homo sapiens
ggcgcgccagtcctgagaggcgcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcacgactcggaccgatg

SEQ ID NO: 1488 - DNA, 203 bp, Homo sapiens
ggcgcgccagtcctagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagacgactcggaccgatg

SEQ ID NO: 1489 - DNA, 203 bp, Homo sapiens
ggcgcgccagtcctcctttgccccggacccgccaccccagagtcaagctgagggcatcggcatgccgcagggaagacgatcaggactgtttttaatcgggcagtcgcgcggatggccttttccctctcgcctccttccgccccgcccccactctcagcccggccgcgctgattgtcctgggtcacatacgactcggaccgatg

SEQ ID NO: 1490 - DNA, 203 bp, Homo sapiens
ggcgcgccagtcctaagacgggagaaaaggaggggcgtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagcgactcggaccgatg

SEQ ID NO: 1491 - DNA, 203 bp, Homo sapiens
ggcgcgccagtcctcccaggccgggtgaggcgttcccggaggtgtccagcagaggacgctgccggcggagacgggaccggaagccgggccgcaggcggccgggcgtattcgccgactcctcccgcttccgctgccgcagccggtcgtaaccaagttgtgtcctgtcagccgctgtccccttcgccgcgcgactcggaccgatg

SEQ ID NO: 1492 - DNA, 203 bp, Homo sapiens
ggcgcgccagtcctatcacaacttggttcaatgggtagcctcaccatgaaatcacagcttcagatcactgtatcgttacccctgtgagtaaattacattttcgtgtgtggagtcaccagacactgaaatctgatgttttgttgggaactgctgcattagatatttatgaaacattaaagtcaaacaatcgactcggaccgatg

SEQ ID NO: 1493 - DNA, 203 bp, Homo sapiens
ggcgcgccagtcctatggtaacgaggaggccagtcacaaatagctgggactggcttcctgccggggcggccccagaggctgtcccttgcagacacatgcccctttcacggctccctctcagggttggccagaaggaatttttttttccgctccccctcctggtccctcccatttcctggctcctcctgcgactcggaccgatg

SEQ ID NO: 1494 - DNA, 203 bp, Homo sapiens
ggcgcgccagtccttgacacctctcctactccttctctttaatgtacagctgagactgggatacccttagactgaaaggaaggacacggctatgtagaaaagaattgactgaaggggaggagtactcgtgaaccccttgcttcagcctcccaatgttctgagagaggaggagccaggcgcagtggctccgactcggaccgatg

SEQ ID NO: 1495 - DNA, 203 bp, Homo sapiens
ggcgcgccagtcctgcgtgtgtggctgcagcctgcaccgttgctgcccgctgcccaggacgcggggtgggggacaggagccagagtggtgcctcctacagaccaatctgcggccccaaggtggggggccctacagagatgctccgagagccaaggacatgaagaacaagctggggatcttcagacggccgactcggaccgatg

SEQ ID NO: 1496 - DNA, 203 bp, Homo sapiens
ggcgcgccagtccttctggaggcccttcctgagaagccgtcgccagagttacgtcgcggttttcttaactttagagcctgggggccggagaccctgattgcactcgacctggctctgccctactctctgcgtgacttccactgttcatcaaagaaaaagggttcttttggtcacccaccactggcccccgactcggaccgatg

SEQ ID NO: 1497 - DNA, 203 bp, Homo sapiens
ggcgcgccagtcctggccccgcggcccgcgcgctcctgggcgggggatgttgtgatggagaagccgcggcggagcccgaaccccgcagcctgagccacctccgtcatctgggcccggggcctcaccgcgcaggagctgccaaggccatgtctgttccatcatcactgagccagtcggccattaatgcccgactcggaccgatg

SEQ ID NO: 1498 - DNA, 203 bp, Homo sapiens
ggcgcgccagtcctagacgctctgccctggtgagaagggggcgggatgagcttttctctgcagcccagcaccaggctgtgagcccagctggctgggctggaggggctgtgaggagggagggtggaggcaggaggggccgggaatgagcgccatgttctcccaggactttttcctggccattatcctgccgactcggaccgatg

SEQ ID NO: 1499 - DNA, 203 bp, Homo sapiens
ggcgcgccagtcctggccccaggcagctggggtattccttaggggctgagtctcctggtatccctaagactgggcttggcttaggcactgaggactttttcctggccattatcctgcaggacagcagcgcagattccttctggaaccccaacgccttcgagacggattccgacctgccggctggatggcgactcggaccgatg

SEQ ID NO: 1500 - DNA, 203 bp, Homo sapiens
ggcgcgccagtcctggtctcagaatatctgggagacctcgggctcttgatctccgagacaccccgtttcgtagtggagaacagtccagatcggggaagtttattttgcccaaagccggttagaggccccctggccctcgattcccagtgcggggctcagagctcccctgaacagcagctgcagcagcccgactcggaccgatg

SEQ ID NO: 1501 - DNA, 203 bp, Homo sapiens
ggcgcgccagtcctacgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggaccgactcggaccgatg

SEQ ID NO: 1502 - DNA, 203 bp, Homo sapiens
ggcgcgccagtcctccacgcgcctgccaagccaatcggctaggagcagcgagcggcgcggctgaggcgcggcggccccgtggagcagcgcagtatggcgggcggggcccgggaggtgctcacactgcagttgggacattttgccggtttcgtgggcgcgcactggtggaaccagcaggatgctgcgctcgactcggaccgatg

SEQ ID NO: 1503 - DNA, 203 bp, Homo sapiens
ggcgcgccagtcctagcacccaaacttaccctgtccaggtggcccacgaagctacccaagacatctctgcacagccctagcctttttggcttcacccactccgttcgggagttggggacccggcctctacattccttaggggaactccagctccaggtctgagagtcactggagctaccagaagcatccgactcggaccgatg

SEQ ID NO: 1504 - DNA, 203 bp, Homo sapiens
ggcgcgccagtcctaactacagctcccagcatgccccggggcccgcaaccgtccgccgcccggtgcactgtggacgatgagtcagggttaggggcgccaggacgtgggcgtgcaggacgccagagctgggtcagagctcgagccagcggcgcccggagagattcggagatgcaggcggctcggatggccgactcggaccgatg

SEQ ID NO: 1505 - DNA, 203 bp, Homo sapiens
ggcgcgccagtcctgcatggtaagcaacaggacatatcccagcctcggacatgtctgtatgatccaaggtacccaaagtcagacagagtaaactcaagcctggcactggctttctgccgcttcatgtgctttggaaaaagcaggagaagcaatagcagcaggagtccccagcagctggagccgcaagacgactcggaccgatg

SEQ ID NO: 1506 - DNA, 203 bp, Homo sapiens
ggcgcgccagtcctgtcactatacagagacagtccatgttggggggcctggccgcggcggcgggaacccggataatgggaaaggagatagaagcagaagcacagaggcccctgaggcaaacatggagacctggccagccaccagcgatgacagcaaagacgatgagctcgcggctcacggcgctcctgcgactcggaccgatg

SEQ ID NO: 1507 - DNA, 203 bp, Homo sapiens
ggcgcgccagtcctcagccgccgccggcgccgaacttgggctcgggaagccgggggaccgcgtcctgcgccggagcaggggcatggtctagtggcccagtcaggacgcggaaacactccctggaggttctgacccactccctctcagcctccgcctggtctctggtgtagtcgccgccgccagccgcccgactcggaccgatg

SEQ ID NO: 1508 - DNA, 203 bp, Homo sapiens
ggcgcgccagtcctagaaggaggaaccttttccttctgcagcccctccccaccagcctcattccttagctggggtcagacctggggtcctcactgcagctggcctctggcagcgttctcaggctagccctccctgctgaaaagagaaccgtgtgggactcacaggtgtagtcgccgccgccagccgcccgactcggaccgatg

SEQ ID NO: 1509 - DNA, 203 bp, Homo sapiens
ggcgcgccagtcctgacataaaaaccgggtgccggcaggcgccagtcgcaggtgtgctgctgaggcgtgagaatggcgtcccgcggccggcgtccggagcatggcggacccccagagctgttttatgacgagacagaagcccggaaatacgttcgcaactcacggatgattgatatccagaccaggatcgactcggaccgatg

SEQ ID NO: 1510 - DNA, 203 bp, Homo sapiens
ggcgcgccagtccttatgctgtgttcggggctgtctgtcggcgccacagggaatgggggctggggcatggtctagtggcccagtcaggacgcggaaacactccctggaggttctgacccactccctctcagcctccgcctggtctctggtgtagtcgccgccgccagccgccatgggcaaacagaacacgactcggaccgatg

SEQ ID NO: 1511 - DNA, 203 bp, Homo sapiens
ggcgcgccagtcctggggtcccccccgcaggtactccactctcagtctgcaaaagtgtacgcccgcagagccgccccaggtgcctgggtgttgtgtgattgacgcggggaaggaggggtcagccgatccctccccaaccctccatcccatccctgaggattgggctggtacccgcgtctctcggacagcgactcggaccgatg

SEQ ID NO: 1512 - DNA, 203 bp, Homo sapiens
ggcgcgccagtcctccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaagcacgtggtgaggtgtgtcgactcggaccgatg

SEQ ID NO: 1513 - DNA, 203 bp, Homo sapiens
ggcgcgccagtcctgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggcccgactcggaccgatg

SEQ ID NO: 1514 - DNA, 203 bp, Homo sapiens
ggcgcgccagtcctagcggcctttctctgttcgcgatgtgacgtaacgcgcctgcggactgggcccagcttgtcctctatgacttacccagaaggcaacgcttctctttctggtcaaaatggctggtaagcaggccgtttcagcatcaggcaagtggctggatggtattcgaaaatggtattacaatgcgactcggaccgatg

SEQ ID NO: 1515 - DNA, 203 bp, Homo sapiens
ggcgcgccagtcctcaactcgggaatccccggtgactttgtcgcagcctccgttaccctgtgatctgcaagtcctgggagacgcacagctaagatgcccggacatcctggaagctgggaaatggtattgctgtctctaagccagacctgatcacctgtctggagcaagaaaaagagccttgggagcctcgactcggaccgatg

SEQ ID NO: 1516 - DNA, 203 bp, Homo sapiens
ggcgcgccagtcctggcttccgggatgtggcggggcctttgtctctggctgcagttggagctctgcgtctcgtcttcgttcttctgtgtcctctgctgctagaggtccagcctctgtggctctgtgacctgcgggtattgggggatccacagctaagacgccaggaccccccggaagcctagaaatggcgactcggaccgatg

SEQ ID NO: 1517 - DNA, 203 bp, Homo sapiens
ggcgcgccagtccttttgtctccagctcccgctagaccttgggacccgcctctgcttttccgcgttctccaactcgggaatccccggtgactttgtcgcagcctccgttaccctgtgatctgcaagtcctgggagacgcacagctaagatgcccggacatcctggaagctgggaaatgggaccattgacgactcggaccgatg

SEQ ID NO: 1518 - DNA, 203 bp, Homo sapiens
ggcgcgccagtcctcgagccaggggcggtgcaagccccgcccggccctacccagggcggctcctccctccgcagcgccgagacttttagtttcgctttcgctaaaggggccccagacccttgctgcggagcgacggagagagactgtgccagtcccagccgccctaccgccgtgggaacgatgctgtacgactcggaccgatg

SEQ ID NO: 1519 - DNA, 203 bp, Homo sapiens
ggcgcgccagtcctttcttctgtgtcctctgctgctagaggtccagcctctgtggctctgtgacctgcgggtattgggggatccacagctaagacgccaggaccccccggaagcctagaaatggtattgctgtctctaagccagacctgatcacctgtctggagcaagaaaaagagccttgggagcctcgactcggaccgatg

SEQ ID NO: 1520 - DNA, 203 bp, Homo sapiens
ggcgcgccagtcctacccagcctccctccacccccagaaaattgcttccatggaaatgcctctctaaaacatgaacttttcctagagactacgccagtctctcttcccacttgctgaccctttgctacctatgtgcccggttttactctcatttgggtaaggtcgaggctggctctggaagcagcacccgactcggaccgatg

SEQ ID NO: 1521 - DNA, 203 bp, Homo sapiens
ggcgcgccagtccttcccccgccccaggtccttccccaccgagacgcgccgggggaccgcgggcgagtgcagccggtgacccggcgagaggcggcgccgctcccaagatgtcgcagacggccatgtccgaaacctagggtccgtgacgagaagttattaccgaggcgcggccggggctctcctcgtctcgactcggaccgatg

SEQ ID NO: 1522 - DNA, 203 bp, Homo sapiens
ggcgcgccagtcctcgtcccgggaccgcagactcttagggcccctctctttggccatctgcctctaggtcccatcctggggcctgaagcgcttgttctctgcgctgggaaaaggggaacgatggagcgatccagcacccaaacttaccctgtccaggtctgagagtcactggagctaccagaagcatccgactcggaccgatg

SEQ ID NO: 1523 - DNA, 203 bp, Homo sapiens
ggcgcgccagtccttcccttgcttgttctcactctgtgcccccggcaacgaccccgcgcgcctacactcccgtgccgcctcagctactagtccgcaacttctagccccaaaacgctggagctcagaacccagctcaggcaagactaactcggtgttgctcctcccggcgctgacttcgaggcccggctcgactcggaccgatg

SEQ ID NO: 1524 - DNA, 203 bp, Homo sapiens
ggcgcgccagtcctgagtttttattattacagagaagaaggaaactcacttcctgtcgtcgcagagcacagcctagttctgatgcagaggggactgttttcagatggagacactagtaagaagaagaaaaatgtcaccatgcgatccatcaagaccacccgggaccgagtgcctacatatcagtacaacgactcggaccgatg

SEQ ID NO: 1525 - DNA, 203 bp, Homo sapiens
ggcgcgccagtcctcctcgcggctcgcggcggccgacggttcctgggacacctgcttgcttggcccgtccggcggctcagggcttctctgctgcgctcccggttcgctggacgggaagaagggctgggccgtcccgtcccgtccccatcggaaccccaagtcgcgccgctgacccgtcgcagggcgagcgactcggaccgatg

SEQ ID NO: 1526 - DNA, 203 bp, Homo sapiens
ggcgcgccagtcctcatttggggagaatgagggagaaaagaacgggcattccgagccaagagcactgcatgagcaaggagttgggaggttgcttacttgttgaacatatttgttgcgtatttgcatatttgctaaacaggttttcgtaacaccccagggcctgtaaggtttggtgtttccctttcaagcgactcggaccgatg

SEQ ID NO: 1527 - DNA, 203 bp, Homo sapiens
ggcgcgccagtcctcgcgacttttgctttacccttctgctgtgctactgctgtcgcgagacttcctgctcatctgccgctccctttgccgccgccttagcccgggacccgaacccagcctctcccctacccgaacaccggccccggctccaccgaggcccgggtcccccagcccgtctcgccgccgcccgactcggaccgatg

SEQ ID NO: 1528 - DNA, 203 bp, Homo sapiens
ggcgcgccagtcctcgaacgcagcttccccaaggtgcaggcgcggtgaaaccatcgagacggagggccagagagtcacggcggtgagagggctgagtgacgggttaccccaaaccatgtggctggaggcgcgagctggggttttcgtaacaccccagggcctgtaaggtttggtgtttccctttcaagcgactcggaccgatg

SEQ ID NO: 1529 - DNA, 203 bp, Homo sapiens
ggcgcgccagtcctagttctcaggctcacattcccaccacccacctctgagcccagccctccctagcatcaccacttccatcccattcctcagccaagagccaggaatcctgattccagatcccacgcttccctgcctccctcaggtcccagctcttgctcctgcctgtttgcctggaaatggccacgcgactcggaccgatg

SEQ ID NO: 1530 - DNA, 203 bp, Homo sapiens
ggcgcgccagtcctcctttccccttggggccctgtccttcccagtcttgccccagcctcgggaggtggtggagtgacctggccccagtgctgcgtccttatcagccgagccggtcccagctcttgctcctgcctgtttgcctggaaatggccacgcttctccttctccttggggtgctggtggtaagccgactcggaccgatg

SEQ ID NO: 1531 - DNA, 203 bp, Homo sapiens
ggcgcgccagtcctacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtgcatatcttttaccatatttaatactacttcgactcggaccgatg

SEQ ID NO: 1532 - DNA, 203 bp, Homo sapiens
ggcgcgccagtcctattttttgataattggcctcgaccctcctcacctactccttccttagccaaatctactgagaaaagacttggagggggactctccctccacccctccgtgggcaaactcctgacggactgtaagaccttggccgccctctcgcctggcctgggtccctcgaatgaatgtacatccgactcggaccgatg

SEQ ID NO: 1533 - DNA, 203 bp, Homo sapiens
ggcgcgccagtcctccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtccgactcggaccgatg

SEQ ID NO: 1534 - DNA, 203 bp, Homo sapiens
ggcgcgccagtcctgcggggccggcagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctcgactcggaccgatg

SEQ ID NO: 1535 - DNA, 203 bp, Homo sapiens
ggcgcgccagtcctgctccacctcgtccgtggccctgcccacccaggccgcaagagctgccgggacggtccccatcttcttggagcgctttaggctggccggcggcgctgggaggtggagtcgttgctgttgctgtttgtgagcctgtggcgcggcttctgtgggccggaaccttaaagatagccgcacgactcggaccgatg

SEQ ID NO: 1536 - DNA, 203 bp, Homo sapiens
ggcgcgccagtcctaggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcagccatggccaaggacatcctgggtgcgactcggaccgatg

SEQ ID NO: 1537 - DNA, 203 bp, Homo sapiens
ggcgcgccagtccttaatatggaggagcttccggcagcccccggcggctgaaagccggggcagaagtgctggtctcggtcgggattccgggcttggtcccaccgaggcggcgactgcggtaggagggaagaggttttggacgcgctggcctcccgccgctgtgcattgcagcattatttcagttcaaacgactcggaccgatg

SEQ ID NO: 1538 - DNA, 203 bp, Homo sapiens
ggcgcgccagtcctggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagccgagccacatcgctcagacacccgactcggaccgatg

SEQ ID NO: 1539 - DNA, 203 bp, Homo sapiens
ggcgcgccagtcctagcctcgccccgttcgcctcagctacaacaaatcatcgtcaacctgttccaccttctccagtctggtagcaaaaaggggtgtctcagaatctccggcctgtgaaactgtgaggggattcggccaagacgtcctcttccctctgcctcccacccaggccactcttcacctccacccgactcggaccgatg

SEQ ID NO: 1540 - DNA, 203 bp, Homo sapiens
ggcgcgccagtccttgacagaaacggagggtgtgtccaaagttttgaggacggccgagcggcgctccaaaacccgtcctcacagcctcgccccgttcgcctcagctacaacaaatcatcgtcaacctgttccaccttctccagtctggtagcaaaaaggggtgtctcaggccactcttcacctccacccgactcggaccgatg

SEQ ID NO: 1541 - DNA, 203 bp, Homo sapiens
ggcgcgccagtcctccagcgagctacgcaagcaatcctggcccagccgagcttgcttccccaaatcccgtaatccttgaccttattcccccaaagaagcggcctcccgggaaggagcgccctggcggagaagactcgaacggctcccacagccgggcgttgggggaaaggccactcttcacctccacccgactcggaccgatg

SEQ ID NO: 1542 - DNA, 203 bp, Homo sapiens
ggcgcgccagtcctgagttgcggcgatgggcggggcaggcgcgcggggattggcgggatgccgcgcgccgcgcgtgaacctccttggcctgggcgaagctgtgtggaccaagcaagtcaggagtgtggccatgttttctgagcaggctgcccagagggcccacactctactgtccccaccatcagccacgactcggaccgatg

SEQ ID NO: 1543 - DNA, 203 bp, Homo sapiens
ggcgcgccagtcctttccttttctctttttggatgaccgctacaggtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggcccgactcggaccgatg

SEQ ID NO: 1544 - DNA, 203 bp, Homo sapiens
ggcgcgccagtccttattcccccaaagaagcggcctcccgggaaggagcgccctggcggagaagactcgaacggctcccacagccgggcgttgggggaaagaatctccggcctgtgaaactgtgaggggattcggccaagacgtcctcttccctctgcctcccacccaggccactcttcacctccacccgactcggaccgatg

SEQ ID NO: 1545 - DNA, 203 bp, Homo sapiens
ggcgcgccagtcctcaggacccgggctttctgctgtacagacttctcgtgggcagcctcccctcggaactcgggcatcatggcctcaggcccagccaccatcagtcacgtcactcctgggactgaggaggcaggggagggataaggggcagagatggaggccccactccccgaggttgcctagacaaccgactcggaccgatg

SEQ ID NO: 1546 - DNA, 203 bp, Homo sapiens
ggcgcgccagtcctcctgaccacgcccacgagccggctcgaacacgcccgcgccgctgactggcgggtggggttgtcgacacgttcaacccgttctgctggctcgagaacgaagtaggccgtctcgctctgggtctccaggcccgcgaccgtccgccagtcgtcccgaggccactcttcacctccacccgactcggaccgatg

SEQ ID NO: 1547 - DNA, 203 bp, Homo sapiens
ggcgcgccagtcctccaccccgaccccagtagcgctgggcctaggagcactcgggagttgctcagtggctctgcaccgctggcgcgggaaggggagaaaggggctgccagaggcgggaatttggtccccacgcgctgctccagggacgagaagccagggaccggcggttctgggagcagctgtgctggcgactcggaccgatg

SEQ ID NO: 1548 - DNA, 203 bp, Homo sapiens
ggcgcgccagtcctccgtcctcttccgcttggccccagaaagtttcggttctgcccggcggtggacccacgagcgcgtgccaccatggagtctgaccactgctgagcagacagccaccgagggccgaaattctgagccttcctctggacccaggcaggagacatacagacaagaaaggcaaactcacccgactcggaccgatg

SEQ ID NO: 1549 - DNA, 203 bp, Homo sapiens
ggcgcgccagtcctgattccgtagagacactcctccgctgcctgagtcctcggcgaacatggcggcccccgagtcagggccggctttgagtccaggcactgcagagggtgaggaggagacgattctctatgacttgttggtcaacaccgagtggccaccggagactgaagtacagcctagaggcaacccgactcggaccgatg

SEQ ID NO: 1550 - DNA, 203 bp, Homo sapiens
ggcgcgccagtcctgaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgcccgactcggaccgatg

SEQ ID NO: 1551 - DNA, 203 bp, Homo sapiens
ggcgcgccagtcctagtatgcaggtcgctgcagggacccgaggcgacacgcgcctgcaggaggtggcactcctgccgcagctcttcgatctgcttgtccttggccagcggcgcgctcgcctgctccgacaggtcccgagcgcgctggcgggcaaagacttggcacagctccaggccggcgcaactctccgactcggaccgatg

SEQ ID NO: 1552 - DNA, 203 bp, Homo sapiens
ggcgcgccagtcctcggtgatcaggttcccctctgctgattctgggccccgaaccccggtaaaggcctccgtgttccgtttcctgccgccctcctccgtagccttgcctagtgtaggagccccgaggcctccgtcctcttcccagaggtgtcggggcttggccccagcctccatcttcgtctctcaggcgactcggaccgatg

SEQ ID NO: 1553 - DNA, 203 bp, Homo sapiens
ggcgcgccagtccttttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcacgactcggaccgatg

SEQ ID NO: 1554 - DNA, 203 bp, Homo sapiens
ggcgcgccagtcctctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagcgactcggaccgatg

SEQ ID NO: 1555 - DNA, 203 bp, Homo sapiens
ggcgcgccagtcctcatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggacccgactcggaccgatg

SEQ ID NO: 1556 - DNA, 203 bp, Homo sapiens
ggcgcgccagtccttgatgccatcatcccctctttcccctgcaggaagtggcagtgaagctagaatctcagaaggccaggcatccccagttgctgtacgagagcaagctctataagattcttcaaggtggggttggcatcccccacatacggtggtatggtcaggaaaaagactacaatgtactagtccgactcggaccgatg

SEQ ID NO: 1557 - DNA, 203 bp, Homo sapiens
ggcgcgccagtcctggtgacagtggggtccaggagagtctcaaaatcctaagctttcagtatttgttattgtgaaagaagttaattcacctgaaacagaggaggggcaacctgagttatcagaaagtgacttcctggccttcccttctttactgatcagaggcacacaaagcgtagtttctaagctgacgactcggaccgatg

SEQ ID NO: 1558 - DNA, 203 bp, Homo sapiens
ggcgcgccagtcctacacccagtgcgcatgcgcagcaccccggcccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctcgactcggaccgatg

SEQ ID NO: 1559 - DNA, 203 bp, Homo sapiens
ggcgcgccagtccttttcacgacaacttccggaagaggtcgccatggcttcccgggaggaggtactcgccttacaagctgaagttgcccaacgtgaggaggaattgaattcgctgaagcagaagctggcgtcggctcttttggctgagcaggaaccgcagccagaacggctggttccggtgtcgccgccgactcggaccgatg

SEQ ID NO: 1560 - DNA, 203 bp, Homo sapiens
ggcgcgccagtcctctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcacgactcggaccgatg

SEQ ID NO: 1561 - DNA, 203 bp, Homo sapiens
ggcgcgccagtcctgcggagtgagtgaccaggaatgtgggggaaatttatgtcagtcatcaggcaggtactagaagatgctaggggcctcacagacagcttgttcccggctgttaacatggagcagagcgttccctggggctgagcatgggagcccagcacttcttatagtgtttccagagcctggcacgactcggaccgatg

SEQ ID NO: 1562 - DNA, 203 bp, Homo sapiens
ggcgcgccagtcctagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggcccgactcggaccgatg

SEQ ID NO: 1563 - DNA, 203 bp, Homo sapiens
ggcgcgccagtcctttttggctgttctgaagagtgttactgtgaacattcatgcacaaatttttatgtggaggcagtagcagaatcccatggtagccaggtgggtgaaggggagcgaggacgttctacctgccttgaagaagacacctgacctgcggagtgagtgaccagtgtttccagagcctggcacgactcggaccgatg

SEQ ID NO: 1564 - DNA, 203 bp, Homo sapiens
ggcgcgccagtcctgaggccgtcccgtgatgccccgcgccccggccgctctggcctgcaacgtgtctctggggcggaggcagcggcagtggagttcgctgcgcgctgttgggggccacctgtcttttcgcttgtgtccctctttctagtgtcgcgctcgagtcccgacgggccgctccaagcctcgaccgactcggaccgatg

SEQ ID NO: 1565 - DNA, 203 bp, Homo sapiens
ggcgcgccagtccttcggggccgcagagggggcggggcgggacgtccggggagtgcgcacgcatcctgcccgcggcgcgcgcgcaggtcggtgcgtctgtcgggggcgcgctcgggtacctgtaccccacgtagtcgccggttaccgatcggactaagttccagtggtgatttacaagtcaagttaaacgactcggaccgatg

SEQ ID NO: 1566 - DNA, 203 bp, Homo sapiens
ggcgcgccagtccttctaggagacaggggccacggggagagcacagccacccggcgcgaagagccctctgtaccccgcttcctcttgaggccctgggaccgtccaggaaatgtctgggagcccgcctgcggagggcatagcgccgaccctcgctccccgcccaggacccgaatgaacctggagagcggcgactcggaccgatg

SEQ ID NO: 1567 - DNA, 203 bp, Homo sapiens
ggcgcgccagtcctatcttccgtcccaactgctagtggctgagtccctggcggggcgcggcggtggaaggtgtcgcgtacgggcttcccgagctgacgtggcttgaattgggaggggggcagctggagcctcaggcggcagcgcttctagaaatgctgagccgattatcaggattagcaaatgttgttcgactcggaccgatg

SEQ ID NO: 1568 - DNA, 203 bp, Homo sapiens
ggcgcgccagtccttacgagttggcccggagcaaggcggcccaggacaggcaggggctgcacgcggtgaagaaaccaagacgcagagaggccaagccccttgccttgggtcacacagccaaaggaggcagagccagaactcacaaccaggcagtcacccgcagggccaaggtggctcccgctgagaggcgactcggaccgatg

SEQ ID NO: 1569 - DNA, 203 bp, Homo sapiens
ggcgcgccagtcctgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacacccgactcggaccgatg

SEQ ID NO: 1570 - DNA, 203 bp, Homo sapiens
ggcgcgccagtcctgtcattcacccgcgccacccggaagccgcggttcctaccaaccgttcttattgctggcggcctgaggagcccatcatggcgacgccccctaagcggcgggcggtggaggccacgggggagaaagtgctgcgctacgagaccttcatcagtgacgtgctgcagcgggacttgcgacgactcggaccgatg

SEQ ID NO: 1571 - DNA, 203 bp, Homo sapiens
ggcgcgccagtcctcgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccgactcggaccgatg

SEQ ID NO: 1572 - DNA, 203 bp, Homo sapiens
ggcgcgccagtcctggaggcgtcggggctgcgccgtacaacttccggctgtaaagatggcggcttcctagtgagtcggcggctgatttagaaggaggttcaggctacggtgagccgaagccacacaggagccatggaagtggcagagcccagcagccccactgaagaggaggaggaggaagaggagcacgactcggaccgatg

SEQ ID NO: 1573 - DNA, 203 bp, Homo sapiens
ggcgcgccagtccttcccgcagcttccctagattaggcttgggaggcaagaggaggcctcctgacctttcacactgcctttttaatattaagatgaagtcacactccacaactttcttccagccaggcccagacatgtccgtccttgtaagttaaaagcttccatgggagccttccttcctaatcaagcgactcggaccgatg

SEQ ID NO: 1574 - DNA, 203 bp, Homo sapiens
ggcgcgccagtcctaacgcagctgagattactcccagccactaaggacgaagaggtggggcggtggcgtcccacgcctcgtgcgacagtgggcggggctttgttgcctgagtaaccgtatgatggtggtggtggtggtgtcttcctgtctcaacgatacctattttctagtgctgagatcctgagacacgactcggaccgatg

SEQ ID NO: 1575 - DNA, 203 bp, Homo sapiens
ggcgcgccagtcctgagccaaccgagggcgttcctgtcggggctgcagcggcgggagggagcccagtggaggcgccctcccgaagcgccactgcccatgctgaccacccagccctccggctgctgatgtcatgagtaacaccactgtgcccaatgccccccaggccaacagcgactccatggtaatgtcgactcggaccgatg

SEQ ID NO: 1576 - DNA, 203 bp, Homo sapiens
ggcgcgccagtcctgtgaccccaggccctggtcactccatgctttggagggtgcttttgtcaaagaggcctcctttccctcacccagagctggatttccaagaggctcccatacctagctgccctggcagactcccagggaggaaaaacagcgtggccttggcagctgccccgaggaaggagcccacacgactcggaccgatg

SEQ ID NO: 1577 - DNA, 203 bp, Homo sapiens
ggcgcgccagtcctcctctcggcgccgccgcagtgcgcagaacagctctggtcctcacagccagtgcaccggaggggcgcgctcccgagctggcgcagtttcccagcgcggtgcccgcccctcatcctcctccagtctccctcccctcgccgactgccgccccaggctccgccatggggaatgtgccacgactcggaccgatg

SEQ ID NO: 1578 - DNA, 203 bp, Homo sapiens
ggcgcgccagtcctcggctagcggccccacagcccctgctgactcaaaacaactgagttgtaagacgttcatcgccgtgttatccttgagtaaagaatgaactctggaagcccagccagggacaatgcaccttcacagagattctgcactaatctgagtgaaggtctaaggtttggaatctccccctccgactcggaccgatg

SEQ ID NO: 1579 - DNA, 203 bp, Homo sapiens
ggcgcgccagtcctagtgtgctctacgtggggcggggctcaggtgcggacgccgccggttgtcctcttcgctgctccgtagtgacggggattgttgtgttgcagaaatccggcaatcgacctgaggacttgcgagccgctcagctcccgggacgtttggagctgctgctaaataatttctgctcagcccgactcggaccgatg

SEQ ID NO: 1580 - DNA, 203 bp, Homo sapiens
ggcgcgccagtcctcccgggacgtttggtgcgtcttctaagggcgtgggcgagtttacgcgggccagttgttgctggtcgcatgggagctgctgctaaataatttctgctcagccatgtcgccggctccagatgcagccccggctcctgcgtcgatctccctgtttgacctcagcgcggatgctccggcgactcggaccgatg

SEQ ID NO: 1581 - DNA, 203 bp, Homo sapiens
ggcgcgccagtcctagttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacgactcggaccgatg

SEQ ID NO: 1582 - DNA, 203 bp, Homo sapiens
ggcgcgccagtcctccctcccctcccgctctgtgccccgccgggcggggaccgtgggagccgcggacaagcccaaggccggagcggttccaggaggaccctggtctgcacctgtggttgccaggtaggtggatgtgagagaccctacccttctggttctctagaagccatcccatcgccgctagcatccgactcggaccgatg

SEQ ID NO: 1583 - DNA, 203 bp, Homo sapiens
ggcgcgccagtcctcgagtgccggggagttcctggggagccgggcttctcttttggcccccagcgtgttgaccgagcccgcttcgcacagcccttcctagggtgtggagagcgggccccgccctgaaggggcaccgtgggctggggggcctgttttggagcaggcaccggtggccgagctccgtgacccgactcggaccgatg

SEQ ID NO: 1584 - DNA, 203 bp, Homo sapiens
ggcgcgccagtcctcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaaccgactcggaccgatg

SEQ ID NO: 1585 - DNA, 203 bp, Homo sapiens
ggcgcgccagtcctggggcgtgctcgcggctataaggggcggaggctgggcggcgttgctctgcgctctgcggctgacggcgcttttgtctccgggtccagaggcctttcagaaggagaaggcagctctgtttctctgcagaggagtagggtcctttcagccatgaagcatgtgttgaacctctacctcgactcggaccgatg

SEQ ID NO: 1586 - DNA, 203 bp, Homo sapiens
ggcgcgccagtcctcagatttgactgagagccgtaaagcgcggctggctctcgttttccggataacgactacagctccgactgtcagtgccggccttcctcgtgtgaggggatctgccggacccctgcaaattcaatttctttcccattccgggcccttccctatcgtcgcccccttcaccttggatccgactcggaccgatg

SEQ ID NO: 1587 - DNA, 203 bp, Homo sapiens
ggcgcgccagtcctcgttgggaacggttgtaggacgtggctctttattcgtgagttttccatttacctccgctgaacctagagcttcagacgccctatggcgtccgcctcgacccaaccggcggccttgagcgctgagcaagcaaaggtggtcctcgcggaggtgatccaggcgttctccgccccggacgactcggaccgatg

SEQ ID NO: 1588 - DNA, 203 bp, Homo sapiens
ggcgcgccagtcctctcacaatggcttgggtccagactgcgccacagcctctcgggagacgtgggccctcggaacctttttagtgccggactccgggccgcaggcagtcccgcggcagcaggatcacaggtggcagggactcagctcggaattctgtatagaaaaagcacctggatcccagtctttcacgactcggaccgatg

SEQ ID NO: 1589 - DNA, 203 bp, Homo sapiens
ggcgcgccagtcctctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggacagcgtctggctccttccctcggctccgactcggaccgatg

SEQ ID NO: 1590 - DNA, 203 bp, Homo sapiens
ggcgcgccagtcctatggagaacgttgataattctctggatggcagtgatgtgtcagaaccagcaaaaccagaagccggacttgaagtggctcagtcgatcctgagtaagttctctatgaaatccctatttgggtttacgagtaaattagaatctgtgaatccagaagaggaagatgctgtgctgaaacgactcggaccgatg

SEQ ID NO: 1591 - DNA, 203 bp, Homo sapiens
ggcgcgccagtcctcgctggcggtggcgcggtttgtgtgggcttggtgagggcggggaggcctggctgtgtggatgtctgacaggtgaggcgggggacgcagaagtgcagccgccctctcccacagcggagtccaaaacaggcctaccagtcagttcttatttctattgggtgtttccatgctccacccgactcggaccgatg

SEQ ID NO: 1592 - DNA, 203 bp, Homo sapiens
ggcgcgccagtcctcccagactccagccctggaccgcgcatcccgagcccagcgcccagacagagtgtccccacaccctcctctgagacgccatgttcaactcgatgaccccaccaccaatcagtagctatggcgagccctgctgtctccggcccctccccagtcagggggcccccagtgtggggacacgactcggaccgatg

SEQ ID NO: 1593 - DNA, 203 bp, Homo sapiens
ggcgcgccagtcctcccacttcccccggctccagccggcgcaggcagcggcggcagcagcaggcgagcctcggccccgcaaggccatgaaggtgaagaagggcggcggtggggccgggacggcgacggagtccgctccggggccctcgggccagagcgtggcccccataccacagccgcctgcggaatcgactcggaccgatg

SEQ ID NO: 1594 - DNA, 203 bp, Homo sapiens
ggcgcgccagtcctccacaactggagcagccgggaacagctctgaccacagtggttccggggagaagcctttccaggacccatgtgtaggcacaactgttttccctgatcaggatacttgcggcactcaacagaggaaagaaattcctaagggaacactgctcagaaagtactgcagcatgtcttcaacgactcggaccgatg

SEQ ID NO: 1595 - DNA, 203 bp, Homo sapiens
ggcgcgccagtcctgggtacaaatgtattttggatcaaagaaactccagtattcaaagataggaactgacaggattttaggtcactttgtaggtcaccacctagaggggaggaagacctcgctttggagagtgggaataaaacgctcgtggaaaagggtacacgcttttctgggaaagtgaggccacccgactcggaccgatg

SEQ ID NO: 1596 - DNA, 203 bp, Homo sapiens
ggcgcgccagtcctccccgcgctgcgtgcccacgttgcgccggcctcgcgccagtccgctgggctgcagggactgcggcgcctgagggagtcgctgacgggcacgctgactggaggctggcggacaggcgacagcgacctgcggcaggaccagaggagcgagagcagcaagaaccacacccagcagcacgactcggaccgatg

SEQ ID NO: 1597 - DNA, 203 bp, Homo sapiens
ggcgcgccagtcctagcgacctgcggcagagtcttgctgcgacacccaggctggagtgcaatggcgctatctcggctcactgcaacctccgcttcccggattcaagcgattctcctgcctcagcctcccgagtaggtgggactacaggaccagaggagcgagagcagcaagaaccacacccagcagcacgactcggaccgatg

SEQ ID NO: 1598 - DNA, 203 bp, Homo sapiens
ggcgcgccagtcctaggcgcgggcggagggcgggctgaagcagctgaagcggcggtagcggcggcggctcgggcagaggggcgggagctgaggcgggagcggacaggctggtgggcgagcgagaggcggcggaatggtggactaccacgcggcgaaccagtcgtaccagtacggccccagcagcgcggcgactcggaccgatg

SEQ ID NO: 1599 - DNA, 203 bp, Homo sapiens
ggcgcgccagtcctcttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccgactcggaccgatg

SEQ ID NO: 1600 - DNA, 203 bp, Homo sapiens
ggcgcgccagtcctacaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccgactcggaccgatg

SEQ ID NO: 1601 - DNA, 203 bp, Homo sapiens
ggcgcgccagtccttaagagccgcggagtcggggacggtagaaggggccgcgcgtgcgcagtggcgtccgctgtgcttccggtgcgccgggcgcggacgcgggcacgcacacacgcaagcacgcctccacttaactcgcgccgccgcggcagctcgagtccaccagcagcgccgtccgcttgaccgagcgactcggaccgatg

SEQ ID NO: 1602 - DNA, 203 bp, Homo sapiens
ggcgcgccagtcctggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtcgactcggaccgatg

SEQ ID NO: 1603 - DNA, 203 bp, Homo sapiens
ggcgcgccagtcctaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgcccgactcggaccgatg

SEQ ID NO: 1604 - DNA, 203 bp, Homo sapiens
ggcgcgccagtccttagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggccgactcggaccgatg

SEQ ID NO: 1605 - DNA, 203 bp, Homo sapiens
ggcgcgccagtcctgggccactgctctccaggaagataaggcttttaaagcagcctagcactagaaggtgaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 1606 - DNA, 203 bp, Homo sapiens
ggcgcgccagtcctcctgctgctgctcgctgttcggcccggggcggggacacggccgcggacgtccttgtgggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 1607 - DNA, 203 bp, Homo sapiens
ggcgcgccagtcctgcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 1608 - DNA, 203 bp, Homo sapiens
ggcgcgccagtcctataggccccgcccctgtatcccaagaccctgcctcctcttgcggtggggggaaagcggcctcttactctaggcctttcggtttgcgcgagcgggcaggaaagcgtgcgtgcggctaagagagtgggcgctctcgcggccgctgacgatggaagaactggagcaaggcctgttgacgactcggaccgatg

SEQ ID NO: 1609 - DNA, 203 bp, Homo sapiens
ggcgcgccagtcctaaaggaagaccaggttcctgaaagggttattctgacttaatctggctataaaaatgctattggctgttatttggcatggccaaagtgcacccagaatgtcttctctctccattcagtgcacgcgttactttggctaaaaggaggtgagcggcactctgcccttccagagcaagccgactcggaccgatg

SEQ ID NO: 1610 - DNA, 203 bp, Homo sapiens
ggcgcgccagtccttcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggttttcacccgactcggaccgatg

SEQ ID NO: 1611 - DNA, 203 bp, Homo sapiens
ggcgcgccagtcctgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggcccgactcggaccgatg

SEQ ID NO: 1612 - DNA, 203 bp, Homo sapiens
ggcgcgccagtcctttcccccgccgccaggctgacttctcatcgcttgtttttctttttgcatttttcctcccaccgccgttgccgccctccccgtcctggccgtccgccctccgccctctgcagggacatctctacaccgttcccatccgggaacagggcaacatctacaagcccaacaacaaggcccgactcggaccgatg

SEQ ID NO: 1613 - DNA, 203 bp, Homo sapiens
ggcgcgccagtcctttagcctcccgcccgccgcctctgtctccctctctccacaaactgcccaggagtgagtagctgctttgggtccgccggacacaccggacagatagacgtgcggacggcccaccaccccagcccgccaactagtcagcctgcgcctggcgcctcccctctccaggtccatccgcccgactcggaccgatg

SEQ ID NO: 1614 - DNA, 203 bp, Homo sapiens
ggcgcgccagtcctactttactgcaagccttagtcagagtacaaagggttcctgcttggtggttttgctgcagcttcagagtttagcctgaactgtggcaggattttgtaacttgcacattttttgagaagtctgatggaggtataatgtccacggtcgattatttgaacagtgtttctggagatcatcgactcggaccgatg

SEQ ID NO: 1615 - DNA, 203 bp, Homo sapiens
ggcgcgccagtcctgtataaggtccacaccccgggagctgagtgattgcagaaactggccttccatctctctcagacaccaagctgcagatccaggcttttctgggaaagtgaggccaccatggctctggagaagtctcttgtccggctccttctgcttgtcctgatactgctggtgctgggctgggtcgactcggaccgatg

SEQ ID NO: 1616 - DNA, 203 bp, Homo sapiens
ggcgcgccagtcctaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatcgactcggaccgatg

SEQ ID NO: 1617 - DNA, 203 bp, Homo sapiens
ggcgcgccagtccttaaggtccacaccccgggagctgagtgattgcagaaactggccttccatctctctcagacaccaagctgcagatccaggtcaccacctagaggggaggaagacctcgctttggagagtgggaataaaacgctcgtggaaaagggtacacgcttttctgggaaagtgaggccacccgactcggaccgatg

SEQ ID NO: 1618 - DNA, 203 bp, Homo sapiens
ggcgcgccagtcctaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgcgactcggaccgatg

SEQ ID NO: 1619 - DNA, 203 bp, Homo sapiens
ggcgcgccagtcctcccgggagctgagtgattgcagaaactggccttccatctctctcagacaccaagctgcagatccaggtcactttgtaggtcaccacctagaggggaggaagacctcgctttggagagtgggaataaaacgctcgtggaaaagggtacacgcttttctgggaaagtgaggccacccgactcggaccgatg

SEQ ID NO: 1620 - DNA, 203 bp, Homo sapiens
ggcgcgccagtcctaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaacgactcggaccgatg

SEQ ID NO: 1621 - DNA, 203 bp, Homo sapiens
ggcgcgccagtcctacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgaccgactcggaccgatg

SEQ ID NO: 1622 - DNA, 203 bp, Homo sapiens
ggcgcgccagtcctttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagacgactcggaccgatg

SEQ ID NO: 1623 - DNA, 203 bp, Homo sapiens
ggcgcgccagtcctatatatttcgagactaaagaacccaggaacccaagaagactccttgaccacaacaaagatggcgaaatctgcctgttgctcgtgctagattgaggttacgtagattggcgtgctgcaaaccagctctaggcggctctggccccaaaaggagcataaaccagggactttgatatccgactcggaccgatg

SEQ ID NO: 1624 - DNA, 203 bp, Homo sapiens
ggcgcgccagtcctgatctcagctcactgcagcctccgcctcccgggttcaagcgattcttctgcctcagcctcccgagtagcagattatgagcttacagaaagcctggcctacattttactctttttggatttcttcctcatcaagagactgctgcagtgcctgtcatgtgacagcggcatggacatcgactcggaccgatg

SEQ ID NO: 1625 - DNA, 203 bp, Homo sapiens
ggcgcgccagtcctgattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccacgactcggaccgatg

SEQ ID NO: 1626 - DNA, 203 bp, Homo sapiens
ggcgcgccagtcctgaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaacgactcggaccgatg

SEQ ID NO: 1627 - DNA, 203 bp, Homo sapiens
ggcgcgccagtccttaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgcgactcggaccgatg

SEQ ID NO: 1628 - DNA, 203 bp, Homo sapiens
ggcgcgccagtcctcaccgcaggctcctgtgccttgggcttgagctttgtggcagttaatggcttttctgcacgtatctctggtgtttacttgagaagcctggctgtgtccttgctgtaggagccggagtagctcagagtgatcttgtctgaggaaaggccagccccacttggggttaataaaccgcgcgactcggaccgatg

SEQ ID NO: 1629 - DNA, 203 bp, Homo sapiens
ggcgcgccagtccttttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagaggttgatattcactgcgactcggaccgatg

SEQ ID NO: 1630 - DNA, 203 bp, Homo sapiens
ggcgcgccagtcctgtctcccgcggcccagcgctcgcaccaccgcttctccctccctgtcgcagccgcgccgccgcgcagcgccccagccacacgccggcgggcagaagccgcccgctctccggaaagtgataacagaattcattgaagtggagaatttttaaagaaggtaacaaaaagagaaagaaacgactcggaccgatg

SEQ ID NO: 1631 - DNA, 203 bp, Homo sapiens
ggcgcgccagtcctcaggacgcacgtttcaagctcatcagtaaaggttccttaaattcccgaagggcaagaagttaaccaagtaaaacagcatcggaacaccaggatcccatgacagattctgttgtcacgtctccttacagagtttgagcggtgctgaactgtcagcaccatctgtccggtcccagccgactcggaccgatg

SEQ ID NO: 1632 - DNA, 203 bp, Homo sapiens
ggcgcgccagtcctattcagcaaatgtttgcggaatgaatggggtgagctggagccaggacctgcaggaagggatctccgcctggttcggcccgcctgcctccactcctgcctctaccatgtccatcagggtgacccagaagtcctacaaggtgtccacctctggcccccgggccttcagcagccgctcgactcggaccgatg

SEQ ID NO: 1633 - DNA, 203 bp, Homo sapiens
ggcgcgccagtcctggtggcagcggcaggagagtccggccgcgacaggacgaactcccccactggaaaggattctgaaagaaatgaagtcagccctcagaaatgaagttgactgcctgctggctttctgttgactggcccggagctgtactgcaagacccttgtgagcttccctagtctaagagtaggcgactcggaccgatg

SEQ ID NO: 1634 - DNA, 203 bp, Homo sapiens
ggcgcgccagtcctttctccagaacaagcctcctggtctttctgggagagctctggcagcatcactgtgcctgtgcagggagagcgggaacccacttcctgcaccggctttctctgagttcttcaggatgaattcgctctggtctagcggagctggagtttgttcagatcatcatcatcgtggtggtgcgactcggaccgatg

SEQ ID NO: 1635 - DNA, 203 bp, Homo sapiens
ggcgcgccagtcctaaatgatcaagtgttgggtataagccaaggagctgagagagggggagaccagcgcaggtctgaggagctgagaagggaggcttacgtgaagggaatttagataatgggctgtgtgcaatgtaaggataaagaagcaacaaaactgacggaggagagggacggcagcctgaaccacgactcggaccgatg

SEQ ID NO: 1636 - DNA, 203 bp, Homo sapiens
ggcgcgccagtcctgggcgtgtctacgcgagttcccgtctttcctggtcgtcctccttgggttcgggtgaaagcgcttgggggttcagtgggccatgatccccgagctgctggagaactgaaggcggacagtctcctgcgaaaccagcggagctggagtttgttcagatcatcatcatcgtggtggtgcgactcggaccgatg

SEQ ID NO: 1637 - DNA, 203 bp, Homo sapiens
ggcgcgccagtcctgcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagcgactcggaccgatg

SEQ ID NO: 1638 - DNA, 203 bp, Homo sapiens
ggcgcgccagtcctgaatttagataatgggctgtgtgcaatgtaaggataaagaagcaacaaaactgacggaggagagggacggcagcctgaaccagagctctgggtaccgctatggcacagaccccacccctcagcactaccccagcttcggtgtgacctccatccccaactacaacaacttccacgcgactcggaccgatg

SEQ ID NO: 1639 - DNA, 203 bp, Homo sapiens
ggcgcgccagtcctaccctctacacccgccatagcaatggagaccccgcctcctgctacagttaattaatccttcttttttgcttcacaataaaaatagcatggctcttctgattgtaaaaagtgatatacactccttatttaacgaaaaattcaaagaatttgataaatgacaggcgaaaagtcaaacgactcggaccgatg

SEQ ID NO: 1640 - DNA, 203 bp, Homo sapiens
ggcgcgccagtcctccccggagtgcagtcaagttgaccaagaagcgggcactgtccatctcacctctgtcggatgccagcctggacctgcagacggttatccgcacctcacccagctccctcgtagctttcatcaactcgcgatgcacatctccaggaggctcctacggtcatctctccattggcacccgactcggaccgatg

SEQ ID NO: 1641 - DNA, 203 bp, Homo sapiens
ggcgcgccagtcctaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagccccgactcggaccgatg

SEQ ID NO: 1642 - DNA, 203 bp, Homo sapiens
ggcgcgccagtccttccggggcgggggcggggcctcactctgcgatataactcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccacgactcggaccgatg

SEQ ID NO: 1643 - DNA, 203 bp, Homo sapiens
ggcgcgccagtcctcaatctccgcctctgattggctgagcccccggctccccgctccccctctcctccatccccggtgaaaactgcgggctccgagctgggtgcagcaaccggaggcggcggcgcgtctggaggaggctgcagcagcggaagaccccagtccagatccaggactgagatcccagaacccgactcggaccgatg

SEQ ID NO: 1644 - DNA, 203 bp, Homo sapiens
ggcgcgccagtcctatgctgtccacttcctctgtaaagctctcaaccctgtccccttccccctctctcctgggaaagagccctcccatgcctagctgctgctcttagggaccctgtggctaggtgcgcggatggaaatccaggatctccgcctggttcggcccgcctgcctccactcctgcctctacccgactcggaccgatg

SEQ ID NO: 1645 - DNA, 203 bp, Homo sapiens
ggcgcgccagtcctgcagcctcgagggccaacaacacctgctgtccgtgtccatgcccggttggccaccccgtttctgggggcatgagcttcaccactcgctccaccttctccaccaactaccggtccctgggctctgtccaggcgcccagctacggcgcccggccggtcagcagcgcggccagcgtccgactcggaccgatg

SEQ ID NO: 1646 - DNA, 203 bp, Homo sapiens
ggcgcgccagtcctagtgcttctgcggcaggagcccgtggacaaggcccactgcctgagcctgaactaggagcacctcctagggactgcccaggcttgctctgctctgacccttctgctggccagtctgggcacctggcccctgagggagggagctgtcagccagggaaaaccgagaacaccatcacccgactcggaccgatg

SEQ ID NO: 1647 - DNA, 203 bp, Homo sapiens
ggcgcgccagtcctctggttcctaggcctcctctccctgctggcagatgggaacaggttcttcttgaggaaactgaggcaaagaggagggcaggtctgagggaccccgcttgggctggcctcacccgcacactgggagggcagccaggtggggactctgacctgggggcttctggaggagaggatgagcgactcggaccgatg

SEQ ID NO: 1648 - DNA, 203 bp, Homo sapiens
ggcgcgccagtcctgtggcagtgggcgcagggcggggcgagctcagcggagggcgggtttgaatgtgccccggcgggagagggaagctgcagcgagagcgcgcggatctcagcgcgggagcagtgcttctgcggcaggcccctgagggagggagctgtcagccagggaaaaccgagaacaccatcacccgactcggaccgatg

SEQ ID NO: 1649 - DNA, 203 bp, Homo sapiens
ggcgcgccagtcctcactcctgtgtttgacctgaagtcctctcgagctgcagaagcctgaagaccaaggagtggaaagttctccggcagccctgagatctcaagagtgacatttgtgagaccagctaatttgattaaaattctcttggaatcagctttgctagtatcatacctgtgccagatttcatccgactcggaccgatg

SEQ ID NO: 1650 - DNA, 203 bp, Homo sapiens
ggcgcgccagtcctgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagcgactcggaccgatg

SEQ ID NO: 1651 - DNA, 203 bp, Homo sapiens
ggcgcgccagtcctagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtgacagtgatgtgtgttctgaaattgtgaacccgactcggaccgatg

SEQ ID NO: 1652 - DNA, 203 bp, Homo sapiens
ggcgcgccagtcctcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagcccgactcggaccgatg

SEQ ID NO: 1653 - DNA, 203 bp, Homo sapiens
ggcgcgccagtcctacggggacgagcaggagcgctctcgacttttctagagcctcagcgtcctaggactcacctttccctgatcctgcaccgtccctctcctggccccagactctccctcccactgttcacgaagcccaggtacccactgatggtaatgctggcctgctggctgaaccccagattgcccgactcggaccgatg

SEQ ID NO: 1654 - DNA, 203 bp, Homo sapiens
ggcgcgccagtcctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgcgactcggaccgatg

SEQ ID NO: 1655 - DNA, 203 bp, Homo sapiens
ggcgcgccagtcctgacaactcggtggtggccactgcgcagaccagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaacgactcggaccgatg

SEQ ID NO: 1656 - DNA, 203 bp, Homo sapiens
ggcgcgccagtccttcaccacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgactcggaccgatg

SEQ ID NO: 1657 - DNA, 203 bp, Homo sapiens
ggcgcgccagtcctgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgccgactcggaccgatg

SEQ ID NO: 1658 - DNA, 203 bp, Homo sapiens
ggcgcgccagtccttgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagaccgactcggaccgatg

SEQ ID NO: 1659 - DNA, 203 bp, Homo sapiens
ggcgcgccagtcctcaccctgggaccggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagccgactcggaccgatg

SEQ ID NO: 1660 - DNA, 203 bp, Homo sapiens
ggcgcgccagtcctcatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaacgactcggaccgatg

SEQ ID NO: 1661 - DNA, 203 bp, Homo sapiens
ggcgcgccagtcctcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagccgactcggaccgatg

SEQ ID NO: 1662 - DNA, 203 bp, Homo sapiens
ggcgcgccagtcctgtctgagcagacggggaggcttttccaaacccaggcagcttcgtggcgtgtgcggtttcgacccggtcacacaaagcttcagcatgtcatgtggtaggtgaggccggcgcctgtaggctggcggtttccttcctcttggtctttgtagagacagtttgcagaacagcggagaaacgactcggaccgatg

SEQ ID NO: 1663 - DNA, 203 bp, Homo sapiens
ggcgcgccagtcctgagtatttgaggctcggagccaccgccccgccggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccacgactcggaccgatg

SEQ ID NO: 1664 - DNA, 203 bp, Homo sapiens
ggcgcgccagtcctgactgagagcagggagcagcaggcatggggcatgccgggtgccagttcaaagccctgctgtggaagaattggctctgcagactcaggaacccggtccttttccttgctgaattcttctggccttgtatcctgtttgtaattctgacagttcttcgttttcaagaacctcccagacgactcggaccgatg

SEQ ID NO: 1665 - DNA, 203 bp, Homo sapiens
ggcgcgccagtcctctatttgagtttgtggcgcgcgaggccctgcagtccgggttggcgcttgggtactggctgggtccgatgctgggtacgctgcgcgccatggagggcgaggacgtggaagacgaccagctgctgcagaagctcagggccagtcgccgccgcttccagaggcgcatgcagcggctgcgactcggaccgatg

SEQ ID NO: 1666 - DNA, 203 bp, Homo sapiens
ggcgcgccagtcctggagtctcactgtgttgcccaggctggagtgcagtggcgccatcttggctcactgcagtgcgcctctgccccccgagttcaagcgattctcctgcctcaggctcctgagtagctgggactacaggtcatcatcagatttgaaatatttaaagtggatacaaaactatttcagcacgactcggaccgatg

SEQ ID NO: 1667 - DNA, 203 bp, Homo sapiens
ggcgcgccagtcctgccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgaccgactcggaccgatg

SEQ ID NO: 1668 - DNA, 203 bp, Homo sapiens
ggcgcgccagtcctccgctgagctgctctgttcccggcttagaggaccaggagaagggggagctggaggctggagcctgtaacaccgtggctcgtctcactctggatggtggtggcaacagagatggcagcgcagctggagtgttaggagggcggcctgagcggtaggagtggggctggagcagtaagcgactcggaccgatg

SEQ ID NO: 1669 - DNA, 203 bp, Homo sapiens
ggcgcgccagtcctaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggcgactcggaccgatg

SEQ ID NO: 1670 - DNA, 203 bp, Homo sapiens
ggcgcgccagtcctctcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtcccgactcggaccgatg

SEQ ID NO: 1671 - DNA, 203 bp, Homo sapiens
ggcgcgccagtcctggtgcagtccctggagggttctcacgctttggctgtctggacttttaagtttttccgctttttcaggaaggcgaccggcagcctcgggcaggggagacaggactgtatgtcagagaagagacggcgcttggacgccaggaatcctctgaagcaggagactgccctatccagaagcgactcggaccgatg

SEQ ID NO: 1672 - DNA, 203 bp, Homo sapiens
ggcgcgccagtcctgccaggctccacgtcaaatccagtttgaaacacagaccctaggaccacgcaggaggtggtgggctcgcaggaaggttcctctcccagtggccatgggtagcaacagtgggcaggctggccgccacatctataaatccctagctgatgatggcccctttgactctgtggagccgccgactcggaccgatg

SEQ ID NO: 1673 - DNA, 203 bp, Homo sapiens
ggcgcgccagtcctgcctgcaacgcgccctggcactcaccggtgggcgaaatttccccgcctccacgtgagagccagctccgccgtgacccggaagtccacttcgagtcgccggcccaccctctcgggttccggcttcttccgggtcgcggccttccggcgaacgcggttaccgtggaaaccgcggcccgactcggaccgatg

SEQ ID NO: 1674 - DNA, 203 bp, Homo sapiens
ggcgcgccagtcctgaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgcccgactcggaccgatg

SEQ ID NO: 1675 - DNA, 203 bp, Homo sapiens
ggcgcgccagtcctctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagacgactcggaccgatg

SEQ ID NO: 1676 - DNA, 203 bp, Homo sapiens
ggcgcgccagtcctcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatccgactcggaccgatg

SEQ ID NO: 1677 - DNA, 203 bp, Homo sapiens
ggcgcgccagtccttgcagaggatccagtccagatcccaggagagcccctctgccccttcggacctcgtctcccatctacaaaacgtgaagattggcccagttagcgtgtctctacaaaaaggtgcatataccactgccccgctgcaggctgatctgagaaagcctctggcccagggcagataccgcccgactcggaccgatg

SEQ ID NO: 1678 - DNA, 203 bp, Homo sapiens
ggcgcgccagtcctaagtgctggctacctgctgagcgcccccgtaactctgacacagtagtaatttgagcctctgcaattgccgtctgcttcctgtgaaagtcctttccgtgcccactgacccttgagtgggcctttgagctgctgactttcagctggaacttgaagggaccccaaccctgagacactcgactcggaccgatg

SEQ ID NO: 1679 - DNA, 203 bp, Homo sapiens
ggcgcgccagtcctagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggcgactcggaccgatg

SEQ ID NO: 1680 - DNA, 203 bp, Homo sapiens
ggcgcgccagtcctgcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgacgactcggaccgatg

SEQ ID NO: 1681 - DNA, 203 bp, Homo sapiens
ggcgcgccagtcctcaccaggctgagctaagcagggccgccttgggcaggcctacgtggtggtgcaggcgagacccaggctgggcaaggcgcagtttcagtttccatcttgggtctctgagctgagcagagtggcaccaggctgagttaagtgggactgccctgggcagacctacctactagagcagacgactcggaccgatg

SEQ ID NO: 1682 - DNA, 203 bp, Homo sapiens
ggcgcgccagtcctggagccaaaatgctattgccctgtcttcatcaacatttaatcaagtgttgcggagataggaacatgggagagaaacaatctgggtaacatgaaagtgatgctggttgctaagggaaggcaacttgattctgtgggaagggctgtagctgatccatccgttgtctagatttgagtcgactcggaccgatg

SEQ ID NO: 1683 - DNA, 203 bp, Homo sapiens
ggcgcgccagtcctccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattcgactcggaccgatg

SEQ ID NO: 1684 - DNA, 203 bp, Homo sapiens
ggcgcgccagtcctgctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcgactcggaccgatg

SEQ ID NO: 1685 - DNA, 203 bp, Homo sapiens
ggcgcgccagtcctggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggacgactcggaccgatg

SEQ ID NO: 1686 - DNA, 203 bp, Homo sapiens
ggcgcgccagtcctccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcgtgcccggctcgactcggaccgatg

SEQ ID NO: 1687 - DNA, 203 bp, Homo sapiens
ggcgcgccagtcctgaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaaccgactcggaccgatg

SEQ ID NO: 1688 - DNA, 203 bp, Homo sapiens
ggcgcgccagtcctccagcgaccgcggcaccgcctgtgcccgcccgcccctccgcagccgctacttaagaggctccagcgccggccccgccctagtgcgttacttacctcgactcttagcttgtcggggacggtaaccgggacccggtgtctgctcctgtcgccttcgcctcctaatccctagccactcgactcggaccgatg

SEQ ID NO: 1689 - DNA, 203 bp, Homo sapiens
ggcgcgccagtcctctccgcactgcaccccgacccaccccgcaccctccctttctgcaccctcgcacccacacccctcgcggttccagggggcggcggccccgggcggagcgctttcgcgtgcagccaccactccagaagacttaatgaagtagccagctgcagaagaatctggatcattagataaaacgactcggaccgatg

SEQ ID NO: 1690 - DNA, 203 bp, Homo sapiens
ggcgcgccagtcctccgccgcccgccctcgctctctcgcgctaccctcccgccgcccgcggtcctccgtcggttctctcgttagtccacggtctggtcttcagctacccgccttcgtctccgagtttgcgactcggggaccggcgtccccggcgcgaagaggctggactcggattcgttgcctgagcacgactcggaccgatg

SEQ ID NO: 1691 - DNA, 203 bp, Homo sapiens
ggcgcgccagtcctctccccgcctccttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaacccccgactcggaccgatg

SEQ ID NO: 1692 - DNA, 203 bp, Homo sapiens
ggcgcgccagtcctgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacacgactcggaccgatg

SEQ ID NO: 1693 - DNA, 203 bp, Homo sapiens
ggcgcgccagtcctacgttcctgccgggcaggacaggtgcatagggaactcctcagaggtctgtacctcgagggctcccatggatagccttgacagatcctgccaggactggtgcgacaggaagcaacactggttggagatcggaccaccggacttggtggagcgcaagggctccctgaccctccgctcgactcggaccgatg

SEQ ID NO: 1694 - DNA, 203 bp, Homo sapiens
ggcgcgccagtccttggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccacccgactcggaccgatg

SEQ ID NO: 1695 - DNA, 203 bp, Homo sapiens
ggcgcgccagtcctccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcgactcggaccgatg

SEQ ID NO: 1696 - DNA, 203 bp, Homo sapiens
ggcgcgccagtcctgcgcacgcagggtggggggagggagcgcacgacgtgcgcgcaccctctcccctcgtccaccgctgccgcctccttcttctgccgctcctggtgctgcttgtgtgctcgtttggtgcggacctggtacctcttttgtgaagcggcagctgaggagactccggcgctcgccatggccgactcggaccgatg

SEQ ID NO: 1697 - DNA, 203 bp, Homo sapiens
ggcgcgccagtcctggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaacgactcggaccgatg

SEQ ID NO: 1698 - DNA, 203 bp, Homo sapiens
ggcgcgccagtcctctggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacacgactcggaccgatg

SEQ ID NO: 1699 - DNA, 203 bp, Homo sapiens
ggcgcgccagtcctgcagggcggggcctgagcactaggcggcggcggctggcgtggggctgcttagatgcgccacggtttcggtagcgacggtatctctagccgggcctgagctgtgctagcacctcccccaggagaccgttgcagtcggccagcccccttctccacggccttgcccactaggtaacccgactcggaccgatg

SEQ ID NO: 1700 - DNA, 203 bp, Homo sapiens
ggcgcgccagtcctgagcggtcacgtgtgaggggcggcccgaggtcacgtgacggagcgccggagcggagggagccggggctgggagttctcctgagggaagaggagtggagtaggggggacgcggcggcggcgttgacaatgagttttcttggaggcttttttggtccaatttgtgagatcgatattcgactcggaccgatg

SEQ ID NO: 1701 - DNA, 203 bp, Homo sapiens
ggcgcgccagtcctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctgcgactcggaccgatg

SEQ ID NO: 1702 - DNA, 203 bp, Homo sapiens
ggcgcgccagtcctgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagccgactcggaccgatg

SEQ ID NO: 1703 - DNA, 203 bp, Homo sapiens
ggcgcgccagtcctctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagcgactcggaccgatg

SEQ ID NO: 1704 - DNA, 203 bp, Homo sapiens
ggcgcgccagtcctacggaaacgggcgtgccatttccgcgcacgtctgcagatgcggtagtcgattggtcaagtctcccatggctcctccttcatcaggaggtgggcaaaccgcgccatgatagggtcgggattggctggctctggaggcgcaggtggtccttcttctactgtcacatggtgcgcgctcgactcggaccgatg

SEQ ID NO: 1705 - DNA, 203 bp, Homo sapiens
ggcgcgccagtcctaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgcctctctgctcctgtcttttgtttggcgactcggaccgatg

SEQ ID NO: 1706 - DNA, 203 bp, Homo sapiens
ggcgcgccagtcctgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgccgactcggaccgatg

SEQ ID NO: 1707 - DNA, 203 bp, Homo sapiens
ggcgcgccagtccttgggctcgcgcttccactccgccgcgccttcctcccagtttccgtccgctcgccgcaccggcttcgttcccccaaatctgggaccgtcccttcgcgccccctccccgtccgcccccagtgctgcgttctccccctcttggctctcctgcggctgggggaggggcgggggtcacccgactcggaccgatg

SEQ ID NO: 1708 - DNA, 203 bp, Homo sapiens
ggcgcgccagtcctcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaacgactcggaccgatg

SEQ ID NO: 1709 - DNA, 203 bp, Homo sapiens
ggcgcgccagtcctccgagcgcccgccaggctcctcccgctcccgcgccgcctccctctacccacccgccgcacgtactaaggaaggcgcacagcccgccgcgctcgcctctccgccccgcgtccagctcgcccagctcgcccagcgtccgccgcgcctcggccaaggcttcaacggaccacaccaaacgactcggaccgatg

SEQ ID NO: 1710 - DNA, 203 bp, Homo sapiens
ggcgcgccagtcctgcgcgttgtgcgctgtcccaggttggaaaccagtgccccaggcggcgaggagagcggtgccttgcagggatgctgcgggcgggagcaccaaccggggacttaccccgggcgggagaagtccacaccgggaccaccatcatggcagtggagtttgacgggggcgttgtgatgggtcgactcggaccgatg

SEQ ID NO: 1711 - DNA, 203 bp, Homo sapiens
ggcgcgccagtcctcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgcgggaccgggaggaggggagggggcgcgactcggaccgatg

SEQ ID NO: 1712 - DNA, 203 bp, Homo sapiens
ggcgcgccagtcctgggggtcacgtggtgcagagcacgcagagtccttctgtcggttggtcctggagcggcgcagccggagtggggccgtgaggagaataaaggcagccccgttgatgactgaaaatgacaaagcatccacctaacagacgaggaatcagctttgaagtgggagcccagttggaagcccgactcggaccgatg

SEQ ID NO: 1713 - DNA, 203 bp, Homo sapiens
ggcgcgccagtcctaatggactctagcctcctctgatagcctcatgccaggccccgtgcacattgctttgcttgcctccctcaatcctcatagcttctctttgggaagcctttgggtctgaagtgtctgtgagacctcacagaagagcacccctgggctccacttacctgccccctgctccttcagggcgactcggaccgatg

SEQ ID NO: 1714 - DNA, 203 bp, Homo sapiens
ggcgcgccagtcctgggcttatcccgcctgtcccgccattctcgctagttcgatcggtagcgggagcggagagcggaccccagagagccctgagcagccccaccgccgccgccggcctagttaccatcacaccccgggaggagccgcagctgccgcagccggccccagtcaccatcaccgcaaccatgcgactcggaccgatg

SEQ ID NO: 1715 - DNA, 203 bp, Homo sapiens
ggcgcgccagtcctctcccgggctggcagcagggccccagcggcaccatgtctgccctcggagtcaccgtggccctgctggtgtgggcggccttcctcctgctggtgtccatgtggaggcaggtgcacagcagctggaatctgcccccaggccctttcccgcttcccatcatcgggaacctcttccagcgactcggaccgatg

SEQ ID NO: 1716 - DNA, 203 bp, Homo sapiens
ggcgcgccagtcctattggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacatcgactcggaccgatg

SEQ ID NO: 1717 - DNA, 203 bp, Homo sapiens
ggcgcgccagtcctctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatgcgactcggaccgatg

SEQ ID NO: 1718 - DNA, 203 bp, Homo sapiens
ggcgcgccagtcctgaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgcgactcggaccgatg

SEQ ID NO: 1719 - DNA, 203 bp, Homo sapiens
ggcgcgccagtcctggcaacgccaaccgctccgctgcgcgcaggctgggctgcaggctctcggctgcagcgctgggctggtgtgcagtggtgcgaccacggctcacggcagcctcagccacccagatgtaagcgatctggttcccacctcagcctcccgagtagtggatctaggatccggcttccaaccgactcggaccgatg

SEQ ID NO: 1720 - DNA, 203 bp, Homo sapiens
ggcgcgccagtcctcgatgtcgcaccgcggcgtgcgcggtgtcggcagtagctgcggcgcaggggcggagcgaaggctgcggcggcgtcgggtacgcgcacacgttgcatcttcttcctttcgcggggtcctccgtagttctggcacgagccaggcgtactgacaggtggaccagcggactggtggagcgactcggaccgatg

SEQ ID NO: 1721 - DNA, 203 bp, Homo sapiens
ggcgcgccagtcctcagcaggggggaaaaaagagacaaaaacaaaacaaaaaacaacaaaaagcaacaccccccccttttattttcaaaagtagctagaggaaaaaaaaataaaacaacagccaaccaagtgaatcccaacccaaccccctgaagggctgaaaattctcgccttcttcagagcggggccgactcggaccgatg

SEQ ID NO: 1722 - DNA, 203 bp, Homo sapiens
ggcgcgccagtcctggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttcgactcggaccgatg

SEQ ID NO: 1723 - DNA, 203 bp, Homo sapiens
ggcgcgccagtcctcaccctcaggaccctcaccacccatcagagaagcctgtcattcactgccataaatgtggggagccttgcaagggtgaagtgcttcgggtccagaccaaacatttccacatcaagtgtttcacctgcaaagtgtgtggctgtgacctggcacaagggggcttcttcataaagaaccgactcggaccgatg

SEQ ID NO: 1724 - DNA, 203 bp, Homo sapiens
ggcgcgccagtcctgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttggagagtctccgaggactttgtctcgactcggaccgatg

SEQ ID NO: 1725 - DNA, 203 bp, Homo sapiens
ggcgcgccagtcctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcaatgagccgtccagcggccggaaccgactcggaccgatg

SEQ ID NO: 1726 - DNA, 203 bp, Homo sapiens
ggcgcgccagtccttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgagacgtcggcagcttcaagaagagcgactcggaccgatg

SEQ ID NO: 1727 - DNA, 203 bp, Homo sapiens
ggcgcgccagtcctcaattaatgaagcttaactcaggcctgggacagttgatcttgaaagaagagatggagaaagagagccgggaaaggtcatctctgttagccagtcgctacgattctcccatcaactcagcttcacatattccatcatctaaaactgcatctctccctggctatggaagaaatgggcgactcggaccgatg

SEQ ID NO: 1728 - DNA, 203 bp, Homo sapiens
ggcgcgccagtcctgtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtcgactcggaccgatg

SEQ ID NO: 1729 - DNA, 203 bp, Homo sapiens
ggcgcgccagtcctaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctcgactcggaccgatg

SEQ ID NO: 1730 - DNA, 203 bp, Homo sapiens
ggcgcgccagtcctccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaagcgactcggaccgatg

SEQ ID NO: 1731 - DNA, 203 bp, Homo sapiens
ggcgcgccagtcctgaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgcttttcgactcggaccgatg

SEQ ID NO: 1732 - DNA, 203 bp, Homo sapiens
ggcgcgccagtccttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacacgactcggaccgatg

SEQ ID NO: 1733 - DNA, 203 bp, Homo sapiens
ggcgcgccagtcctcaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacgactcggaccgatg

SEQ ID NO: 1734 - DNA, 203 bp, Homo sapiens
ggcgcgccagtcctatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttgcgactcggaccgatg

SEQ ID NO: 1735 - DNA, 203 bp, Homo sapiens
ggcgcgccagtcctgtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacgactcggaccgatg

SEQ ID NO: 1736 - DNA, 203 bp, Homo sapiens
ggcgcgccagtcctgcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctggtgccgcgactcggaccgatg

SEQ ID NO: 1737 - DNA, 203 bp, Homo sapiens
ggcgcgccagtcctatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctgtgtgacttattaggagataggacgactcggaccgatg

SEQ ID NO: 1738 - DNA, 203 bp, Homo sapiens
ggcgcgccagtcctcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctacgactcggaccgatg

SEQ ID NO: 1739 - DNA, 203 bp, Homo sapiens
ggcgcgccagtccttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattcgactcggaccgatg

SEQ ID NO: 1740 - DNA, 203 bp, Homo sapiens
ggcgcgccagtcctttttggaaatatgaaagcaaatgtttagaagaattccttttgaaaagctgtgtcgtgttccctgtgaaactgagcaggtgtgtgttggcgcgctaagtgccacatgcttgtgtgtagaggaggaggtggccctgccggctccgcgctgctgtgcctgtgatccctacctgctcccgactcggaccgatg

SEQ ID NO: 1741 - DNA, 203 bp, Homo sapiens
ggcgcgccagtcctagaggaggaggtggccctgccggctccgcgctgctgtgcctgtgatccctacctgctccccgctcctgttgccagcagcactcactgcactcctttgtcatatactctgcatcactgtcatactcacaacttcgtgaataaagttgtgtgctttattcgtagaaaaaaaaaaaacgactcggaccgatg

SEQ ID NO: 1742 - DNA, 203 bp, Homo sapiens
ggcgcgccagtcctaagggggcttcttcataaagaacggagagtatctctgcaccctggactaccagcggatgtacgggacacgctgccatggctgtggggagttcgtggagggcgaagtggtgactgctctgggcaagacctaccatcccaattgctttgcttgtactatctgcaagcgcccgtttccgactcggaccgatg

SEQ ID NO: 1743 - DNA, 203 bp, Homo sapiens
ggcgcgccagtcctgctcaccaggtcatactatctatgcaaaagtagacaatgagatcctggattacaaggatttagcagccattccgaaggtcaaggcaatttatgacattgaacgtccagatcttattacctatgagcctttctacacttcgggctatgatgacaaacaggagagacagagccttgcgactcggaccgatg

SEQ ID NO: 1744 - DNA, 203 bp, Homo sapiens
ggcgcgccagtcctgagagtctccgaggactttgtctcctactccatcagcagaagggtaccaggatgttcgggatcggatgatccatcggtccacgagccagggctccatcaactcccctgtgtacagccgccacagctacactccaaccacgtcccgctctccccagcatttccacagacctggcacgactcggaccgatg

SEQ ID NO: 1745 - DNA, 203 bp, Homo sapiens
ggcgcgccagtcctcctcagaagatatcatcaagttttccaagttcccagcagcccaggcaccagaccccagcgagacaccaaagattgagacggaccactggcctggtcccccctcatttgctgtcgtaggacctgacatgaaacgcagatctagtggcagagaggaagatgatgaggaacttctgacgactcggaccgatg

SEQ ID NO: 1746 - DNA, 203 bp, Homo sapiens
ggcgcgccagtcctcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagcgactcggaccgatg

SEQ ID NO: 1747 - DNA, 203 bp, Homo sapiens
ggcgcgccagtccttttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatgcgactcggaccgatg

SEQ ID NO: 1748 - DNA, 203 bp, Homo sapiens
ggcgcgccagtcctaggattacaagctgtctctctgacaccagtggtaaaaaagcaagtagaatagtttctgagtctgtgttgcagcctctgacacgtggctcaccgctgtcatttgggggatggaatgaacagtcactgttctatagcatcctcctgtgctcttacctaaggaatctaaattgtcctcgactcggaccgatg

SEQ ID NO: 1749 - DNA, 203 bp, Homo sapiens
ggcgcgccagtcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacaccgactcggaccgatg

SEQ ID NO: 1750 - DNA, 203 bp, Homo sapiens
ggcgcgccagtcctttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgatacgactcggaccgatg

SEQ ID NO: 1751 - DNA, 203 bp, Homo sapiens
ggcgcgccagtcctcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatacgactcggaccgatg

SEQ ID NO: 1752 - DNA, 203 bp, Homo sapiens
ggcgcgccagtccttatggcaggcttccctggtgccgatgtaaagggctacatttgggaacatttgacttccttgggactcttaagtgcataatgatggcatgaagtaaaaggggcctcaatgatgataggaaaatcagttcttttaaaatttcttcaagaaaatccaggctatcacatagtctttctcgactcggaccgatg

SEQ ID NO: 1753 - DNA, 203 bp, Homo sapiens
ggcgcgccagtcctgtgtgacttattaggagataggaagagcattgggaaacttgcacagctagctatgcatctacattttggtttggggttagttatgaaatgttcttaatatgacgtgttcaataacttcacataaacttcctgttctccaaaacctcaaagagatagagttaatgagttgttgttcgactcggaccgatg

SEQ ID NO: 1754 - DNA, 203 bp, Homo sapiens
ggcgcgccagtccttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccaccgactcggaccgatg

SEQ ID NO: 1755 - DNA, 203 bp, Homo sapiens
ggcgcgccagtcctctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaacgactcggaccgatg

SEQ ID NO: 1756 - DNA, 203 bp, Homo sapiens
ggcgcgccagtcctagtctgaagagaggcgggacgcggggtgataacagctggctctggtgggcgggcgggagctggggaggaggagcaggagaggcccacaggcttcatttggagtcaggcctggctgttgctcaggtgaccagcttgtgtctctgggagggcgctgctttccccggccacccggcgcgactcggaccgatg

SEQ ID NO: 1757 - DNA, 203 bp, Homo sapiens
ggcgcgccagtcctccaaccaacgtggtgagctgagcgtcgggcagctgctcaagtggattgacaccacggcttgcctgtccgcggagaggcacgctggctgcccctgtgtcacagcttccatggatgacatctattttgagcacaccattagtgttggacaagtggtgaatatcaaggccaaggtgacgactcggaccgatg

SEQ ID NO: 1758 - DNA, 203 bp, Homo sapiens
ggcgcgccagtcctacagtgtggcggctgagcgccggcgcatgcgccttgtctatgcagacaccatcaaggacctcctggccaactgcgccattcagggcgatctggagagcagagactgtagccgcatggtgccggctgagaagacccgtgtggagagtgtggagctggtcctgcctccccacgccacgactcggaccgatg

SEQ ID NO: 1759 - DNA, 203 bp, Homo sapiens
ggcgcgccagtcctacagacgcggagagaccctctgctcaggcttctgcctctggcgcgagggggaccagctgaccaaggtatcctactacaaccaggccaccccaggtgttctcaactatgtgaccaccaacgtggccggcctctcctctgagttctacaccaccttcaaggcttgtgagcagtttccgactcggaccgatg

SEQ ID NO: 1760 - DNA, 203 bp, Homo sapiens
ggcgcgccagtcctggagggctgcgggctccgctatttgcaaatggatgccccagtgtccgggatgtgtggccagctgctgcaggcaggactccagcgtcaggatgttgccacttggagtatgaacaatgggcacggggttttcagccacagttccctcgaggccagtgttcagcaggatcatgccttcgactcggaccgatg

SEQ ID NO: 1761 - DNA, 203 bp, Homo sapiens
ggcgcgccagtccttgcctggtgcatgagaaactcttgtttcagctcttggcctttacccatgactcagcctgggggctggtgccggccttgcctgcagcaatgtagctgaggactggtctgaaggccaggagccctgtgctcttgacatcactgtactccctctccctccccgcaaccctgccccaccgactcggaccgatg

SEQ ID NO: 1762 - DNA, 203 bp, Homo sapiens
ggcgcgccagtcctactcagcctgggggctggtgccggccttgcctgcagcaatgtagctgaggactggtctgaaggccaggagccctgtgctcttgacatcactgtactccctctccctccccgcaaccctgccccaccttgcatccagggtatggtgtaaataaacctgtgttgccatggcaacagcgactcggaccgatg

SEQ ID NO: 1763 - DNA, 203 bp, Homo sapiens
ggcgcgccagtccttgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgtcgactcggaccgatg

SEQ ID NO: 1764 - DNA, 203 bp, Homo sapiens
ggcgcgccagtccttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctcgactcggaccgatg

SEQ ID NO: 1765 - DNA, 203 bp, Homo sapiens
ggcgcgccagtcctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgcgactcggaccgatg

SEQ ID NO: 1766 - DNA, 203 bp, Homo sapiens
ggcgcgccagtcctggtagcgccagtgccgattccgttttatccagaattaaccagcgcttagatatggtgccgcatttggagacagacatgatgcaaggaggcgtgtacggctcaggtggagaaaggtatgactcttatgagtcctgcgactcgagggccgtcctgagtgagcgcgacctgtaccggcgactcggaccgatg

SEQ ID NO: 1767 - DNA, 203 bp, Homo sapiens
ggcgcgccagtcctatgtgggaagaccccatgggggcccggggccagtgcatgtctggtgcctctcggctgccctccctcttctcccagaacatcatccccgagtacggcatgttccagggcatgcgaggtgggggcgccttcccgggcggctcccgctttggtttcgggtttggcaatggcatgaagcgactcggaccgatg

SEQ ID NO: 1768 - DNA, 203 bp, Homo sapiens
ggcgcgccagtcctttcattcccatgcagtttgggatcatccagaagcatctgaagaccatggatcacaaccggaaccgcaggctcatgatggagcagtccaagaagtcctccctcatggtggcccgcagtattctcaacaacaagctcatcagcaagaagctggagcgctacctgaagggcgagaaccgactcggaccgatg

SEQ ID NO: 1769 - DNA, 203 bp, Homo sapiens
ggcgcgccagtcctgatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctagcgactcggaccgatg

SEQ ID NO: 1770 - DNA, 203 bp, Homo sapiens
ggcgcgccagtcctaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccacgactcggaccgatg

SEQ ID NO: 1771 - DNA, 203 bp, Homo sapiens
ggcgcgccagtcctgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgcgactcggaccgatg

SEQ ID NO: 1772 - DNA, 203 bp, Homo sapiens
ggcgcgccagtccttcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtcgactcggaccgatg

SEQ ID NO: 1773 - DNA, 203 bp, Homo sapiens
ggcgcgccagtcctaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagcgactcggaccgatg

SEQ ID NO: 1774 - DNA, 203 bp, Homo sapiens
ggcgcgccagtcctgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgaccgactcggaccgatg

SEQ ID NO: 1775 - DNA, 203 bp, Homo sapiens
ggcgcgccagtcctgtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggccgactcggaccgatg

SEQ ID NO: 1776 - DNA, 203 bp, Homo sapiens
ggcgcgccagtccttgcggccgggatttgtcccctcttcggcttccgtagaggaagtggcgcggaccttcatttggggtttcggttcccccccttccccttccccggggtctgggggtgacattgcaccgcgcccctcgtggggtcgcgttgccaccccacgcggactccccagctcgcgcgcccctccgactcggaccgatg

SEQ ID NO: 1777 - DNA, 203 bp, Homo sapiens
ggcgcgccagtcctccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttccgactcggaccgatg

SEQ ID NO: 1778 - DNA, 203 bp, Homo sapiens
ggcgcgccagtccttggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgagcgactcggaccgatg

SEQ ID NO: 1779 - DNA, 203 bp, Homo sapiens
ggcgcgccagtcctctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcgactcggaccgatg

SEQ ID NO: 1780 - DNA, 203 bp, Homo sapiens
ggcgcgccagtccttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttccgactcggaccgatg

SEQ ID NO: 1781 - DNA, 203 bp, Homo sapiens
ggcgcgccagtccttccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtccgactcggaccgatg

SEQ ID NO: 1782 - DNA, 203 bp, Homo sapiens
ggcgcgccagtcctgcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccacgactcggaccgatg

SEQ ID NO: 1783 - DNA, 203 bp, Homo sapiens
ggcgcgccagtcctcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacccgactcggaccgatg

SEQ ID NO: 1784 - DNA, 203 bp, Homo sapiens
ggcgcgccagtccttggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaatcgactcggaccgatg

SEQ ID NO: 1785 - DNA, 203 bp, Homo sapiens
ggcgcgccagtcctaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgcgactcggaccgatg

SEQ ID NO: 1786 - DNA, 203 bp, Homo sapiens
ggcgcgccagtcctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaacgactcggaccgatg

SEQ ID NO: 1787 - DNA, 203 bp, Homo sapiens
ggcgcgccagtccttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgcgactcggaccgatg

SEQ ID NO: 1788 - DNA, 203 bp, Homo sapiens
ggcgcgccagtccttctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacacccgactcggaccgatg

SEQ ID NO: 1789 - DNA, 203 bp, Homo sapiens
ggcgcgccagtcctaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttatcgactcggaccgatg

SEQ ID NO: 1790 - DNA, 203 bp, Homo sapiens
ggcgcgccagtccttttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgcgactcggaccgatg

SEQ ID NO: 1791 - DNA, 203 bp, Homo sapiens
ggcgcgccagtcctatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattcgactcggaccgatg

SEQ ID NO: 1792 - DNA, 203 bp, Homo sapiens
ggcgcgccagtcctatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccaggcgactcggaccgatg

SEQ ID NO: 1793 - DNA, 203 bp, Homo sapiens
ggcgcgccagtcctaaatggttcacggctgacacatttggcatagatacctcatcctgtctacctttcatgaccaactacagttttcattgcaacgtctgccatcacagtgggaatacctatttcctccggaagcaagcaaacttgaaggaaatgtgccttagtgctttggccaacctgacatggcagcgactcggaccgatg

SEQ ID NO: 1794 - DNA, 203 bp, Homo sapiens
ggcgcgccagtcctgaacacccagatccaggcagtaaagatccagaagaagattaccccaaatttggacttttggatcaggaccttagtaacattggtcctgcttatgacaaccaaaaacagagcagtgctgtgtctactagtgggaatttaaatgggggaattgcagcaggaagcagcggaaaaggacgactcggaccgatg

SEQ ID NO: 1795 - DNA, 203 bp, Homo sapiens
ggcgcgccagtcctcgaggagccaagcgcaaacagcaggatggagggaccacagggaccaccaagaaggcccggagtgaccctttgttttctgctcagcgccttccccctcatggctacccattggaacacccgtttaacaaagatggctatcggtatattctagctgagcctgatccgcacgcccctcgactcggaccgatg

SEQ ID NO: 1796 - DNA, 203 bp, Homo sapiens
ggcgcgccagtccttgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgcgactcggaccgatg

SEQ ID NO: 1797 - DNA, 203 bp, Homo sapiens
ggcgcgccagtccttgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgcgactcggaccgatg

SEQ ID NO: 1798 - DNA, 203 bp, Homo sapiens
ggcgcgccagtcctgtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaagaatgagccttctaggctgggcgccgactcggaccgatg

SEQ ID NO: 1799 - DNA, 203 bp, Homo sapiens
ggcgcgccagtccttcaggcgggctccgtggatgaagagaatggccgacagttgggtgaggtagagctgcaatgtgggatttgtacaaaatggttcacggctgacacatttggcatagatacctcatcctgtctacctttcatgaccaactacagttttcattgcaacgtctgccatcacagtgggaacgactcggaccgatg

SEQ ID NO: 1800 - DNA, 203 bp, Homo sapiens
ggcgcgccagtcctacctgggaaaatgacttggccaaataacattgttaaaacaatgagtaaagaaagagatgtattcttggtaaaggaacacccagatccaggcagtaaagatccagaagaagattaccccaaatttggacttttggatcaggaccttagtaacattggtcctgcttatgacaaccacgactcggaccgatg

SEQ ID NO: 1801 - DNA, 203 bp, Homo sapiens
ggcgcgccagtcctttacttcccagccatctcactgtacaagagctgcacggtttccattaactttggaccatgcttcaagtatcctccgaaggatctcacttaccgccctatgagtgacatgggctggggcgccgtggtagagcacaccctggctgacgtcttgtatcacgtggagacagaagtggacgactcggaccgatg

SEQ ID NO: 1802 - DNA, 203 bp, Homo sapiens
ggcgcgccagtcctgtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttgcgactcggaccgatg

SEQ ID NO: 1803 - DNA, 203 bp, Homo sapiens
ggcgcgccagtccttttcctccgaagctctgtggtccgatctggggtccgcttgctttccctgcccggtcccgagcgctcagcctgaagcgccgctttcgagggcaccctgcatacactggccgcgcctcagggatctcattgcccgcgctttctcattgcctctttccgtgttcgattcggctgatccgactcggaccgatg

SEQ ID NO: 1804 - DNA, 203 bp, Homo sapiens
ggcgcgccagtccttgaaatggaaaatagtttatctgatcctgagaatgaacagacagttcagaaaagaaaatctaatgttgttatacaggaggaagaattagaattggctgttttggaagctggaagttctgaagctgtgaaaccaaaatgcactctagaagaaagacagcaatttatgaaagcattcgactcggaccgatg

SEQ ID NO: 1805 - DNA, 203 bp, Homo sapiens
ggcgcgccagtccttgatgaaagcagtcaagatacatctgaaaaatctcaggattgtgatgttcaatgtaaagcaaagcgtgacttcctaatgagtggtttgccagatttgttgaaacggcaaattgcaaagaaagctgctgcgctggatgtgtacaatgcagtgagtaccagtttccagagagtcgtcgactcggaccgatg

SEQ ID NO: 1806 - DNA, 203 bp, Homo sapiens
ggcgcgccagtcctggaggctgatgtcagccataaagaaaccaaaaggaaactcgtagaagcagaaaattctaagtcaaaaagaaagaaaccaaatgagtattcaaaaaatctggagaagaccaataggaagtcagaagaacttagcaaaagaaacaactcttctgggataaagctagattcttccaacgactcggaccgatg

SEQ ID NO: 1807 - DNA, 203 bp, Homo sapiens
ggcgcgccagtccttacaagtgacccaacatttagtttaatgtttgatggctgctttgaagaaatcaagttcagtactccttccctgctaaatgttgccagctacctacaaatgatttgcttaactgagaattttagaactgatgtaaaagactttgtaaccttgttaactgcaaatacttgtgatatcgactcggaccgatg

SEQ ID NO: 1808 - DNA, 203 bp, Homo sapiens
ggcgcgccagtcctgaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaaaggaaacaatccagagacaaagaaatccgactcggaccgatg

SEQ ID NO: 1809 - DNA, 203 bp, Homo sapiens
ggcgcgccagtcctaacccttcgaaacatctgtaagactgagaagctaaaagaacaaggaaaaagtaaaagaagattcctgcactattttgaaggaattcatcttgacattccaaaagagactgtgaatactttggcagctgacttcccttaatgttccatactaacaatgctttgtatagattatcacgactcggaccgatg

SEQ ID NO: 1810 - DNA, 203 bp, Homo sapiens
ggcgcgccagtccttctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtcgactcggaccgatg

SEQ ID NO: 1811 - DNA, 203 bp, Homo sapiens
ggcgcgccagtccttgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgcgactcggaccgatg

SEQ ID NO: 1812 - DNA, 203 bp, Homo sapiens
ggcgcgccagtccttcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttcgactcggaccgatg

SEQ ID NO: 1813 - DNA, 203 bp, Homo sapiens
ggcgcgccagtcctcccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttagcgactcggaccgatg

SEQ ID NO: 1814 - DNA, 203 bp, Homo sapiens
ggcgcgccagtccttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccgactcggaccgatg

SEQ ID NO: 1815 - DNA, 203 bp, Homo sapiens
ggcgcgccagtcctcaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtcgactcggaccgatg

SEQ ID NO: 1816 - DNA, 203 bp, Homo sapiens
ggcgcgccagtccttgaaaggaaaaagaggcgacgagaaagaaataagattgcagctgcaaagtgccgaaacaagaagaaggagaagacggagtgcctgcagaaactcccaaggcccttttgggtccagaagacctgcatatgggctgttgactcatgcaaatgaggtatctgaactgcagcttcagtcgactcggaccgatg

SEQ ID NO: 1817 - DNA, 203 bp, Homo sapiens
ggcgcgccagtcctattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccacccgactcggaccgatg

SEQ ID NO: 1818 - DNA, 203 bp, Homo sapiens
ggcgcgccagtcctccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgcgactcggaccgatg

SEQ ID NO: 1819 - DNA, 203 bp, Homo sapiens
ggcgcgccagtcctctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccacgactcggaccgatg

SEQ ID NO: 1820 - DNA, 203 bp, Homo sapiens
ggcgcgccagtcctaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggcgactcggaccgatg

SEQ ID NO: 1821 - DNA, 203 bp, Homo sapiens
ggcgcgccagtcctttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcacgactcggaccgatg

SEQ ID NO: 1822 - DNA, 203 bp, Homo sapiens
ggcgcgccagtcctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacgactcggaccgatg

SEQ ID NO: 1823 - DNA, 203 bp, Homo sapiens
ggcgcgccagtcctctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaaccgactcggaccgatg

SEQ ID NO: 1824 - DNA, 203 bp, Homo sapiens
ggcgcgccagtcctgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggacgactcggaccgatg

SEQ ID NO: 1825 - DNA, 203 bp, Homo sapiens
ggcgcgccagtcctcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagacgactcggaccgatg

SEQ ID NO: 1826 - DNA, 203 bp, Homo sapiens
ggcgcgccagtcctagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctccgactcggaccgatg

SEQ ID NO: 1827 - DNA, 203 bp, Homo sapiens
ggcgcgccagtcctgaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactccgactcggaccgatg

SEQ ID NO: 1828 - DNA, 203 bp, Homo sapiens
ggcgcgccagtcctgaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactcgactcggaccgatg

SEQ ID NO: 1829 - DNA, 203 bp, Homo sapiens
ggcgcgccagtccttaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcacgactcggaccgatg

SEQ ID NO: 1830 - DNA, 203 bp, Homo sapiens
ggcgcgccagtcctctgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactcgactcggaccgatg

SEQ ID NO: 1831 - DNA, 203 bp, Homo sapiens
ggcgcgccagtcctacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggccgactcggaccgatg

SEQ ID NO: 1832 - DNA, 203 bp, Homo sapiens
ggcgcgccagtcctcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactgcgactcggaccgatg

SEQ ID NO: 1833 - DNA, 203 bp, Homo sapiens
ggcgcgccagtcctatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgcgactcggaccgatg

SEQ ID NO: 1834 - DNA, 203 bp, Homo sapiens
ggcgcgccagtccttttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagcgactcggaccgatg

SEQ ID NO: 1835 - DNA, 203 bp, Homo sapiens
ggcgcgccagtcctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcacgactcggaccgatg

SEQ ID NO: 1836 - DNA, 203 bp, Homo sapiens
ggcgcgccagtccttgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccgactcggaccgatg

SEQ ID NO: 1837 - DNA, 203 bp, Homo sapiens
ggcgcgccagtccttgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccgactcggaccgatg

SEQ ID NO: 1838 - DNA, 203 bp, Homo sapiens
ggcgcgccagtcctcactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgacgactcggaccgatg

SEQ ID NO: 1839 - DNA, 203 bp, Homo sapiens
ggcgcgccagtccttggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacgactcggaccgatg

SEQ ID NO: 1840 - DNA, 203 bp, Homo sapiens
ggcgcgccagtcctgggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcgactcggaccgatg

SEQ ID NO: 1841 - DNA, 203 bp, Homo sapiens
ggcgcgccagtcctcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtcgactcggaccgatg

SEQ ID NO: 1842 - DNA, 203 bp, Homo sapiens
ggcgcgccagtcctatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgccgactcggaccgatg

SEQ ID NO: 1843 - DNA, 203 bp, Homo sapiens
ggcgcgccagtcctcggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcacccgactcggaccgatg

SEQ ID NO: 1844 - DNA, 203 bp, Homo sapiens
ggcgcgccagtcctgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgcgactcggaccgatg

SEQ ID NO: 1845 - DNA, 203 bp, Homo sapiens
ggcgcgccagtcctagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcgactcggaccgatg

SEQ ID NO: 1846 - DNA, 203 bp, Homo sapiens
ggcgcgccagtcctcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttcctcgactcggaccgatg

SEQ ID NO: 1847 - DNA, 203 bp, Homo sapiens
ggcgcgccagtcctcatttgaacctgggaggtagaggttgctgtgagccgagattacgcccctgcactccagcctgggtcacagagtgagactccatctcagaaaaaaaaaaaattgagtcaggtgcagtagctccttcctgtagtcccagctacttgggaggctgaggctagaggatcacttgagcccgactcggaccgatg

SEQ ID NO: 1848 - DNA, 203 bp, Homo sapiens
ggcgcgccagtccttagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtccgactcggaccgatg

SEQ ID NO: 1849 - DNA, 203 bp, Homo sapiens
ggcgcgccagtcctcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtcgactcggaccgatg

SEQ ID NO: 1850 - DNA, 203 bp, Homo sapiens
ggcgcgccagtcctctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacgactcggaccgatg

SEQ ID NO: 1851 - DNA, 203 bp, Homo sapiens
ggcgcgccagtccttttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttcgactcggaccgatg

SEQ ID NO: 1852 - DNA, 203 bp, Homo sapiens
ggcgcgccagtcctgacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgccgactcggaccgatg

SEQ ID NO: 1853 - DNA, 203 bp, Homo sapiens
ggcgcgccagtcctctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgctacgactcggaccgatg

SEQ ID NO: 1854 - DNA, 203 bp, Homo sapiens
ggcgcgccagtcctaacgctggtcctcggccgggcgcgctgacgtcatcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtcgactcggaccgatg

SEQ ID NO: 1855 - DNA, 203 bp, Homo sapiens
ggcgcgccagtcctgacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactcccgactcggaccgatg

SEQ ID NO: 1856 - DNA, 203 bp, Homo sapiens
ggcgcgccagtcctaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagacgactcggaccgatg

SEQ ID NO: 1857 - DNA, 203 bp, Homo sapiens
ggcgcgccagtccttagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagcgactcggaccgatg

SEQ ID NO: 1858 - DNA, 203 bp, Homo sapiens
ggcgcgccagtcctagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatccgactcggaccgatg

SEQ ID NO: 1859 - DNA, 203 bp, Homo sapiens
ggcgcgccagtcctcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggacgactcggaccgatg

SEQ ID NO: 1860 - DNA, 203 bp, Homo sapiens
ggcgcgccagtcctctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgcgactcggaccgatg

SEQ ID NO: 1861 - DNA, 203 bp, Homo sapiens
ggcgcgccagtcctgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcgactcggaccgatg

SEQ ID NO: 1862 - DNA, 203 bp, Homo sapiens
ggcgcgccagtcctaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacccgactcggaccgatg

SEQ ID NO: 1863 - DNA, 203 bp, Homo sapiens
ggcgcgccagtcctgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctcgactcggaccgatg

SEQ ID NO: 1864 - DNA, 203 bp, Homo sapiens
ggcgcgccagtcctaagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacgactcggaccgatg

SEQ ID NO: 1865 - DNA, 203 bp, Homo sapiens
ggcgcgccagtccttgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccgactcggaccgatg

SEQ ID NO: 1866 - DNA, 203 bp, Homo sapiens
ggcgcgccagtcctcagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgacgactcggaccgatg

SEQ ID NO: 1867 - DNA, 203 bp, Homo sapiens
ggcgcgccagtcctggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggccgactcggaccgatg

SEQ ID NO: 1868 - DNA, 203 bp, Homo sapiens
ggcgcgccagtcctctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagacgactcggaccgatg

SEQ ID NO: 1869 - DNA, 203 bp, Homo sapiens
ggcgcgccagtcctaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagattcgactcggaccgatg

SEQ ID NO: 1870 - DNA, 203 bp, Homo sapiens
ggcgcgccagtcctcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgcgactcggaccgatg

SEQ ID NO: 1871 - DNA, 203 bp, Homo sapiens
ggcgcgccagtcctacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttacgactcggaccgatg

SEQ ID NO: 1872 - DNA, 203 bp, Homo sapiens
ggcgcgccagtcctatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgacgactcggaccgatg

SEQ ID NO: 1873 - DNA, 203 bp, Homo sapiens
ggcgcgccagtccttggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactctcgactcggaccgatg

SEQ ID NO: 1874 - DNA, 203 bp, Homo sapiens
ggcgcgccagtcctaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcgactcggaccgatg

SEQ ID NO: 1875 - DNA, 203 bp, Homo sapiens
ggcgcgccagtcctcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagttcgactcggaccgatg

SEQ ID NO: 1876 - DNA, 203 bp, Homo sapiens
ggcgcgccagtcctctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcacgactcggaccgatg

SEQ ID NO: 1877 - DNA, 203 bp, Homo sapiens
ggcgcgccagtcctacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgcgactcggaccgatg

SEQ ID NO: 1878 - DNA, 203 bp, Homo sapiens
ggcgcgccagtcctaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggcgactcggaccgatg

SEQ ID NO: 1879 - DNA, 203 bp, Homo sapiens
ggcgcgccagtcctacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcacccgactcggaccgatg

SEQ ID NO: 1880 - DNA, 203 bp, Homo sapiens
ggcgcgccagtcctcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccgactcggaccgatg

SEQ ID NO: 1881 - DNA, 203 bp, Homo sapiens
ggcgcgccagtccttgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggcgactcggaccgatg

SEQ ID NO: 1882 - DNA, 203 bp, Homo sapiens
ggcgcgccagtccttcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgcgactcggaccgatg

SEQ ID NO: 1883 - DNA, 203 bp, Homo sapiens
ggcgcgccagtccttggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgactcggaccgatg

SEQ ID NO: 1884 - DNA, 203 bp, Homo sapiens
ggcgcgccagtcctcgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgtcgactcggaccgatg

SEQ ID NO: 1885 - DNA, 203 bp, Homo sapiens
ggcgcgccagtccttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacccgactcggaccgatg

SEQ ID NO: 1886 - DNA, 203 bp, Homo sapiens
ggcgcgccagtcctgtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgatacgactcggaccgatg

SEQ ID NO: 1887 - DNA, 203 bp, Homo sapiens
ggcgcgccagtcctagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagacgactcggaccgatg

SEQ ID NO: 1888 - DNA, 203 bp, Homo sapiens
ggcgcgccagtcctctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagcccgactcggaccgatg

SEQ ID NO: 1889 - DNA, 203 bp, Homo sapiens
ggcgcgccagtcctgccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccacccccccgactcggaccgatg

SEQ ID NO: 1890 - DNA, 203 bp, Homo sapiens
ggcgcgccagtcctatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactcgactcggaccgatg

SEQ ID NO: 1891 - DNA, 203 bp, Homo sapiens
ggcgcgccagtcctcagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatcgactcggaccgatg

SEQ ID NO: 1892 - DNA, 203 bp, Homo sapiens
ggcgcgccagtcctgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacgactcggaccgatg

SEQ ID NO: 1893 - DNA, 203 bp, Homo sapiens
ggcgcgccagtcctaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccgactcggaccgatg

SEQ ID NO: 1894 - DNA, 203 bp, Homo sapiens
ggcgcgccagtccttgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgccgactcggaccgatg

SEQ ID NO: 1895 - DNA, 203 bp, Homo sapiens
ggcgcgccagtcctaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtcgactcggaccgatg

SEQ ID NO: 1896 - DNA, 203 bp, Homo sapiens
ggcgcgccagtcctcagaagagaagggaaatggcaagggagcattccaggagagaaagggaccgcttggagcagttagaaaggaagcgggagcgggagcgcaagatgcgggagcagcagaaggagcagcgggagcagaaggagcgcgagcggcgggcggaggagcggcgcaaggagcgggaggcccgccgactcggaccgatg

SEQ ID NO: 1897 - DNA, 203 bp, Homo sapiens
ggcgcgccagtcctagggaagtgtctgcacatcaccgaacgatgagagaggactacagcgacaaagtgaaagccagccactggagtcgcagcccgcctcggccgccgcgggagcggttcgagttgggagacggccggaagccagtaaaagaagagaaaatggaagaaagggacctgctgtccgacttacgactcggaccgatg

SEQ ID NO: 1898 - DNA, 203 bp, Homo sapiens
ggcgcgccagtcctctgagccacgccggcatcctcaaggtgggtgattttgggctggcgcgggagtacggatcccctctgaaggcctacaccccggtcgtggtgacccagtggtaccgcgccccagagctgctgcttggtgccaaggaatactccacggccgtggacatgtggtcagtgggctgcatccgactcggaccgatg

SEQ ID NO: 1899 - DNA, 203 bp, Homo sapiens
ggcgcgccagtcctttcggggagctgctgactcagaagcctctgttccccgggaattcggaaatcgatcagatcaacaaagtgttcaaggagctggggacccccagtgagaaaatctggcccggctacagtgagctcccagtagtcaaaaagatgaccttcagcgagcacccctacaacaacctccgccgactcggaccgatg

SEQ ID NO: 1900 - DNA, 203 bp, Homo sapiens
ggcgcgccagtcctaagcgcttcggggctctgctctcagaccagggcttcgacctcatgaacaagttcctgacctacttccccgggaggaggatcagcgctgaggacggcctcaagcatgagtatttccgcgagacccccctccccatcgacccctccatgttccccacgtggcccgccaagagcgagcgactcggaccgatg

SEQ ID NO: 1901 - DNA, 203 bp, Homo sapiens
ggcgcgccagtcctgcccagactcggacgggctttgccaccctctccgcttgcctggtcccctctcctctccgccctcccgctcgccagtccatttgatcagcggagactcggcggccgggccggggcttccccgcagcccctgcgcgctcctagagctcgggccgtggctcgtcggggtctgtgtctcgactcggaccgatg

SEQ ID NO: 1902 - DNA, 203 bp, Homo sapiens
ggcgcgccagtccttttggctccgagggcagtcgctgggcttccgagaggggttcgggctgcgtaggggcgctttgttttgttcggttttgtttttttgagagtgcgagagaggcggtcgtgcagacccgggagaaagatgtcaaacgtgcgagtgtctaacgggagccctagcctggagcggatggacgactcggaccgatg

SEQ ID NO: 1903 - DNA, 203 bp, Homo sapiens
ggcgcgccagtcctaaagactgatccgtcggacagccagacggggttagcggagcaatgcgcaggaataaggaagcgacctgcaaccgacgattcttctactcaaaacaaaagagccaacagaacagaagaaaatgtttcagacggttccccaaatgccggttctgtggagcagacgcccaagaagcccgactcggaccgatg

SEQ ID NO: 1904 - DNA, 203 bp, Homo sapiens
ggcgcgccagtcctcccggggcccgcttgcctcagcttcttgctgccgccagcacgctaagctccagtcggcgccgaaggagagcttcccgaccctcgtgtccagtagccgcaatcccaggctgggagggtgaggcgccgcgctctgccgcccccccgcccctcgctccctgtgtcctggcggatttgcgactcggaccgatg

SEQ ID NO: 1905 - DNA, 203 bp, Homo sapiens
ggcgcgccagtcctcacgtaatctatccgaaagcccagtcccacccgccacccgactctggagctcccattcttcaggaccctgctgaagtatcgcttctcagccgccttctccaggcgcagctgcattcgcttctcggtttttgcactcgctgtgcaccgagttactttcccggcccctcgttgacacgactcggaccgatg

SEQ ID NO: 1906 - DNA, 203 bp, Homo sapiens
ggcgcgccagtcctccgttcacaggtggctgttggtctttagtaagggtgctgtcttccctgtctgatccttagcaaaagtaggaaggtagagttgttggcagaaatcctgggataagagaatagtttcctggaagatctgtgcctccaaccagcagagagggattgagcttcattgaactcaacagacgactcggaccgatg

SEQ ID NO: 1907 - DNA, 203 bp, Homo sapiens
ggcgcgccagtcctgccaacatttcatagcaccatgttcaagaggaggttgaagtggcatggcaatggttagagaccctgctgggcgtgaacaccctctggctacctagggacctgtgggcctaccacctggtgccctcatggagacaagaagccctgggttgaacaacatgaagccccagtcactgccgactcggaccgatg

SEQ ID NO: 1908 - DNA, 203 bp, Homo sapiens
ggcgcgccagtccttactagccaagacccaggagctggagaaggaagcccatgaaaggagccaggagttaatacagctgaagagtcaaggggatctggagaaggctgaacttcaggaccgggtgaccgagctctctgctctgttgacccagtctcagaagcaaaatgaagattatgaaaagatgataacgactcggaccgatg

SEQ ID NO: 1909 - DNA, 203 bp, Homo sapiens
ggcgcgccagtccttcagtgaactgatcactcttcgggaagccctggagtcaagtcacctggaaggggagttactgaggcaagagcaaacggaagtgaccgcagcgctggctagggcagagcagtcaattgcagagctgtcgagttctgaaaacaccctgaagacagaagtagctgatcttcgggctgcgactcggaccgatg

SEQ ID NO: 1910 - DNA, 203 bp, Homo sapiens
ggcgcgccagtcctaagccctgtgggaaaagaacactcacctggaggctcagctgcagaaagctgaggaggctggggctgagctgcaggcagatctcagggacatccaagaagagaaggaagaaattcaaaagaaactaagtgagtcacgtcaccagcaggaggcagccacgactcagctggagcagccgactcggaccgatg

SEQ ID NO: 1911 - DNA, 203 bp, Homo sapiens
ggcgcgccagtcctgcagtctgtttgaagcccaacaacaaaattctgtgatagaggtcaccaaggggcagctggaggtccagattcaaactgtcactcaagccaaggaagtaatccaaggggaagtgaggtgcctgaagctggaactggacactgaacggagtcaggcagagcaggagcgggatgctgcgactcggaccgatg

SEQ ID NO: 1912 - DNA, 203 bp, Homo sapiens
ggcgcgccagtcctctctctccgctgaggcagtagcatctgccctccacaagcttcatcaagacctgtggaagactcaacagacccgggatgttctgagggatcaggtccagaaactggaagagcgtctaactgatactgaggctgagaagagccaggtccacacagagttgcaggatctgcagagaccgactcggaccgatg

SEQ ID NO: 1913 - DNA, 203 bp, Homo sapiens
ggcgcgccagtcctgcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaagacgactcggaccgatg

SEQ ID NO: 1914 - DNA, 203 bp, Homo sapiens
ggcgcgccagtcctagaggaaccaagaggtagatctgcagcaagaacagattcaggagctagagaagtgtaggtctgttttagagcatctgcccatggccgtccaggagcgagagcagaagctgactgtgcagagggagcagatcagagagctcgagaaggatcgggagactcagaggaacgtcttggcgactcggaccgatg

SEQ ID NO: 1915 - DNA, 203 bp, Homo sapiens
ggcgcgccagtcctagctgcagaggcagaaagagcatctgactcaggatctcgagaggagagaccaggagctgatgctgcagaaggagaggattcaggttctcgaggatcagaggacccggcagaccaagatcctggaggaggacctggaacagatcaagctgtccttgagagagcgaggccgggagccgactcggaccgatg

SEQ ID NO: 1916 - DNA, 203 bp, Homo sapiens
ggcgcgccagtcctagcagctccagggcctgcacaggaaggtaggtgagaccagcctcctcctgtcccagcgagagcaggaaatagtggtcctgcagcagcaactgcaggaagccagggaacaaggggagctgaaggagcagtcacttcagagtcaactggatgaggcccagagagccctagcccagacgactcggaccgatg

SEQ ID NO: 1917 - DNA, 203 bp, Homo sapiens
ggcgcgccagtcctgggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggaggcgactcggaccgatg

SEQ ID NO: 1918 - DNA, 203 bp, Homo sapiens
ggcgcgccagtcctaagagctggcagtggagggacggcgggtccaggccctggaggaggtgctgggagacctaagggctgagtctcgggaacaggagaaagctctgttggccctccagcagcagtgtgctgagcaggcacaggagcatgaggtggagaccagggccctgcaggacagctggctgcaggcgactcggaccgatg

SEQ ID NO: 1919 - DNA, 203 bp, Homo sapiens
ggcgcgccagtcctaagccagggagattgagtggagggagaaggcccaggacttggcactctccctagcgcagaccaaggccagtgtcagcagtctgcaggaggtagccatgttcctacaagcctctgtcctggagcgggactcagaacagcaaaggctgcaggatgaactggagctcaccagacgggcgactcggaccgatg

SEQ ID NO: 1920 - DNA, 203 bp, Homo sapiens
ggcgcgccagtcctctctggagaaggagcggctacacagcccaggtgcaaccagcacagcagaactggggtccagaggggagcagggtgtgcagctgggagaggtctcaggagtggaggctgagcctagtcctgatggaatggagaagcagtcatggagacaaaggcttgaacacctgcagcaagcagcgactcggaccgatg

SEQ ID NO: 1921 - DNA, 203 bp, Homo sapiens
ggcgcgccagtcctttcttgccgtggcccaggcccctgaggccactgtcctggaggcagagacccgcaggctggatgagtccctgactcaaagtctgacatccccagggccagtcctgctacaccccagccccagcactacccaagccgcctccaggtagcagccacagccaggagcacacagacagacgactcggaccgatg

SEQ ID NO: 1922 - DNA, 203 bp, Homo sapiens
ggcgcgccagtcctagactgtgtcatgggtcatggcccctccgcacacctacaggtttgccaaaggaaaagcctggctctgttaggcacccaggagccccaggtcggcgggtgttcccaggaagaggaagtaaatctgcaaccctggggaggaccccaactcacctgggaatgaggcaaattgcatttcgactcggaccgatg

SEQ ID NO: 1923 - DNA, 203 bp, Homo sapiens
ggcgcgccagtcctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaaccttttttcgactcggaccgatg

SEQ ID NO: 1924 - DNA, 203 bp, Homo sapiens
ggcgcgccagtccttgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggcgactcggaccgatg

SEQ ID NO: 1925 - DNA, 203 bp, Homo sapiens
ggcgcgccagtcctagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagacgactcggaccgatg

SEQ ID NO: 1926 - DNA, 203 bp, Homo sapiens
ggcgcgccagtcctgtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtacgactcggaccgatg

SEQ ID NO: 1927 - DNA, 203 bp, Homo sapiens
ggcgcgccagtcctggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgcgactcggaccgatg

SEQ ID NO: 1928 - DNA, 203 bp, Homo sapiens
ggcgcgccagtcctggaaggggagagaaaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattcgactcggaccgatg

SEQ ID NO: 1929 - DNA, 203 bp, Homo sapiens
ggcgcgccagtcctgtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttcgactcggaccgatg

SEQ ID NO: 1930 - DNA, 203 bp, Homo sapiens
ggcgcgccagtcctataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaagcgactcggaccgatg

SEQ ID NO: 1931 - DNA, 203 bp, Homo sapiens
ggcgcgccagtccttagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattactcgactcggaccgatg

SEQ ID NO: 1932 - DNA, 203 bp, Homo sapiens
ggcgcgccagtcctaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacacgactcggaccgatg

SEQ ID NO: 1933 - DNA, 203 bp, Homo sapiens
ggcgcgccagtcctataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctccgactcggaccgatg

SEQ ID NO: 1934 - DNA, 203 bp, Homo sapiens
ggcgcgccagtcctatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggcaccatcatgactcgactcggaccgatg

SEQ ID NO: 1935 - DNA, 203 bp, Homo sapiens
ggcgcgccagtcctccaagcggaggagatccgatgaatttaggcctcaaaattaccaccagcaggatttccgacgaatgtctgatcaccgccccgctatgggctaccatggccagggaccctcagaccattaccgctctttccacacagataaactgggggaatataaacagcctctacccccattgccgactcggaccgatg

SEQ ID NO: 1936 - DNA, 203 bp, Homo sapiens
ggcgcgccagtccttggcaccccatcccattccagcctagttctggcctcccactttgacgggcacttggaggaggagctgactgtgtgtgtaccagcttcactgggatgtgtttccccagtcaaggaacaggggatcttcagagtcatgaatgttttcttgccagggtcagtgttcccaggaccttacgactcggaccgatg

SEQ ID NO: 1937 - DNA, 203 bp, Homo sapiens
ggcgcgccagtcctgtgcatggtcggggcaggaactggtgcatggaggctgctgggacctggtgaacagtgtgtgatttggttgatttggttcactctgacatgatggatgctgctgatggggagtggcgagttggggcaagcgggtggggacaagcataggacttgaaggggagcaggtacacccctcgactcggaccgatg

SEQ ID NO: 1938 - DNA, 203 bp, Homo sapiens
ggcgcgccagtcctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgcgactcggaccgatg

SEQ ID NO: 1939 - DNA, 203 bp, Homo sapiens
ggcgcgccagtcctggcctccttttcccactgtgccagggaaggtaggtttctctggctgactgagtactgtgagtgaggcaacactgatgccagcatgggtcttacttgactggggagtaggctgagtgaggggtagggtggggtaggtggggagtagtgtggccagggaactggaatccctggtggcgactcggaccgatg

SEQ ID NO: 1940 - DNA, 203 bp, Homo sapiens
ggcgcgccagtcctatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtatcgactcggaccgatg

SEQ ID NO: 1941 - DNA, 203 bp, Homo sapiens
ggcgcgccagtcctcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccgactcggaccgatg

SEQ ID NO: 1942 - DNA, 203 bp, Homo sapiens
ggcgcgccagtcctagcccagtcgccgccgcccgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctcgactcggaccgatg

SEQ ID NO: 1943 - DNA, 203 bp, Homo sapiens
ggcgcgccagtcctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgccgactcggaccgatg

SEQ ID NO: 1944 - DNA, 203 bp, Homo sapiens
ggcgcgccagtcctagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcgactcggaccgatg

SEQ ID NO: 1945 - DNA, 203 bp, Homo sapiens
ggcgcgccagtcctcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagacgactcggaccgatg

SEQ ID NO: 1946 - DNA, 203 bp, Homo sapiens
ggcgcgccagtccttgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcacgactcggaccgatg

SEQ ID NO: 1947 - DNA, 203 bp, Homo sapiens
ggcgcgccagtcctccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggacgactcggaccgatg

SEQ ID NO: 1948 - DNA, 203 bp, Homo sapiens
ggcgcgccagtcctctgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtgcgactcggaccgatg

SEQ ID NO: 1949 - DNA, 203 bp, Homo sapiens
ggcgcgccagtcctggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcgactcggaccgatg

SEQ ID NO: 1950 - DNA, 203 bp, Homo sapiens
ggcgcgccagtcctccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctcgactcggaccgatg

SEQ ID NO: 1951 - DNA, 203 bp, Homo sapiens
ggcgcgccagtcctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatcgactcggaccgatg

SEQ ID NO: 1952 - DNA, 203 bp, Homo sapiens
ggcgcgccagtcctgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcggcgactcggaccgatg

SEQ ID NO: 1953 - DNA, 203 bp, Homo sapiens
ggcgcgccagtcctacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtcgactcggaccgatg

SEQ ID NO: 1954 - DNA, 203 bp, Homo sapiens
ggcgcgccagtcctaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaacgactcggaccgatg

SEQ ID NO: 1955 - DNA, 203 bp, Homo sapiens
ggcgcgccagtcctaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtcgactcggaccgatg

SEQ ID NO: 1956 - DNA, 203 bp, Homo sapiens
ggcgcgccagtcctctggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgactcggaccgatg

SEQ ID NO: 1957 - DNA, 203 bp, Homo sapiens
ggcgcgccagtcctctcactaattttcaggtgaccaaactttttgctgaagctgtgcagaaatctcgcaaggtggactccaagagtcttttccactacaggcagtacagtgctggaaaagcagcatagagatgcagacaccccagccccattattaaatcaacctgagccacatgttatctaaaggaacgactcggaccgatg

SEQ ID NO: 1958 - DNA, 203 bp, Homo sapiens
ggcgcgccagtcctttagagtatggacttttcttttctttttctttttctttttttctttttgagatggagtcacactctccaggctggagtgcagtggcacaatctcggctcactgcaatttccgtctcccaagttcaagcgattctcctgctttagactatggatttctttaaggaatactggtttcgactcggaccgatg

SEQ ID NO: 1959 - DNA, 203 bp, Homo sapiens
ggcgcgccagtccttgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtcgactcggaccgatg

SEQ ID NO: 1960 - DNA, 203 bp, Homo sapiens
ggcgcgccagtccttagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgccgactcggaccgatg

SEQ ID NO: 1961 - DNA, 203 bp, Homo sapiens
ggcgcgccagtccttgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttcgactcggaccgatg

SEQ ID NO: 1962 - DNA, 203 bp, Homo sapiens
ggcgcgccagtcctaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacacgactcggaccgatg

SEQ ID NO: 1963 - DNA, 203 bp, Homo sapiens
ggcgcgccagtcctacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcgactcggaccgatg

SEQ ID NO: 1964 - DNA, 203 bp, Homo sapiens
ggcgcgccagtcctggctaatccaggaatattgttatcccttcccattatattgaagttgagaaatgtgacagaggcatttagagtatggacttttcttttctttttctttttctttttttctttttgagatggagtcacactctccaggctggagtgcagtggcacaatctcggctcactgcaatttcgactcggaccgatg

SEQ ID NO: 1965 - DNA, 203 bp, Homo sapiens
ggcgcgccagtccttttgtcattcacactctcccccagttttggaataacttggaagtaaggttcattcccttaagacgatggattctgttgaactatggggtcccacactgcactattaattccacccactgtaagggcaaggacaccattccttctacatataagaaaaaagtctctccccaagggcgactcggaccgatg

SEQ ID NO: 1966 - DNA, 203 bp, Homo sapiens
ggcgcgccagtcctgattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctacgactcggaccgatg

SEQ ID NO: 1967 - DNA, 203 bp, Homo sapiens
ggcgcgccagtcctgggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggcgactcggaccgatg

SEQ ID NO: 1968 - DNA, 203 bp, Homo sapiens
ggcgcgccagtcctccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgactcggaccgatg

SEQ ID NO: 1969 - DNA, 203 bp, Homo sapiens
ggcgcgccagtcctcgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcccgactcggaccgatg

SEQ ID NO: 1970 - DNA, 203 bp, Homo sapiens
ggcgcgccagtcctggagcgggaggcggggccacttcaatcctgggcaggggcggttccgtacagggtataaaagctgtccgcgcgggagcccaggccagctttggggttgtccctggacttgtcttggttccagaacctgacgacccggcgacggcgacgtctcttttgactaaaagacagtgtccacgactcggaccgatg

SEQ ID NO: 1971 - DNA, 203 bp, Homo sapiens
ggcgcgccagtccttgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgctcgactcggaccgatg

SEQ ID NO: 1972 - DNA, 203 bp, Homo sapiens
ggcgcgccagtccttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggcgactcggaccgatg

SEQ ID NO: 1973 - DNA, 203 bp, Homo sapiens
ggcgcgccagtcctcgaatctcctggggccgtccgtgccggctcgggccgtcgtggcggctcgagctcctggaacttgctcaggctccggaggtccgaggccctcgaagttatgcgtcgcctccaggcggttgcggcgggcgcgggctcctaaagggcgtcacacccggactccgccgactaggcaaccgactcggaccgatg

SEQ ID NO: 1974 - DNA, 203 bp, Homo sapiens
ggcgcgccagtcctctccattcatctttccactgcgcctccggcgcccccgccttctccggtcccctcctcggagtcattttttcctgttccccctctgccgccctttcctcacgccccgggtgaggcaattctcttggaagcgaaggtgtcggctatgagccggagcctccttccttgaatttctcccgactcggaccgatg

SEQ ID NO: 1975 - DNA, 203 bp, Homo sapiens
ggcgcgccagtcctctcccctttccctttatgggcaactgttatggcgtgaatttttctatacagcagcaacaaataatccacgctttgataaaatggaaggaaaccctatctgtgttcagattccttgggataaaaatcctgaggctttagccaaatgggcggaaggccggacaggctttccatggacgactcggaccgatg

SEQ ID NO: 1976 - DNA, 203 bp, Homo sapiens
ggcgcgccagtcctttgatgccatcatgacacagcttcgtcaggagggttggattcatcatctagccaggcatgcagttgcttgcttcctgacacgaggggacctgtggattagttgggaagaaggaatgaaggtatttgaagaattattgcttgatgcagattggagcataaatgctggaagttggacgactcggaccgatg

SEQ ID NO: 1977 - DNA, 203 bp, Homo sapiens
ggcgcgccagtccttgggatattctgcagaaaatatcccaggttgtagcagcagtggaagttgctctcaagggagtggtattttacactatgctcatggcgacagtcagcaaactcacctgttgaagcaaggaagaagctccatgggcactggtctcagtggtgggaaacgtcctagtcaggaagaggcgactcggaccgatg

SEQ ID NO: 1978 - DNA, 203 bp, Homo sapiens
ggcgcgccagtccttctcttcttctttcgcggttcagcatgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaagggcgactcggaccgatg

SEQ ID NO: 1979 - DNA, 203 bp, Homo sapiens
ggcgcgccagtccttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcacgactcggaccgatg

SEQ ID NO: 1980 - DNA, 203 bp, Homo sapiens
ggcgcgccagtcctgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccggcgactcggaccgatg

SEQ ID NO: 1981 - DNA, 203 bp, Homo sapiens
ggcgcgccagtcctgcgaggagtgggtctgtgacgaggatagtatcaaggaccccatggaggaccaggacggcctccttggcaaggagctgggattcgatgcctccgaggtggagttgacgagaaacaatgaattgattgcagttggaaaaggcagctcactgaagcggctccctgtttttggaatggcgactcggaccgatg

SEQ ID NO: 1982 - DNA, 203 bp, Homo sapiens
ggcgcgccagtcctagcctcgcatcctatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggaccgactcggaccgatg

SEQ ID NO: 1983 - DNA, 203 bp, Homo sapiens
ggcgcgccagtcctagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggccgactcggaccgatg

SEQ ID NO: 1984 - DNA, 203 bp, Homo sapiens
ggcgcgccagtcctaggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggctctgtgtgctccgggatggagcaggtgtgcgactcggaccgatg

SEQ ID NO: 1985 - DNA, 203 bp, Homo sapiens
ggcgcgccagtcctcagagggtgagaacccagctctgggaccaagtcacttgcttccttacttagcaagactatcgacttgagcaaacttggacctgggatgaggatgtctgtgggcctctcgctgctgctgcccctctgggggaggacctttctcctcctgctctctgtggttatggctcagtcccacgactcggaccgatg

SEQ ID NO: 1986 - DNA, 203 bp, Homo sapiens
ggcgcgccagtcctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacccgactcggaccgatg

SEQ ID NO: 1987 - DNA, 203 bp, Homo sapiens
ggcgcgccagtcctaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaaccgactcggaccgatg

SEQ ID NO: 1988 - DNA, 203 bp, Homo sapiens
ggcgcgccagtcctccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtcgactcggaccgatg

SEQ ID NO: 1989 - DNA, 203 bp, Homo sapiens
ggcgcgccagtcctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgccgactcggaccgatg

SEQ ID NO: 1990 - DNA, 203 bp, Homo sapiens
ggcgcgccagtcctctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggacgactcggaccgatg

SEQ ID NO: 1991 - DNA, 203 bp, Homo sapiens
ggcgcgccagtcctttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcaccgactcggaccgatg

SEQ ID NO: 1992 - DNA, 203 bp, Homo sapiens
ggcgcgccagtcctgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccgactcggaccgatg

SEQ ID NO: 1993 - DNA, 203 bp, Homo sapiens
ggcgcgccagtcctaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtgcgactcggaccgatg

SEQ ID NO: 1994 - DNA, 203 bp, Homo sapiens
ggcgcgccagtcctgctcgcgcctcttaggcttggcggtggcggcggcggcagcttcgcgccgaatccccggggagcggcggtggcggcgtcctggggccaggaggagcgaacacctgccgcggtcctcccgccggcgctggggattctcattctgtctcccatgctggagtgcagtggcgcggtcttcgactcggaccgatg

SEQ ID NO: 1995 - DNA, 203 bp, Homo sapiens
ggcgcgccagtcctcaaacttggacctgggatgaggatgtctgtgggcctctcgctgctgctgcccctctgggggaggacctttctcctcctgctctctgtggttatggctcagtcccactggcccagtgaaccctcagaggctgtcagggactgggaaaaccagcttgaggcatccatgcactcagtcgactcggaccgatg

SEQ ID NO: 1996 - DNA, 203 bp, Homo sapiens
ggcgcgccagtcctgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggacgactcggaccgatg

SEQ ID NO: 1997 - DNA, 203 bp, Homo sapiens
ggcgcgccagtcctagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattcgactcggaccgatg

SEQ ID NO: 1998 - DNA, 203 bp, Homo sapiens
ggcgcgccagtcctaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccaccgactcggaccgatg

SEQ ID NO: 1999 - DNA, 203 bp, Homo sapiens
ggcgcgccagtcctatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagatcgactcggaccgatg

SEQ ID NO: 2000 - DNA, 203 bp, Homo sapiens
ggcgcgccagtccttcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtcgactcggaccgatg

SEQ ID NO: 2001 - DNA, 203 bp, Homo sapiens
ggcgcgccagtcctgatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtacgactcggaccgatg

SEQ ID NO: 2002 - DNA, 203 bp, Homo sapiens
ggcgcgccagtcctcttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtcgactcggaccgatg

SEQ ID NO: 2003 - DNA, 203 bp, Homo sapiens
ggcgcgccagtcctcaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccgactcggaccgatg

SEQ ID NO: 2004 - DNA, 203 bp, Homo sapiens
ggcgcgccagtcctcccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcgactcggaccgatg

SEQ ID NO: 2005 - DNA, 203 bp, Homo sapiens
ggcgcgccagtcctcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtcgactcggaccgatg

SEQ ID NO: 2006 - DNA, 203 bp, Homo sapiens
ggcgcgccagtcctgccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacgactcggaccgatg

SEQ ID NO: 2007 - DNA, 203 bp, Homo sapiens
ggcgcgccagtcctaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcgactcggaccgatg

SEQ ID NO: 2008 - DNA, 203 bp, Homo sapiens
ggcgcgccagtcctgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagcgactcggaccgatg

SEQ ID NO: 2009 - DNA, 203 bp, Homo sapiens
ggcgcgccagtcctagatgggggtgccgggaggagcggatgcagctggagcggctcccttggggtgccgagtggcaggtggggggcggtgagggtccttgagggcgggccttagagtcttcagaagggcaggactctgagggctttttggagctcgctatgcttaacctggagatgattaaggccccgcgactcggaccgatg

SEQ ID NO: 2010 - DNA, 203 bp, Homo sapiens
ggcgcgccagtcctctttttttgttcactgtgcagggattgttcattgctgctggaggaagatcatggactgtcgcgggaaactgaagtggttgagtatccactagtcgtggatgagggcagtgacttcgcagttttttgcgaattacacatctctttgattatgttgtgactagttttgttagatagcgactcggaccgatg

SEQ ID NO: 2011 - DNA, 203 bp, Homo sapiens
ggcgcgccagtccttcatttagtgtttgggatacctgttaagccctttgtccagggactgtggttggatttatgaattatttggacggttgtccacttgaaagaactgacagtagcttcataacaatgttacaaatctcgttctaagattaagctgttgaacctatatttgccattagcgcttaatttcgactcggaccgatg

SEQ ID NO: 2012 - DNA, 203 bp, Homo sapiens
ggcgcgccagtcctttgaagtattatttttatgaatcaagccctggaaaaggacaagatatttgaatgaaatagcacccataatggagaacttcacagttgctactcctgtgataggtttatcttagtttcattgtggtataaatggaatagcaggtgttgtcaggtacaaggtttgtagcttgccaacgactcggaccgatg

SEQ ID NO: 2013 - DNA, 203 bp, Homo sapiens
ggcgcgccagtcctctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaaatgatcccttattgatgacacagtattttacgactcggaccgatg

SEQ ID NO: 2014 - DNA, 203 bp, Homo sapiens
ggcgcgccagtccttgtctagtacacctgctccgaagtatttgaaaatattgccttctggtcttaagtataatgcaagacatccttctaccaaggtaatgaagcaaatggatataggtgtgtattttggactacctcccaaaagaaaggaagagaaattgctaggggaaagtgcattagaagggataacgactcggaccgatg

SEQ ID NO: 2015 - DNA, 203 bp, Homo sapiens
ggcgcgccagtccttcagagcagatcccagcatggaacgttctcttcttgcggaccagaaagtccatatgctgtacttagataccacatattgtagcccagaatacacctttccatctcagcaagaggttatccggtttgccatcaacactgcctttgaggctgtaactctaaacccacatgctcttgcgactcggaccgatg

SEQ ID NO: 2016 - DNA, 203 bp, Homo sapiens
ggcgcgccagtcctttgtctgtggcacttactctattggaaaagagaaagtcttcctagccattgctgatgttttaggttcaaaagtgggcatgtcccaggaaaaatataaaactctacagtgcctcaatataccagaaattaattcactcatcactaccgacatgtgcagttcattggttcaccttccgactcggaccgatg

SEQ ID NO: 2017 - DNA, 203 bp, Homo sapiens
ggcgcgccagtcctcttacagtgaacacagcagctacctagaaatgaagcgctttgtccagtggctgaagccccagaaaatcatacctactgtaaatgtgggcacctggaaatctaggagcacaatggagaaatattttagagagtggaaattggaagctggatattgatgatacctccgaggattcacgactcggaccgatg

SEQ ID NO: 2018 - DNA, 203 bp, Homo sapiens
ggcgcgccagtcctgattcgacacggcactggcagcgggaacttgttcccgccaagaccctaaagggattgttcattgctgctggaggaagatcatggactgtcgcgggaaactgaagtggttgagtatccactagtcgtggatgagggcagtgacttcgcagttttttgcgaattacacatctctttcgactcggaccgatg

SEQ ID NO: 2019 - DNA, 203 bp, Homo sapiens
ggcgcgccagtcctaatgataaaatcattttgccatgttagaagacatttccgaagaagacatttgggaatacaaatctaaaagaaaaccaaaacgagttgatccaaataatggctctaaaaatattctaaaatctgttgaaaaagcaacagatggaaaataccagtcaaaacggagtagaaacagaacgactcggaccgatg

SEQ ID NO: 2020 - DNA, 203 bp, Homo sapiens
ggcgcgccagtcctattacaagagatacactcacttcctgctagctcaaagcagggctggtgatcatccttttagcagcccatcacctgcgtcaggtggcagtttcagtgagactaagtcaggcgtcctttgtagccttgaggaaagatggtcttcgtatcagaaccaaactgataactcggtttcaacgactcggaccgatg

SEQ ID NO: 2021 - DNA, 203 bp, Homo sapiens
ggcgcgccagtcctcagtttattgtagtgagataactggcaatttgttgaagaacaagcttcatgtgcaagaacaatatattcacccattgccactggacactgaatgtattgtgaatggtgtcaaagttgttttgcttgatgccaatcactgtccaggtgctgtcatgatcctcttttatcttcctacgactcggaccgatg

SEQ ID NO: 2022 - DNA, 203 bp, Homo sapiens
ggcgcgccagtcctaatgcctctcagcatcatcaaggataactgaaactgggtctccctgggacccttaatttcttgtcccctgccctccatgggcagttatattctgcatcaagccttagaagaggaagcaaaggcagattcagggaccaaaaggattaatgataattaataaagtagtttgaagcacgactcggaccgatg

SEQ ID NO: 2023 - DNA, 203 bp, Homo sapiens
ggcgcgccagtcctatagagcggctcccagcgttccctgcggcgtaggaggcggtccagactataaaagcggctgccggaaagcggccggcacctcattcatttctaccggtctctagtagtgcagcttcggctggtgtcatcggtgtccttcctccgctgccgcccccgcaaggcttcgccgtcatccgactcggaccgatg

SEQ ID NO: 2024 - DNA, 203 bp, Homo sapiens
ggcgcgccagtccttggaaaccctggggagaaattagttaaaaagaagtggaatcttgatgagctgcctaaatttgagaagaatttttatcaagagcaccctgatttggctaggcgcacagcacaagaggtggaaacatacagaagaagcaaggaaattacagttagaggtcacaactgcccgaagcccgactcggaccgatg

SEQ ID NO: 2025 - DNA, 203 bp, Homo sapiens
ggcgcgccagtccttcctgccattgtccacatcaatcatcagccattcctagagagaggcgatgggcctatttgtttggtgctggcaccaactcgggaactggcccaacaggtgcagcaagtagctgctgaatattgtagagcatgtcgcttgaagtctacttgtatctacggtggtgctcctaagggcgactcggaccgatg

SEQ ID NO: 2026 - DNA, 203 bp, Homo sapiens
ggcgcgccagtcctaccacaaatacgtgatttggagagaggtgtggaaatctgtattgcaacacctggaagactgattgactttttagagtgtggaaaaaccaatctgagaagaacaacctaccttgtccttgatgaagcagatagaatgcttgatatgggctttgaaccccaaataaggaagattgtcgactcggaccgatg

SEQ ID NO: 2027 - DNA, 203 bp, Homo sapiens
ggcgcgccagtcctggatcaaataagacctgataggcaaactctaatgtggagtgcgacttggccaaaagaagtaagacagcttgctgaagatttcctgaaagactatattcatataaacattggtgcacttgaactgagtgcaaaccacaacattcttcagattgtggatgtgtgtcatgacgtagacgactcggaccgatg

SEQ ID NO: 2028 - DNA, 203 bp, Homo sapiens
ggcgcgccagtcctaaaggatgaaaaacttattcgtctaatggaagagatcatgagtgagaaggagaataaaaccattgtttttgtggaaaccaaaagaagatgtgatgagcttaccagaaaaatgaggagagatgggtggcctgccatgggtatccatggtgacaagagtcaacaagagcgtgactgcgactcggaccgatg

SEQ ID NO: 2029 - DNA, 203 bp, Homo sapiens
ggcgcgccagtcctggttctaaatgaattcaaacatggaaaagctcctattctgattgctacagatgtggcctccagagggctagatgtggaagatgtgaaatttgtcatcaattatgactaccctaactcctcagaggattatattcatcgaattggaagaactgctcgcagtaccaaaacaggcaccgactcggaccgatg

SEQ ID NO: 2030 - DNA, 203 bp, Homo sapiens
ggcgcgccagtccttttttttttgccagaagagaggtcttcaggagacttcatttaaattctgattattaaactgaggctttaattgatgttaatgccttatgtcaaatgtaaagttagaatttgctagggctgggatagggagtgatatttctaggacttagacattgaaaactaattcagcctgtacgactcggaccgatg

SEQ ID NO: 2031 - DNA, 203 bp, Homo sapiens
ggcgcgccagtccttgcccaaagtcttggaaacttgctggatatgatgtaccgggagccagcacgatggtcctacacattccagacattttcctttttgagccgcctgaaagtacagctggagcccttccctgagaaactcttacaggccaggaagccagtacagatctttgagaggtctgtgtacagcgactcggaccgatg

SEQ ID NO: 2032 - DNA, 203 bp, Homo sapiens
ggcgcgccagtccttcccaaccacctttccatccccagcccctctcatccctggagcactctgccgctcaagagctggtttgttaattattgttagactttgccattgttttcttttgtacctgaagcattttgaaaataaagtttacttaagttatgcttgtttttctaaaaaaaaaaaaaaaaaaacgactcggaccgatg

SEQ ID NO: 2033 - DNA, 203 bp, Homo sapiens
ggcgcgccagtcctgtactagcgtccctgacagcgcggaatctgggtgcagttcctgcagtaccccactctacgatcagggtggcccggtggaaatcctgccctttctgtacctgggcagtgcgtatcacgcttcccgcaaggacatgctggatgccttgggcatcactgccttgatcaacgtctcagcgactcggaccgatg

SEQ ID NO: 2034 - DNA, 203 bp, Homo sapiens
ggcgcgccagtcctccgccatggctgtgctcgaccgaggcacctccaccaccaccgtgttcaacttccccgtctccatccctgtccactccacgaacagtgcgctgagctaccttcagagccccattacgacctctcccagctgctgaaaggccacgggaggtgaggctcttcacatcccattgggaccgactcggaccgatg

SEQ ID NO: 2035 - DNA, 203 bp, Homo sapiens
ggcgcgccagtccttacctggaagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttccgactcggaccgatg

SEQ ID NO: 2036 - DNA, 203 bp, Homo sapiens
ggcgcgccagtccttgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatatcgactcggaccgatg

SEQ ID NO: 2037 - DNA, 203 bp, Homo sapiens
ggcgcgccagtcctagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaatcgactcggaccgatg

SEQ ID NO: 2038 - DNA, 203 bp, Homo sapiens
ggcgcgccagtcctctgaagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccgactcggaccgatg

SEQ ID NO: 2039 - DNA, 203 bp, Homo sapiens
ggcgcgccagtcctcctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttcgactcggaccgatg

SEQ ID NO: 2040 - DNA, 203 bp, Homo sapiens
ggcgcgccagtcctgagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatcgactcggaccgatg

SEQ ID NO: 2041 - DNA, 203 bp, Homo sapiens
ggcgcgccagtccttctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctcgactcggaccgatg

SEQ ID NO: 2042 - DNA, 203 bp, Homo sapiens
ggcgcgccagtcctcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggcgactcggaccgatg

SEQ ID NO: 2043 - DNA, 203 bp, Homo sapiens
ggcgcgccagtcctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcattcgactcggaccgatg

SEQ ID NO: 2044 - DNA, 203 bp, Homo sapiens
ggcgcgccagtcctgtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatcgactcggaccgatg

SEQ ID NO: 2045 - DNA, 203 bp, Homo sapiens
ggcgcgccagtcctggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgcgactcggaccgatg

SEQ ID NO: 2046 - DNA, 203 bp, Homo sapiens
ggcgcgccagtcctgctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgccgactcggaccgatg

SEQ ID NO: 2047 - DNA, 203 bp, Homo sapiens
ggcgcgccagtcctgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttgcgactcggaccgatg

SEQ ID NO: 2048 - DNA, 203 bp, Homo sapiens
ggcgcgccagtcctctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccccgactcggaccgatg

SEQ ID NO: 2049 - DNA, 203 bp, Homo sapiens
ggcgcgccagtccttccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgactcggaccgatg

SEQ ID NO: 2050 - DNA, 203 bp, Homo sapiens
ggcgcgccagtcctcgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgcgactcggaccgatg

SEQ ID NO: 2051 - DNA, 203 bp, Homo sapiens
ggcgcgccagtcctcagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctgggcgactcggaccgatg

SEQ ID NO: 2052 - DNA, 203 bp, Homo sapiens
ggcgcgccagtccttcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggcgactcggaccgatg

SEQ ID NO: 2053 - DNA, 203 bp, Homo sapiens
ggcgcgccagtccttctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgccgactcggaccgatg

SEQ ID NO: 2054 - DNA, 203 bp, Homo sapiens
ggcgcgccagtcctagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctcccccgactcggaccgatg

SEQ ID NO: 2055 - DNA, 203 bp, Homo sapiens
ggcgcgccagtcctagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccgactcggaccgatg

SEQ ID NO: 2056 - DNA, 203 bp, Homo sapiens
ggcgcgccagtcctcatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggcgactcggaccgatg

SEQ ID NO: 2057 - DNA, 203 bp, Homo sapiens
ggcgcgccagtcctaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccgactcggaccgatg

SEQ ID NO: 2058 - DNA, 203 bp, Homo sapiens
ggcgcgccagtcctcagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccgactcggaccgatg

SEQ ID NO: 2059 - DNA, 203 bp, Homo sapiens
ggcgcgccagtcctaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtcgactcggaccgatg

SEQ ID NO: 2060 - DNA, 203 bp, Homo sapiens
ggcgcgccagtccttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttgcgactcggaccgatg

SEQ ID NO: 2061 - DNA, 203 bp, Homo sapiens
ggcgcgccagtcctacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatcgactcggaccgatg

SEQ ID NO: 2062 - DNA, 203 bp, Homo sapiens
ggcgcgccagtcctagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgcgactcggaccgatg

SEQ ID NO: 2063 - DNA, 203 bp, Homo sapiens
ggcgcgccagtcctgagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatcgactcggaccgatg

SEQ ID NO: 2064 - DNA, 203 bp, Homo sapiens
ggcgcgccagtcctctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgtcgactcggaccgatg

SEQ ID NO: 2065 - DNA, 203 bp, Homo sapiens
ggcgcgccagtccttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctggcgactcggaccgatg

SEQ ID NO: 2066 - DNA, 203 bp, Homo sapiens
ggcgcgccagtccttccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggcgactcggaccgatg

SEQ ID NO: 2067 - DNA, 203 bp, Homo sapiens
ggcgcgccagtcctgcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgaccgactcggaccgatg

SEQ ID NO: 2068 - DNA, 203 bp, Homo sapiens
ggcgcgccagtcctgaacgagccaagtccttaatggatcagtactttgcccgaatgtgctccttgatgttaagtaaggaattgccagcaaggattcgtttcctgctgcaggataccgtagagttgcgagaacaccattgggttcctcgcaaggcttttcttgacaatggaccaaagacgatcaatcaacgactcggaccgatg

SEQ ID NO: 2069 - DNA, 203 bp, Homo sapiens
ggcgcgccagtcctattcgtcaagatgcagtaaaagatctaggggtgtttattcctgctcctatggctcaagggatgagaagtgacttctttctggagggaccgttcatgccacccaggatgaaaatggatagggacccacttggaggacttgctgatatgtttggacaaatgccaggtagcggaattcgactcggaccgatg

SEQ ID NO: 2070 - DNA, 203 bp, Homo sapiens
ggcgcgccagtcctccaccgtcaaaggaagaactccttaaactaactgaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaacgactcggaccgatg

SEQ ID NO: 2071 - DNA, 203 bp, Homo sapiens
ggcgcgccagtcctacttccctaacttgcgcctgggtgggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggcgactcggaccgatg

SEQ ID NO: 2072 - DNA, 203 bp, Homo sapiens
ggcgcgccagtcctaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatacgactcggaccgatg

SEQ ID NO: 2073 - DNA, 203 bp, Homo sapiens
ggcgcgccagtcctagcactagacgagatgacaactccgcagcaaacaactccgcaaacgaaaaagaacgacatgatgcaatcttcaggaaagtaagaggcatactaaataagcttactcctgaaaagtttgacaagctatgccttgagctcctcaatgtgggtgtagagtctaaactcatccttaaacgactcggaccgatg

SEQ ID NO: 2074 - DNA, 203 bp, Homo sapiens
ggcgcgccagtcctttacaagatgaatttgaaaaccgaactagaaatgttgatgtctatgataagcgtgaaaatcccctcctccccgaggaggaggaacagagagccattgctaagatcaagatgttgggaaacatcaaattcattggagagcttggcaagcttgatcttattcacgaatctatccttcgactcggaccgatg

SEQ ID NO: 2075 - DNA, 203 bp, Homo sapiens
ggcgcgccagtccttcaaatcaactcttcaatggccatgggggacacatcatgcctcccacacaatcgcagtttggagagatgggaggcaagtttatgaaaagccaggggctaagccagctctaccataaccagagtcagggactcttatcccagctgcaaggacagtcgaaggatatgccacctcggcgactcggaccgatg

SEQ ID NO: 2076 - DNA, 203 bp, Homo sapiens
ggcgcgccagtcctgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaacgactcggaccgatg

SEQ ID NO: 2077 - DNA, 203 bp, Homo sapiens
ggcgcgccagtcctctactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttccgactcggaccgatg

SEQ ID NO: 2078 - DNA, 203 bp, Homo sapiens
ggcgcgccagtcctccctggactctctcaaaccccttatccctctggacagaatgcaggtccaaccacgctggtataccctcaaacccctcagacaatgaattcacaacctcaaacccgttctccgtttttccagaggcctcaaatacagcctcctagagctaccatcccgaacagcagtccttccatcgactcggaccgatg

SEQ ID NO: 2079 - DNA, 203 bp, Homo sapiens
ggcgcgccagtccttcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccaacaatatccagttcaacccgactcggaccgatg

SEQ ID NO: 2080 - DNA, 203 bp, Homo sapiens
ggcgcgccagtcctaaaccagggaggtaaagacataacagaggagattatgtctggaggtggcagcagaaatcctactccacccataggaagacccacgtccacacctactcctcctcagcagctgcccagccaggtccccgagcacagccctgtggtttatgggactgtggagagcgctcatcttgccgactcggaccgatg

SEQ ID NO: 2081 - DNA, 203 bp, Homo sapiens
ggcgcgccagtcctatcctggaagcctactgatactgaaggtaagaagcagtatgacagggagtttctgctggacttccagttcatgcctgcctgtatacaaaaaccagagggcctgcctcctatcagtgatgtggttcttgacaagatcaaccaacccaaattgccaatgcgaactctggatcctcgcgactcggaccgatg

SEQ ID NO: 2082 - DNA, 203 bp, Homo sapiens
ggcgcgccagtcctaattttgcctcgaggaccagactttacaccagcctttgctgattttggaaggcagacacctggtggaagaggcgtacctttgttgaatgttgggtcacgaagatctcaacctggccaaagaagagaacccagaaagatcatcacagtttctgtaaaagaagatgtacacctgaacgactcggaccgatg

SEQ ID NO: 2083 - DNA, 203 bp, Homo sapiens
ggcgcgccagtcctggagcggctgaaaggagttattgacctggtctttgagaaggctattgatgaacccagtttctctgtggcttacgcaaacatgtgtcgatgtctagtaacgctgaaagtacccatggcagacaagcctggtaacacagtgaatttccggaagctgctactgaaccgttgccagaacgactcggaccgatg

SEQ ID NO: 2084 - DNA, 203 bp, Homo sapiens
ggcgcgccagtcctactcaaaatgctgactgaagccatcatgcatgactgtgtggtgaagctgctaaagaaccatgatgaagaatccctggagtgcctgtgtcgcctgctcaccaccattggcaaagacttggactttgaaaaagcaaagccacgtatggaccagtactttaatcagatggagaaaatcgactcggaccgatg

SEQ ID NO: 2085 - DNA, 203 bp, Homo sapiens
ggcgcgccagtcctgggaaaaggcagcagtggtggagcaaaggcaagtgagactgatgccttacggtcaagtgcttccagtttaaacagattctctgccctgcaacctccagcaccctcagggtccacgccatccacgcctgtagagtttgattcccgaaggaccttaactagtcgtggaagtatgggcgactcggaccgatg

SEQ ID NO: 2086 - DNA, 203 bp, Homo sapiens
ggcgcgccagtcctcagggagaagaatgacaagccccttccatctgcaacagctcggccaaatactttcatgaggggtggcagcagtaaagacctgctagacaatcagtctcaagaagagcagcggagagagatgctggagaccgtgaagcagctcacaggaggtgtggatgtggagaggaacagcaccgactcggaccgatg

SEQ ID NO: 2087 - DNA, 203 bp, Homo sapiens
ggcgcgccagtcctgaatgcccagggcctactacatgtttttgtgagagtgggagtggagtccaccctggaaaggagccagatcaccagggatcacatgggccaattactctatcagctggtacagtcagaaaaactcagcaaacaggactttttcaaaggtttttcagaaactttggaattggcagacgactcggaccgatg

SEQ ID NO: 2088 - DNA, 203 bp, Homo sapiens
ggcgcgccagtccttgacatggccattgatattccccatatttggttgtaccttgctgaactggtgacccccatgttaaaagaaggtggaatctccatgagagaacttaccatagaatttagcaaacctttacttcctgttggaagagctggggtcttgctatctgaaatattgcacctactatgcaacgactcggaccgatg

SEQ ID NO: 2089 - DNA, 203 bp, Homo sapiens
ggcgcgccagtcctcaatttaagtatttttttaaaaagtttcacgtcttcgccaatcacagtgcagcaaggccaattctcgcagaaacccccacgtgtgcacgagtgggagaggggaaagagaaaaaaaggtgatcatggaggaaaaaggtactggataaaagtaaacttcaaaccttagggcgggagcgactcggaccgatg

SEQ ID NO: 2090 - DNA, 203 bp, Homo sapiens
ggcgcgccagtcctacaaattcctagaggacctgtgcaacaacctcttgaggatcgaatcttcactcccgctgtctcagcagtctacagcacggtaacacaagtggcaagacagccgggaacccctaccccatccccttattcagcacatgaaataaacaaggggcatccaaatcttgcggcaacgcccgactcggaccgatg

SEQ ID NO: 2091 - DNA, 203 bp, Homo sapiens
ggcgcgccagtcctgaacagcagtccttccattcgtcctggtgcacagacacccactgcagtgtaccaggctaatcagcacatcatgatggttaaccatctgcccatgccgtacccagtgccccaggggcctcagtactgtataccacagtaccgtcatagtggccctccttatgttgggcccccccacgactcggaccgatg

SEQ ID NO: 2092 - DNA, 203 bp, Homo sapiens
ggcgcgccagtcctacaatatccagttcaaccaccggggccaggtcctttttatcctggaccaggacctggggacttccccaatgcttatggaacgcctttttacccaagtcagccggtgtatcagtcagcacctatcatagtgcctacgcagcaacagccgcctccagccaagagagagaaaaaaaccgactcggaccgatg

SEQ ID NO: 2093 - DNA, 203 bp, Homo sapiens
ggcgcgccagtcctgagcgctcatcttgctgccagcacccctgtcactgcagctagcgaccagaagcaagaggagaagccaaaaccagatccagtgttaaagtctccttccccagtccttaggctagtcctcagtggagagaagaaagaacaagaaggccagacatctgaaactactgcaatagtatccgactcggaccgatg

SEQ ID NO: 2094 - DNA, 203 bp, Homo sapiens
ggcgcgccagtcctcatagcagagcttcctctgcctccatcacctaccactgtttcttctgttgctcgaagtacaattgcagcccccacctcttctgctcttagtagccaaccaatattcaccactgctatagatgacagatgtgaactctcatccccaagagaagacacaattcctatacccagcctcgactcggaccgatg

SEQ ID NO: 2095 - DNA, 203 bp, Homo sapiens
ggcgcgccagtcctaactctggatcctcgaattttgcctcgaggaccagactttacaccagcctttgctgattttggaaggcagacacctggtggaagaggcgtacctatttgcaaagtgcagagcaggcatggattgccaattctggaacagagcaaagccccaacttgccctccactggtgatgtccgactcggaccgatg

SEQ ID NO: 2096 - DNA, 203 bp, Homo sapiens
ggcgcgccagtcctacacccacccatgaagagcctgcctctagggttgttgaatgttgggtcacgaagatctcaacctggccaaagaagagaacccagaaagatcatcacagtttctgtaaaagaagatgtacacctgaaaaaggcagaaaatgcctggaagccaagccaaaaacgagacagccaagccgactcggaccgatg

SEQ ID NO: 2097 - DNA, 203 bp, Homo sapiens
ggcgcgccagtcctgaaagaacttgaggctgccagtgctccagaggagaggacaaggcttcatgatgaactggaagaagccaaggacaaagcccggcggagatccattggcaacatcaagtttattggagaactctttaaactcaaaatgctgactgaagccatcatgcatgactgtgtggtgaagctcgactcggaccgatg

SEQ ID NO: 2098 - DNA, 203 bp, Homo sapiens
ggcgcgccagtccttgttatagacctaaggctgtgcaattgggtatctcgaagagcagatcaagggcctaaaactatcgaacagattcacaaagaggctaaaatagaagaacaagaagagcaaaggaaggtccagcaactcatgaccaaagagaagagaagaccaggtgtccagagagtggacgaaggcgactcggaccgatg

SEQ ID NO: 2099 - DNA, 203 bp, Homo sapiens
ggcgcgccagtcctacggtcaagtgcttccagtttaaacagattctctgccctgcaacctccagcaccctcagggtccacgccatccacgcctgtagagtttgattcccgaaggaccttaactagtcgtggaagtatgggcagggagaagaatgacaagccccttccatctgcaacagctcggccaaacgactcggaccgatg

SEQ ID NO: 2100 - DNA, 203 bp, Homo sapiens
ggcgcgccagtccttactttcatgaggggtggcagcagtaaagacctgctagacaatcagtctcaagaagagcagcggagagagatgctggagaccgtgaagcagctcacaggaggtgtggatgtggagaggaacagcactgaggctgagcgaaataaaacaagggagtcagcaaaaccagaaatttccgactcggaccgatg

SEQ ID NO: 2101 - DNA, 203 bp, Homo sapiens
ggcgcgccagtcctcaagtacctagactcagatacagagaaggaactgcaagcactttatgcactacaagcatcgatagtaaaacttgatcaacctgccaatttgctgcggatgttttttgattgtctatatgacgaggaggtgatctccgaggatgccttctacaaatgggagagcagcaaggaccccgactcggaccgatg

SEQ ID NO: 2102 - DNA, 203 bp, Homo sapiens
ggcgcgccagtcctgcagcaaggccaattctcgcagaaacccccacgtgtgcacgagtgggagaggggaaagagaaaaaaaggtgatcatggaggaaaaaggtactggataaaagtaaacttcaaaccttagggcgggagcactaaaaccaaaatacatgtattatttatagaaaatattttctgtttcgactcggaccgatg

SEQ ID NO: 2103 - DNA, 203 bp, Homo sapiens
ggcgcgccagtcctttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccgactcggaccgatg

SEQ ID NO: 2104 - DNA, 203 bp, Homo sapiens
ggcgcgccagtcctagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgccgactcggaccgatg

SEQ ID NO: 2105 - DNA, 203 bp, Homo sapiens
ggcgcgccagtccttaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcacgactcggaccgatg

SEQ ID NO: 2106 - DNA, 203 bp, Homo sapiens
ggcgcgccagtcctgagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcgactcggaccgatg

SEQ ID NO: 2107 - DNA, 203 bp, Homo sapiens
ggcgcgccagtcctaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatcgactcggaccgatg

SEQ ID NO: 2108 - DNA, 203 bp, Homo sapiens
ggcgcgccagtccttctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtaccgactcggaccgatg

SEQ ID NO: 2109 - DNA, 203 bp, Homo sapiens
ggcgcgccagtcctgagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactcgactcggaccgatg

SEQ ID NO: 2110 - DNA, 203 bp, Homo sapiens
ggcgcgccagtcctggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggaccgactcggaccgatg

SEQ ID NO: 2111 - DNA, 203 bp, Homo sapiens
ggcgcgccagtccttgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaacgactcggaccgatg

SEQ ID NO: 2112 - DNA, 203 bp, Homo sapiens
ggcgcgccagtcctctatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcccgactcggaccgatg

SEQ ID NO: 2113 - DNA, 203 bp, Homo sapiens
ggcgcgccagtccttcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtacgactcggaccgatg

SEQ ID NO: 2114 - DNA, 203 bp, Homo sapiens
ggcgcgccagtcctcggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatcgactcggaccgatg

SEQ ID NO: 2115 - DNA, 203 bp, Homo sapiens
ggcgcgccagtccttgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagccgactcggaccgatg

SEQ ID NO: 2116 - DNA, 203 bp, Homo sapiens
ggcgcgccagtccttaattcccgactatgtgctgggccagagcacctgtgccctgttcctcagcctccgctaccacaacctgcacccagactacatccatgggcggctgcagagcctggggaagaacttcgccttgcgggtcctgcttgtccaggtggatgtgaaagatccccagcaggccctcaaggcgactcggaccgatg

SEQ ID NO: 2117 - DNA, 203 bp, Homo sapiens
ggcgcgccagtcctagctggctaagatgtgtatcctggccgactgcacattgatcctcgcctggagccccgaggaagctgggcggtacctggagacctacaaggcctatgagcagaaaccagcggacctcctgatggagaagctagagcaggacttcgtctcccggtctctggaacagctcatcgccgcgactcggaccgatg

SEQ ID NO: 2118 - DNA, 203 bp, Homo sapiens
ggcgcgccagtcctcatcaagagaagatctggccttatgcccaggcctgggccctcagaaagcccggaggctgtttgatgtcctgcacgagcccttcttgaaagtaccctgatgaccccagctgccaaggaaacccccagtgtaataataaatcgtcctcccaggccaggctcctgctggctgcgctgcgactcggaccgatg

SEQ ID NO: 2119 - DNA, 203 bp, Homo sapiens
ggcgcgccagtcctgtggcggccctggcatctcctcttggggcactgtctctggcatccggctttcctgactctgcttcttcctcttcttggtggatcccggagttgccctggcttcaggctgtccctcccctggcagttcaggctctagtggctgaattggctcagtcactgtgtgacctctctcttcgactcggaccgatg

SEQ ID NO: 2120 - DNA, 203 bp, Homo sapiens
ggcgcgccagtcctctggctgttgaggcgccatggtcccccctggggactccagaggcttcatctccggctccactggctccatcgcctccgtccctggctccatcattgccatctgtcccttttcttttttcctcttcttcgtagggggcagagggatggcttcctccagtggctccaccttcacctcgactcggaccgatg

SEQ ID NO: 2121 - DNA, 203 bp, Homo sapiens
ggcgcgccagtcctgtggctgagactcaactgtcaccccctcctctggctccatcccttccgtccccttttgcctctttctctttttggtcggggacaggactgtgtcttctagaggctcagtgttaatctgttcctgcttcactgtcttgtcttctggctcgaaggtttctttccctttgggcttctcgactcggaccgatg

SEQ ID NO: 2122 - DNA, 203 bp, Homo sapiens
ggcgcgccagtccttcctcttcttggtggtggacgggaacagcactcccagaggctccagtgtctccactgtgggctctgtccccacaggccctgctgcctctggttctttcagctgctgattttttttcttcttcttcttccgcacatccatttctggcgaccccaaagccatgtccacctccagggcgactcggaccgatg

SEQ ID NO: 2123 - DNA, 203 bp, Homo sapiens
ggcgcgccagtcctccccgtgcccattcactgcctcctgagtgactggggcctctgtcacctgcatctcctttttcttcttccctgaggtgagcaggttgggggccaaggctgacctaggccctgtgactggtgggttgcccccaaaggcacagaaccgaggcctcaggccaggagggatctgtggtgcgactcggaccgatg

SEQ ID NO: 2124 - DNA, 203 bp, Homo sapiens
ggcgcgccagtcctggggacttgctgggatgggctgcagagggctccctgacagggattgctggggaccctcaaggatccttagggtgccctggggggctgaggcacaggtgagtccacctcctgcctccgttgagggggccagcagggtcgcttctccagcttggggacagctgctgaggactcgatcgactcggaccgatg

SEQ ID NO: 2125 - DNA, 203 bp, Homo sapiens
ggcgcgccagtcctgcctaggctggagtgcagtggcatgatctcggctcactgcaatgtccacctcctgggttcaagcgattctcctgcctcagcctctcaagtagctgggattacaggcacctgccaccacgcccagccaatttttgtatttttagtagagacaatttcactatgttggccaggctgcgactcggaccgatg

SEQ ID NO: 2126 - DNA, 203 bp, Homo sapiens
ggcgcgccagtcctgagccgaaggtggaggtcaaaggggcgtggcgttacagagcctctagcgctgggtgttggggacctgacgctatggagctctcggagttttgtgggggacggctgtgagtggggggttcctgctgcgggatgagaacgtagacgccagtggctcactcgctcctggcaccttcccgactcggaccgatg

SEQ ID NO: 2127 - DNA, 203 bp, Homo sapiens
ggcgcgccagtcctaggcggcccctcagacctacgccgaatatgccatctcacagcctctggaaggggctggggccacgtgccccacagggtcagagcccctggcaggagagacgcccaaccaggccctgaaacccggggcaaaatccaacagcatcattgtgagccctcggcagaggggcaatcccgcgactcggaccgatg

SEQ ID NO: 2128 - DNA, 203 bp, Homo sapiens
ggcgcgccagtcctagcaggacttcgtctcccgggtgactgaatgtctgaccaccgtgaagtcagtcaacaaaacggacagtcagaccctcctgaccacatttggatctctggaacagctcatcgccgcatcaagagaagatctggccttatgcccaggcctgggccctcagaaagtaagagctctggcgactcggaccgatg

SEQ ID NO: 2129 - DNA, 203 bp, Homo sapiens
ggcgcgccagtcctgcaggtgctgacaatactgctgccttacccgccatacattaaggagcagggtcctggtcctaaagagttattcaaatgaaggtggttcgacgccccgaacctcacctgacctcaactaacccttaaaaatgcacacctcatgagtctacctgagcattcaggcagcactgacaacgactcggaccgatg

SEQ ID NO: 2130 - DNA, 203 bp, Homo sapiens
ggcgcgccagtcctaacttgacccaggtggctagcaaattagaaacaccattcatctctaacatatgatactgatgccatgtaaaggcctttaataagtcattgaaatttactgtgagactgtatgttttaattgcatttaaaaatatatagcttgaaagcagttaaactgattagtattcaggcactcgactcggaccgatg

SEQ ID NO: 2131 - DNA, 203 bp, Homo sapiens
ggcgcgccagtcctcttagaaggaagaggttggtagttccctgctctgttttgaacatgctctagtttattaacctggggacattcccattgctgtcttaagtaagtctcatagccagctcctgtcacgtgactctcatatggattcattttcgggccagctctgaacaaagcatcatgaacatatgtcgactcggaccgatg

SEQ ID NO: 2132 - DNA, 203 bp, Homo sapiens
ggcgcgccagtcctccatgcaaaagtggggctaaatgaagtgtgttaaggggtcggctaagtgggacattagtaactgcacactatttccctctactgagtaaaccctatctgtgattcccccaaacatctggcatggctcccttttgtccttcctgtgccctgcaaatattagcaaagaagcttcatcgactcggaccgatg

SEQ ID NO: 2133 - DNA, 203 bp, Homo sapiens
ggcgcgccagtcctgccaggttaggaaggcagcattccatgaccagaaacagggacaaagaaatccccccttcagaacagaggcatttaaaatggaaaagagagattggattttggtgggtaacttagaaggatggcatctccatgtagaataaatgaagaaagggaggcccagccgcaggaaggcagcgactcggaccgatg

SEQ ID NO: 2134 - DNA, 203 bp, Homo sapiens
ggcgcgccagtcctttgaatggagattctgattcagtgggttgggggcagagtttctgcagttccatcaggtcccccccaggtgcaggtgctgacaatactgctgccttacccgccatacattaaggagcagggtcctggtcctaaagagttattcaaatgaaggtggttcgacgccccgaacctcaccgactcggaccgatg

SEQ ID NO: 2135 - DNA, 203 bp, Homo sapiens
ggcgcgccagtcctctgacctcaactaacccttaaaaatgcacacctcatgagtctacctgagcattcaggcagcactgacaatagttatgcctgtactaaggagcatgattttaagaggctttggcccaatgcctataaaatgcccatttcgaagatatacaaaaacatacttcaaaaatgttaaaccgactcggaccgatg

SEQ ID NO: 2136 - DNA, 203 bp, Homo sapiens
ggcgcgccagtcctagtgcaattgaagaattgacctaagtaagctgacattatggttaataatagtattttagatttgtgcagcaaaataatttcataacttttttgtttttgttacttggataagatcaatctgttttattttagtaaatctttgcaggcaagttagagaaaatgcagtgtggcttacgactcggaccgatg

SEQ ID NO: 2137 - DNA, 203 bp, Homo sapiens
ggcgcgccagtccttgatgaaagatgctgtggattcaattctttcagtcaagaataaacacagactttgtaggttcctgctgaataaagcaaatcccagaaacccagattttggaagaatcagcaaccccagcataaaataaacccctatcaaaatgtcagaggacatggcaaggtaaacttagcattcgactcggaccgatg

SEQ ID NO: 2138 - DNA, 203 bp, Homo sapiens
ggcgcgccagtccttgtccaagagcacgcagtttgagtacgcctggtgcctggtgcggagcaagtacaatgatgacatccgtaaaggcatcgtgctgctcgaggagctgctgcccaaagggagcaaggaggaacagcgggattacgtcttctacctggccgtggggaactaccggctcaaggaatacgcgactcggaccgatg

SEQ ID NO: 2139 - DNA, 203 bp, Homo sapiens
ggcgcgccagtcctctgtgtccaagtccaaatcctgaaggagacgcgggagcccacggagaacgctccaggagggcctgtccatcctcgctgtcctttccctgttctccccctgccccccgtctctatcctctgtggccttcagctaatttctgctcccctgagattcgtccttcagccccatcatgtcgactcggaccgatg

SEQ ID NO: 2140 - DNA, 203 bp, Homo sapiens
ggcgcgccagtcctgcagattccatttcatgatgtcagattcccacctcctgtaggttataataaagatataaatgaaagtgatgaagttgaggtgtattccagagcaaatgaaaaagagccttgctgttggtggttagctaaagtgaggatgataaagggtgagttttatgtgatagaatatgcagccgactcggaccgatg

SEQ ID NO: 2141 - DNA, 203 bp, Homo sapiens
ggcgcgccagtcctggaaattatgccaccaaattcccttccttccaataattcaagggttggacctaatgccccagaagaaaaaaaacatttagatataaaggaaaacagcacccatttttctcaacctaacagtacaaaagtccagagggtgttagtggcttcatcagttgtagcaggggaatcccacgactcggaccgatg

SEQ ID NO: 2142 - DNA, 203 bp, Homo sapiens
ggcgcgccagtcctcgtggatggtcagcaaccactcgtgaatggagtaccctaaactgcataattctgaagttatatttcctataccatttccgtaattcttattccatattagaaaactttgttaggccaaagacaaatagtaggcaagatggcacagggcatgaaatgaacacaaattatgctaagcgactcggaccgatg

SEQ ID NO: 2143 - DNA, 203 bp, Homo sapiens
ggcgcgccagtcctaattttttattttttggtattggccataagcaacaattttcagatttgcacaaaaagataccttaaaatttgaaacattgcttttaaaactacttagcacttcagggcagattttagttttattttctaaagtactgagcagtgatattctttgttaatttggaccattttcctcgactcggaccgatg

SEQ ID NO: 2144 - DNA, 203 bp, Homo sapiens
ggcgcgccagtcctgcattgggtgatcattcaccagtacattctcagtttttcttaatatatagcatttatggtaatcatattagacttctgttttcaatctcgtatagaagtcttcatgaaatgctatgtcatttcatgtcctgtgtcagtttatgttttggtccacttttccagtattttagtggacgactcggaccgatg

SEQ ID NO: 2145 - DNA, 203 bp, Homo sapiens
ggcgcgccagtccttttttttctttttttcttttgttttttgaagtgttggggtttggttttgttttttgagtcttttttttttaagtgaaatttattgaggaaaaatatgtgaaggaccttcactctaagatgttatatttttcttaaaaagtaactcctagtaggggtaccactgaatctgtacagcgactcggaccgatg

SEQ ID NO: 2146 - DNA, 203 bp, Homo sapiens
ggcgcgccagtccttgatttctagttatttattctgggaatgtatagtatttgaaaacagaaattggtaccttgcacacatcatctgtaagctgtttggttttaaaatactgtagataattaaccaaggtagaatgaccttgtaatgtaactgctcttgggcaatattctctgtacatattagcgacacgactcggaccgatg

SEQ ID NO: 2147 - DNA, 203 bp, Homo sapiens
ggcgcgccagtcctagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttacgactcggaccgatg

SEQ ID NO: 2148 - DNA, 203 bp, Homo sapiens
ggcgcgccagtcctactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagcgactcggaccgatg

SEQ ID NO: 2149 - DNA, 203 bp, Homo sapiens
ggcgcgccagtccttggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacgactcggaccgatg

SEQ ID NO: 2150 - DNA, 203 bp, Homo sapiens
ggcgcgccagtcctgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtccgactcggaccgatg

SEQ ID NO: 2151 - DNA, 203 bp, Homo sapiens
ggcgcgccagtcctacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtccgactcggaccgatg

SEQ ID NO: 2152 - DNA, 203 bp, Homo sapiens
ggcgcgccagtcctggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcgactcggaccgatg

SEQ ID NO: 2153 - DNA, 203 bp, Homo sapiens
ggcgcgccagtcctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctcgactcggaccgatg

SEQ ID NO: 2154 - DNA, 203 bp, Homo sapiens
ggcgcgccagtcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacgactcggaccgatg

SEQ ID NO: 2155 - DNA, 203 bp, Homo sapiens
ggcgcgccagtcctcttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttccgactcggaccgatg

SEQ ID NO: 2156 - DNA, 203 bp, Homo sapiens
ggcgcgccagtcctctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagcgactcggaccgatg

SEQ ID NO: 2157 - DNA, 203 bp, Homo sapiens
ggcgcgccagtcctggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaacgactcggaccgatg

SEQ ID NO: 2158 - DNA, 203 bp, Homo sapiens
ggcgcgccagtcctaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagcgactcggaccgatg

SEQ ID NO: 2159 - DNA, 203 bp, Homo sapiens
ggcgcgccagtcctgtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcgactcggaccgatg

SEQ ID NO: 2160 - DNA, 203 bp, Homo sapiens
ggcgcgccagtccttgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactgcgactcggaccgatg

SEQ ID NO: 2161 - DNA, 203 bp, Homo sapiens
ggcgcgccagtcctgctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcgactcggaccgatg

SEQ ID NO: 2162 - DNA, 203 bp, Homo sapiens
ggcgcgccagtcctctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcacgactcggaccgatg

SEQ ID NO: 2163 - DNA, 203 bp, Homo sapiens
ggcgcgccagtcctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagcgactcggaccgatg

SEQ ID NO: 2164 - DNA, 203 bp, Homo sapiens
ggcgcgccagtcctccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacccgactcggaccgatg

SEQ ID NO: 2165 - DNA, 203 bp, Homo sapiens
ggcgcgccagtccttgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaacgactcggaccgatg

SEQ ID NO: 2166 - DNA, 203 bp, Homo sapiens
ggcgcgccagtcctaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggcgactcggaccgatg

SEQ ID NO: 2167 - DNA, 203 bp, Homo sapiens
ggcgcgccagtcctaaatccaaattggtcacatccccagggaagatgtagactatcacctgtacccacagggtccgggactcaatccaaatgcctctacaggacaagaagctctctctcagacaaccatctcatgggccccattccaggacacttctgagtacatcatttcatgtcatcctgttggcacgactcggaccgatg

SEQ ID NO: 2168 - DNA, 203 bp, Homo sapiens
ggcgcgccagtcctctgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgacgactcggaccgatg

SEQ ID NO: 2169 - DNA, 203 bp, Homo sapiens
ggcgcgccagtcctagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcacgactcggaccgatg

SEQ ID NO: 2170 - DNA, 203 bp, Homo sapiens
ggcgcgccagtcctaaatcagttgctacaaaaactgattggtttttgtcacttcatctcttcactaatggagatagctttacactttctgctttaatagatttaagtggaccccaatatttattaaaattgctagtttaccgttcagaagtataatagaaataatctttagttgctcttttctaaccacgactcggaccgatg

SEQ ID NO: 2171 - DNA, 203 bp, Homo sapiens
ggcgcgccagtcctataagagaccacaagcgacccgcagggccagacgttcttcgccgagagtcgtcggggtttcctgcttcaacagtgcttggacggaacccggcgctcgttccccaccccggccggccgcccatagccagccctccgtcacctcttcaccgcaccctcggactgccccaaggcccccgactcggaccgatg

SEQ ID NO: 2172 - DNA, 203 bp, Homo sapiens
ggcgcgccagtcctcgccgccgctccagcgccgcgcagccaccgccgccgccgccgcctctccttagtcgccgccatgacgaccgcgtccacctcgcaggtgcgccagaactaccaccaggactcagaggccgccatcaaccgccagatcaacctggagctctacgcctcctacgtttacctgtccatcgactcggaccgatg

SEQ ID NO: 2173 - DNA, 203 bp, Homo sapiens
ggcgcgccagtcctcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccgactcggaccgatg

SEQ ID NO: 2174 - DNA, 203 bp, Homo sapiens
ggcgcgccagtcctcaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttacctcgactcggaccgatg

SEQ ID NO: 2175 - DNA, 203 bp, Homo sapiens
ggcgcgccagtcctcaaaaagaaacgagtatttgtatttattaaactcattagtttgggcagtatactaaggtgtggctgtcttggattcagatagaactaagggttcccgactctgaatccagagtctgagttaaatgtttccaatggttcagtctagctttcacagtttttatgaataaaaggcatcgactcggaccgatg

SEQ ID NO: 2176 - DNA, 203 bp, Homo sapiens
ggcgcgccagtcctggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatcgactcggaccgatg

SEQ ID NO: 2177 - DNA, 203 bp, Homo sapiens
ggcgcgccagtcctcgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctcgactcggaccgatg

SEQ ID NO: 2178 - DNA, 203 bp, Homo sapiens
ggcgcgccagtcctttcaagtgttccacaagtatgttctctactgaagagttgctgcatccttgaatcttgggtgatttgaggcacagaaactatgactttattttttgagatggagttttgctcttgttgcccaggctggagtgcaatggcacgtttttcggcttaccgcaactgccgcctcctgggcgactcggaccgatg

SEQ ID NO: 2179 - DNA, 203 bp, Homo sapiens
ggcgcgccagtcctgttagccctttcagcttttttccccatcttgtgccgggccttcctgggtttcagtacttggatgtagggctgcagttatgtcagtggtgggtagattgaccaggaattaaggtctagggtccagcccatgtgagacttgactcactgatctacctttaggcatgtcttccttcccgactcggaccgatg

SEQ ID NO: 2180 - DNA, 203 bp, Homo sapiens
ggcgcgccagtcctagtctcatcctttttaaattttttttttttttttgagacggtctcactctcacccaggctggattgcagtggtgtgatctcgaccaactgcaacctctgcctcccacccgcaagctatctgcccacctcagcctctggagtagctgggacgggactacaggcacctgccaccatcgactcggaccgatg

SEQ ID NO: 2181 - DNA, 203 bp, Homo sapiens
ggcgcgccagtcctcgaggggcggccggagagcgccagggcctgagctgccggagcggcgcctgtgagtgagtgcagaaagcaggcgcccgcgcgctagccgtggcaggagcagcccgcacgccgcgctctctccctgggcgacctgcagtttgcaatatgactttggaggaattctcggctggagagcgactcggaccgatg

SEQ ID NO: 2182 - DNA, 203 bp, Homo sapiens
ggcgcgccagtcctgtgacgaatccacattcatctcaatggaaggatcctgccttaagtcaacttatttgtttttgccgggaaagtcgctacatggatcaatgggttccagtgattaatctccctgaacggtgatggcatctgaatgaaaataactgaaccaaattgcactgaagtttttgaaatacccgactcggaccgatg

SEQ ID NO: 2183 - DNA, 203 bp, Homo sapiens
ggcgcgccagtcctaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagcccgactcggaccgatg

SEQ ID NO: 2184 - DNA, 203 bp, Homo sapiens
ggcgcgccagtcctatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggcccgactcggaccgatg

SEQ ID NO: 2185 - DNA, 203 bp, Homo sapiens
ggcgcgccagtcctcactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagacgactcggaccgatg

SEQ ID NO: 2186 - DNA, 203 bp, Homo sapiens
ggcgcgccagtcctggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaacgactcggaccgatg

SEQ ID NO: 2187 - DNA, 203 bp, Homo sapiens
ggcgcgccagtcctgtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgagcgactcggaccgatg

SEQ ID NO: 2188 - DNA, 203 bp, Homo sapiens
ggcgcgccagtcctgctagctggcccgatttctcctccgggtgatgcttttcctagattattctctgatttggtcgtattgggcgcctggtcaccagggctgcttttaactctggtaaagtggatattgttgccatcaatgaccccttcattgacctcaactacatggtttacatgttccaatatgatcgactcggaccgatg

SEQ ID NO: 2189 - DNA, 203 bp, Homo sapiens
ggcgcgccagtccttccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctcgactcggaccgatg

SEQ ID NO: 2190 - DNA, 203 bp, Homo sapiens
ggcgcgccagtcctaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgcgactcggaccgatg

SEQ ID NO: 2191 - DNA, 203 bp, Homo sapiens
ggcgcgccagtcctaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtacgactcggaccgatg

SEQ ID NO: 2192 - DNA, 203 bp, Homo sapiens
ggcgcgccagtcctgcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtcgactcggaccgatg

SEQ ID NO: 2193 - DNA, 203 bp, Homo sapiens
ggcgcgccagtcctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaaccgactcggaccgatg

SEQ ID NO: 2194 - DNA, 203 bp, Homo sapiens
ggcgcgccagtccttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgccgactcggaccgatg

SEQ ID NO: 2195 - DNA, 203 bp, Homo sapiens
ggcgcgccagtccttgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgcgactcggaccgatg

SEQ ID NO: 2196 - DNA, 203 bp, Homo sapiens
ggcgcgccagtcctctcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtcgactcggaccgatg

SEQ ID NO: 2197 - DNA, 203 bp, Homo sapiens
ggcgcgccagtcctctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctcgactcggaccgatg

SEQ ID NO: 2198 - DNA, 203 bp, Homo sapiens
ggcgcgccagtcctctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagccgactcggaccgatg

SEQ ID NO: 2199 - DNA, 203 bp, Homo sapiens
ggcgcgccagtcctccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttacgactcggaccgatg

SEQ ID NO: 2200 - DNA, 203 bp, Homo sapiens
ggcgcgccagtcctccttccgttgagcctgtggaagaatatgattatgaagatctgaaagaatcttccaattctgtttcaaaccatcagctcagtggatttgatcaagctcgtctttattcatgccttgatcacatgagagaggtacttggagatgctgtgccagatgaaatattaattgaagcagttcgactcggaccgatg

SEQ ID NO: 2201 - DNA, 203 bp, Homo sapiens
ggcgcgccagtcctctgaagaacaagtttgatgtgcagaaggctttgtcaggggttctggaacaagatagagtgcagagtttgaaggacaagaatgaggcaacagtatctacaggaaagatagcaaaaggaaaaccagtagattcccagacatcgcgaagtgaatctgaaattgtgccaaaagttgctcgactcggaccgatg

SEQ ID NO: 2202 - DNA, 203 bp, Homo sapiens
ggcgcgccagtcctaaaatgactgtatctggaaagaagcaaactatgggatttgaagtgcctggagtatcttctgaagaaaatggtcatagtttccacacacctcaaaaaggaccgcccattgaagatgccattgcttcttccgatgttcttgagactgcttctaaatctgctaatccaccccacacgcgactcggaccgatg

SEQ ID NO: 2203 - DNA, 203 bp, Homo sapiens
ggcgcgccagtcctattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtcatgttgatgctgggaaaagtactctgatgggccatcgactcggaccgatg

SEQ ID NO: 2204 - DNA, 203 bp, Homo sapiens
ggcgcgccagtcctggttatatccaaactggtgaccgactactggcaatgcctcctaatgaaacttgtaccgtgaaaggaatcactctgcatgatgaacctgtcgactgggcggcagcaggcgatcatgttagtcttactttggttgggatggatatcatcaaaatcaatgttggctgcatattttgtcgactcggaccgatg

SEQ ID NO: 2205 - DNA, 203 bp, Homo sapiens
ggcgcgccagtcctgaggctggggtgggaagatcacttgagcccaggaggtcgaggctgcagtgagccatgatcacatcactgcagtccagcctgggtgacagagcaagacctgtcaccctgccacccataaaaaacctcttctgtaatgccaggttcttgacaagatgtgataattccacacttacacgactcggaccgatg

SEQ ID NO: 2206 - DNA, 203 bp, Homo sapiens
ggcgcgccagtccttcctcagatctcccatccagggcaaggacagactaaaagagcatatcttctccagaagtcctagaaacatctcatcattgactatgattgaattttatttattaatacttccctaggatatcctgtgtttgagtgtgaagttaatatcacacaaagcatgtagctaacagttgtcgactcggaccgatg

SEQ ID NO: 2207 - DNA, 203 bp, Homo sapiens
ggcgcgccagtcctattcattccttccttctccaatagtgtttaagtacaatctttttatttgcattttattgatgattgattgtggttgaaaggagtggtgatattatttcgaggatccactgtgtaagaagactgttggcagtggaaggctcgagttgattaagtgacaaagaggtaaagcagacacgactcggaccgatg

SEQ ID NO: 2208 - DNA, 203 bp, Homo sapiens
ggcgcgccagtcctaaaaaaaaaaaagcaaagaaactaagtctgtacagcaaaagatggaaaggaaacaagaaaattaaatgaagacaaaggttgtgattattacagtaaatgaaaataggtttttatctttaaaatgtagactcaaactgcaaagctaatgatatgctatctgcaaaatattcctatcgactcggaccgatg

SEQ ID NO: 2209 - DNA, 203 bp, Homo sapiens
ggcgcgccagtcctccttccatactggccatattttggaacactgacctagacatgtccagatgggagtcccattcctagcagacaagctgagcaccgttgtaaccagagaactattactaggccttgaagaacctgtctaactggatgctcattgcctgggcaaggcctgtttaggccggttgcggtcgactcggaccgatg

SEQ ID NO: 2210 - DNA, 203 bp, Homo sapiens
ggcgcgccagtcctggctcatgcctgtaatcctagcactttgggaggctgaggtgggtggatcacctgaggtcaggagttcgagaccagcctcgccaacatggcgaaaccccatctctactaaaaatacaaaagttagctgggtgtggtggcagaggcctgtaatcccagctccttgggaggctgaggcgactcggaccgatg

SEQ ID NO: 2211 - DNA, 203 bp, Homo sapiens
ggcgcgccagtcctccttaccccggggtctggtgtatgctgtgctttcctcagcagtatggctctgacatctcttagatgtcccaacttcagctgttgggagatggtgatattttcaaccctacttcctaaacatctgtctggggttcctttagtcttgaatgtcttatgctcaattatttggtgttgcgactcggaccgatg

SEQ ID NO: 2212 - DNA, 203 bp, Homo sapiens
ggcgcgccagtcctcttactagagagcccatcgcctgggacctcctggaccaccagaagccaactagccaacacagagcccaccaagggccttccagaccatccatccagaagcatgtgataagacctccttccatactggccatattttggaacactgacctagacatgtccagatgggagtcccatcgactcggaccgatg

SEQ ID NO: 2213 - DNA, 203 bp, Homo sapiens
ggcgcgccagtcctgggctgttgggagtgaggatggagtgttcagtgcccatttctcattttacattttaaagtcgttcctccaacatagtgtgtattggtctgaagggggtggtgggatgccaaagcctgctcaagttatggacattgtggccaccatgtggcttaaatgattttttctaactaatacgactcggaccgatg

SEQ ID NO: 2214 - DNA, 203 bp, Homo sapiens
ggcgcgccagtccttgcaagtgttttcgcccccatcagtgtcgtcgagtgccttctgcagtgcgaagaaactgaaaatagagccctctggctgggatgtttcaggacagagtagcaacgacaaatattatacccacagcaaaaccctcccagccacacaagggcaagccaactcctctcaccaggtagcgactcggaccgatg

SEQ ID NO: 2215 - DNA, 203 bp, Homo sapiens
ggcgcgccagtccttcttgcagcaggtggccacagccttgatgaagctcaagagtcttggtctgatccacgctgaccttaagcctgaaaacatcatgctggttgatccagttcgccagccctaccgagtgaaggtcattgactttggttctgctagtcacgtttccaaagctgtgtgctcaacctactcgactcggaccgatg

SEQ ID NO: 2216 - DNA, 203 bp, Homo sapiens
ggcgcgccagtcctcttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatgcgactcggaccgatg

SEQ ID NO: 2217 - DNA, 203 bp, Homo sapiens
ggcgcgccagtcctgcaccacatcttcttataattccttggtccctgtccaagatcagcatcagcccatcatcattccagatactcccagccctcctgtgagtgtcatcactatccgaagtgacactgatgaggaagaggacaacaaatacaagcccagtagctctggactgaagccaaggtctaatgcgactcggaccgatg

SEQ ID NO: 2218 - DNA, 203 bp, Homo sapiens
ggcgcgccagtccttcatcagttatgtcactgtcaatgattctccagactctgactcttctttgagcagcccttattccactgataccctgagtgctctccgaggcaatagtggatccgttttggaggggcctggcagagttgtggcagatggcactggcacccgcactatcattgtgcctccactgacgactcggaccgatg

SEQ ID NO: 2219 - DNA, 203 bp, Homo sapiens
ggcgcgccagtcctaaactcagcttggtgactgcactgtagcaacccaggcctcaggtctcctgagcaataagactaagccagtcgcttcagtgagtgggcagtcatctggatgctgtatcacccccacagggtatcgagctcaacgcggggggaccagtgcagcacaaccactcaatcttagccaggcgactcggaccgatg

SEQ ID NO: 2220 - DNA, 203 bp, Homo sapiens
ggcgcgccagtcctgatgtctcactactaaactaccagtcagctttgtacccatcatctgctgcaccagttcctggagttgcccagcagggtgtttccttgcagcctggaaccacccagatttgcactcagacagatccattccaacagacatttatagtatgtccacctgcgtttcaaactggactacgactcggaccgatg

SEQ ID NO: 2221 - DNA, 203 bp, Homo sapiens
ggcgcgccagtcctcaagcaacaacaaagcattctggattccctgtgaggatggataatgctgtaccgattgtaccccaggcaccagctgctcagccactacagattcagtcaggagttctcacgcagggaagctgtacaccactaatggtagcaactctccaccctcaagtagccaccatcacaccgcgactcggaccgatg

SEQ ID NO: 2222 - DNA, 203 bp, Homo sapiens
ggcgcgccagtcctcagtatgcggtgccctttactctgagctgcgcagccggccggccggcgctggttgaacagactgccgctgtactgcaggcgtggcctggagggactcagcaaattctcctgccttcaacttggcaacagttgcctggggtagctctacacaactctgtccagcccacagcaatgcgactcggaccgatg

SEQ ID NO: 2223 - DNA, 203 bp, Homo sapiens
ggcgcgccagtcctagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctaccccttcgactcggaccgatg

SEQ ID NO: 2224 - DNA, 203 bp, Homo sapiens
ggcgcgccagtcctccttgtcttttttctgtaagggacaagatttgttgtttttgtaagaaatgagatgcaggaaagaaaaccaaatcccattcctgcaccccagtccaataagcagataccacttaagataggagtctaaactccacagaaaaggataataccaagagcttgtattgttaccttagtcgactcggaccgatg

SEQ ID NO: 2225 - DNA, 203 bp, Homo sapiens
ggcgcgccagtcctgaagggaggaagcctggtgaatttagtgagcagctggcctgggtcacagtgacctgacctcaaaccagcttaaggctttaagtcctctctcagaacttggcatttccaacttcttcctttccgggtgagagaagaagcggagaagggttcagtgtagccactctgggctcatagcgactcggaccgatg

SEQ ID NO: 2226 - DNA, 203 bp, Homo sapiens
ggcgcgccagtcctggacacttggtcactccagagtttttaatagctcccaggaggtgatattattttcagtgctcagctgaaataccaaccccaggaataagaactccatttcaaacagttctggccattctgagcctgcttttgtgattgctcatccattgtcctccactagaggggctaagcttgcgactcggaccgatg

SEQ ID NO: 2227 - DNA, 203 bp, Homo sapiens
ggcgcgccagtcctctttggttttacaaagtagcttgtattttcagtattttctacataatatggtaaaatgtagagcaattgcaatgcatcaataaaatgggtaaattttctgacttatgtggctgtttttgacttctgttataggatataaaggggatcaataaatgacatctttgaaagtgaaaacgactcggaccgatg

SEQ ID NO: 2228 - DNA, 203 bp, Homo sapiens
ggcgcgccagtcctcgcaccacccccagctacgtggccttcacggacaccgagcggctcatcggggatgcggccaagaaccaggtggcgctgaacccgcagaacaccgtgtttgacgcgaagcggctgattggccgcaagttcggcgacccggtggtgcagtcggacatgaagcactggcctttccagcgactcggaccgatg

SEQ ID NO: 2229 - DNA, 203 bp, Homo sapiens
ggcgcgccagtcctgtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaaccgactcggaccgatg

SEQ ID NO: 2230 - DNA, 203 bp, Homo sapiens
ggcgcgccagtcctgtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaaccgactcggaccgatg

SEQ ID NO: 2231 - DNA, 203 bp, Homo sapiens
ggcgcgccagtcctggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcgactcggaccgatg

SEQ ID NO: 2232 - DNA, 203 bp, Homo sapiens
ggcgcgccagtcctcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaacgactcggaccgatg

SEQ ID NO: 2233 - DNA, 203 bp, Homo sapiens
ggcgcgccagtcctaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaacgactcggaccgatg

SEQ ID NO: 2234 - DNA, 203 bp, Homo sapiens
ggcgcgccagtcctctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacgcgactcggaccgatg

SEQ ID NO: 2235 - DNA, 203 bp, Homo sapiens
ggcgcgccagtcctgtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaacgactcggaccgatg

SEQ ID NO: 2236 - DNA, 203 bp, Homo sapiens
ggcgcgccagtcctgacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaacgactcggaccgatg

SEQ ID NO: 2237 - DNA, 203 bp, Homo sapiens
ggcgcgccagtcctgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttccgactcggaccgatg

SEQ ID NO: 2238 - DNA, 203 bp, Homo sapiens
ggcgcgccagtccttggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccccgactcggaccgatg

SEQ ID NO: 2239 - DNA, 203 bp, Homo sapiens
ggcgcgccagtccttgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaatcgactcggaccgatg

SEQ ID NO: 2240 - DNA, 203 bp, Homo sapiens
ggcgcgccagtcctttaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaacgactcggaccgatg

SEQ ID NO: 2241 - DNA, 203 bp, Homo sapiens
ggcgcgccagtcctattatccagatattttgggtgggccgcaaaggcgagctacttagacgcaccccggtgagctcggccatgcagacaccaatgggaatcccaatggggaagtcgatgctggtgcttctcaccttcttggccttcgcctcgtgctgcattgctgcttaccgccccagtgagaccctgcgactcggaccgatg

SEQ ID NO: 2242 - DNA, 203 bp, Homo sapiens
ggcgcgccagtccttgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtcccgactcggaccgatg

SEQ ID NO: 2243 - DNA, 203 bp, Homo sapiens
ggcgcgccagtcctttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggcgactcggaccgatg

SEQ ID NO: 2244 - DNA, 203 bp, Homo sapiens
ggcgcgccagtcctttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacacgactcggaccgatg

SEQ ID NO: 2245 - DNA, 203 bp, Homo sapiens
ggcgcgccagtcctggtgggcacgtcgctgctaccgccatctcccttctcacgggaattttcagggtaaactggccatccgaaaatagcaacaacccagactggctcctcactcccttttccatcactaaaaatcacagagcagtcagagggacccagtaagaccaaaggaggggaggacagagcatgcgactcggaccgatg

SEQ ID NO: 2246 - DNA, 203 bp, Homo sapiens
ggcgcgccagtcctacgcacagcacacacagcacacagatgagcacacagcacacacacaaacgcacagcacacacacgcacacacatgcacacacagcacacaaacgcacggcacacacacgcacacacatgcacacacagcacacacacaaacgcacagcacacacaaacgcacagcacacacgcacgactcggaccgatg

SEQ ID NO: 2247 - DNA, 203 bp, Homo sapiens
ggcgcgccagtcctctaattccatctttccaccatgacagagatgcccttgtgaggctggcctccttggcgcctgtccccacggcccccgcagcgtgagccacgatgctccccataccccacccattcccgatacaccttacttactgtgtgttggcccagccagagtgaggaaggagtttggccacacgactcggaccgatg

SEQ ID NO: 2248 - DNA, 203 bp, Homo sapiens
ggcgcgccagtcctttggagatggcggtagctgagcagacatgcccccacgagtagcctgactccctggtgtgctcctggaaggaagatcttggggacccccccaccggagcacacctagggatcatctttgcccgtctcctggggaccccccaagaaatgtggagtcctcgggggccgtgcactgatcgactcggaccgatg

SEQ ID NO: 2249 - DNA, 203 bp, Homo sapiens
ggcgcgccagtcctgggtggccgccttccgcacacttgaggaaccctcccctctccctcggtgacatcttgcccgcccctcagcaccctgccttgtctccaggaggtccgaagctctgtgggacctcttgggggcaaggtggggtgaggccggggagtagggaggtcaggcgggtctgagcccacagacgactcggaccgatg

SEQ ID NO: 2250 - DNA, 203 bp, Homo sapiens
ggcgcgccagtcctggccactaaccatcctggcccgggctgcctgtctgacctccgtgcctagtcgtggctctccatcttgtctcctccccgtgtccccaatgtcttcagtggggggccccctcttgggtcccctcctctgccatcacctgaagacccccacgccaaacactgaatgtcacctgtgcccgactcggaccgatg

SEQ ID NO: 2251 - DNA, 203 bp, Homo sapiens
ggcgcgccagtcctccgctaatgtaccatgccctggtgctggaaagtgcctgagccagctgccccagcggcctcagcactaccaagttggcacaaagctccccaaattcggaggggctcagggaaacgagtggaggggatgaggaggtgaggggtaaacccatcatttcagttggcatttgagcaggtcgactcggaccgatg

SEQ ID NO: 2252 - DNA, 203 bp, Homo sapiens
ggcgcgccagtcctccagcccccagccccagggctctgaatcgctgccagctcagccccctgcccagcctgccccacagcctgagccccagcaggccagagagcccagtcctgaggtgagctgctgtggcctgtggcccaggcgaccccagcgctcccagaactgaggctggcagccagccccagcctcgactcggaccgatg

SEQ ID NO: 2253 - DNA, 203 bp, Homo sapiens
ggcgcgccagtcctcagccccaactgcgaggcagagagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgccgactcggaccgatg

SEQ ID NO: 2254 - DNA, 203 bp, Homo sapiens
ggcgcgccagtcctggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttcccccgactcggaccgatg

SEQ ID NO: 2255 - DNA, 203 bp, Homo sapiens
ggcgcgccagtcctagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaacgactcggaccgatg

SEQ ID NO: 2256 - DNA, 203 bp, Homo sapiens
ggcgcgccagtcctgaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctcgactcggaccgatg

SEQ ID NO: 2257 - DNA, 203 bp, Homo sapiens
ggcgcgccagtcctgacccagtccccgtgccccgcctccccgaaacaggctactctcctcggccccctccatcgggctgaggaagcacagcagcatcttcaaacatgtacaaaatcgattggctttaaacacccttcacataccctccccccaaattatccccaattatccccacacataaaaaatcacgactcggaccgatg

SEQ ID NO: 2258 - DNA, 203 bp, Homo sapiens
ggcgcgccagtcctagggtaaactggccatccgaaaatagcaacaacccagactggctcctcactcccttttccatcactaaaaatcacagagcagtcagagggacccagtaagaccaaaggaggggaggacagagcatgaaaaccaaaatccatgcaaatgaaatgtaattggcacgaccctcaccccgactcggaccgatg

SEQ ID NO: 2259 - DNA, 203 bp, Homo sapiens
ggcgcgccagtcctacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacaccgactcggaccgatg

SEQ ID NO: 2260 - DNA, 203 bp, Homo sapiens
ggcgcgccagtccttccttggcgcctgtccccacggcccccgcagcgtgagccacgatgctccccataccccacccattcccgatacaccttacttactgtgtgttggcccagccagagtgaggaaggagtttggccacattggagatggcggtagctgagcagacatgcccccacgagtagcctgaccgactcggaccgatg

SEQ ID NO: 2261 - DNA, 203 bp, Homo sapiens
ggcgcgccagtcctagggtctcctcaggtgtcaggagggtgctcggaggccacaggagggggctcctggctggcctgaggctggccggaggggaaggggctagcaggtgtgtaaacagagggttccatcaggctggggcagggtggccgccttccgcacacttgaggaaccctcccctctccctcggtcgactcggaccgatg

SEQ ID NO: 2262 - DNA, 203 bp, Homo sapiens
ggcgcgccagtcctgagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggcgactcggaccgatg

SEQ ID NO: 2263 - DNA, 203 bp, Homo sapiens
ggcgcgccagtcctggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcacccccgactcggaccgatg

SEQ ID NO: 2264 - DNA, 203 bp, Homo sapiens
ggcgcgccagtcctaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccgggctgcctgtctgacctccgtgcctacgactcggaccgatg

SEQ ID NO: 2265 - DNA, 203 bp, Homo sapiens
ggcgcgccagtcctgtcgtggctctccatcttgtctcctccccgtgtccccaatgtcttcagtggggggccccctcttgggtcccctcctctgccatcacctgaagacccccacgccaaacactgaatgtcacctgtgcctgccgcctcggtccaccttgcggcccgtgtttgactcaactcaactcccgactcggaccgatg

SEQ ID NO: 2266 - DNA, 203 bp, Homo sapiens
ggcgcgccagtcctccacctggggcccgcgcccgcccgccgcccgcagcgctctctgctcctgctgcagctgctgctgctcgtcgctgccccggggtccacgcaggcccaggccgccccgttccccgagctgtgcagttatacatgggaagctgttgataccaaaaataatgtactttataaaatcaacgactcggaccgatg

SEQ ID NO: 2267 - DNA, 203 bp, Homo sapiens
ggcgcgccagtcctagtccagagcagcattgccttcctgtgtgggaaaaccctgggaactcctgaatttgtaactgcaacagaatgtgtgcactactttgagtggaggaccactgcagcctgcaagaaagacatatttaaagcaaataaggaggtgccatgctatgtgtttgatgaagagttgaggaacgactcggaccgatg

SEQ ID NO: 2268 - DNA, 203 bp, Homo sapiens
ggcgcgccagtcctgcatgatctcaatcctctgatcaagcttagtggtgcctacttggtggatgactccgatccggacacttctctattcatcaatgtttgtagagacatagacacactacgagacccaggttcacagctgcgggcctgtccccccggcactgccgcctgcctggtaagaggacaccacgactcggaccgatg

SEQ ID NO: 2269 - DNA, 203 bp, Homo sapiens
ggcgcgccagtcctcctctgcggtgccaccgacgggaagaagcgctatgacctgtccgcgctggtccgccatgcagaaccagagcagaattgggaagctgtggatggcagtcagacggaaacagagaagaagcattttttcattaatatttgtcacagagtgctgcaggaaggcaaggcacgagggtgcgactcggaccgatg

SEQ ID NO: 2270 - DNA, 203 bp, Homo sapiens
ggcgcgccagtcctccaactgaactacagaggcggcacaccctataacaatgaaagacacacaccgagagctacgctcatcacctttctctgtgatcgagacgcgggagtgggcttccctgaatatcaggaagaggataactccacctacaacttccggtggtacaccagctatgcctgcccggaggacgactcggaccgatg

SEQ ID NO: 2271 - DNA, 203 bp, Homo sapiens
ggcgcgccagtcctgctcaagaattggaagccagcaaggccagtcggaattgagaaaagcctccagctgtccacagagggcttcatcactctgacctacaaagggcctctctctgccaaaggtaccgctgatgcttttatcgtccgctttgtttgcaatgatgatgtttactcagggcccctcaaattcgactcggaccgatg

SEQ ID NO: 2272 - DNA, 203 bp, Homo sapiens
ggcgcgccagtcctcctgcatcaagatatcgactctgggcaagggatccgaaacacttactttgagtttgaaaccgcgttggcctgtgttccttctccagtggactgccaagtcaccgacctggctggaaatgagtacgacctgactggcctaagcacagtcaggaaaccttggacggctgttgacaccgactcggaccgatg

SEQ ID NO: 2273 - DNA, 203 bp, Homo sapiens
ggcgcgccagtcctctctgtcgatgggagaaagaggactttctatttgagcgtttgcaatcctctcccttacattcctggatgccagggcagcgcagtggggtcttgcttagtgtcagaaggcaatagctggaatctgggtgtggtgcagatgagtccccaagccgcggcgaatggatctttgagcatcgactcggaccgatg

SEQ ID NO: 2274 - DNA, 203 bp, Homo sapiens
ggcgcgccagtcctcatgtatgtcaacggtgacaagtgtgggaaccagcgcttctccaccaggatcacgtttgagtgtgctcagatatcgggctcaccagcatttcagcttcaggatggttgtgagtacgtgtttatctggagaactgtggaagcctgtcccgttgtcagagtggaaggggacaactgcgactcggaccgatg

SEQ ID NO: 2275 - DNA, 203 bp, Homo sapiens
ggcgcgccagtcctaaaggagacttcagattgttcctacttgtttgagtggcgaacgcagtatgcctgcccacctttcgatctgactgaatgttcattcaaagatggggctggcaactccttcgacctctcgtccctgtcaaggtacagtgacaactgggaagccatcactgggacgggggacccggacgactcggaccgatg

SEQ ID NO: 2276 - DNA, 203 bp, Homo sapiens
ggcgcgccagtcctgcactacctcatcaatgtctgcaagtctctggccccgcaggctggcactgagccgtgccctccagaagcagccgcgtgtctgctgggtggctccaagcccgtgaacctcggcagggtaagggacggacctcagtggagagatggcataattgtcctgaaatacgttgatggcgacgactcggaccgatg

SEQ ID NO: 2277 - DNA, 203 bp, Homo sapiens
ggcgcgccagtcctcttatgtccagatgggattcggaaaaagtcaaccaccatccgattcacctgcagcgagagccaagtgaactccaggcccatgttcatcagcgccgtggaggactgtgagtacacctttgcctggcccacagccacagcctgtcccatgaagagcaacgagcatgatgactgccacgactcggaccgatg

SEQ ID NO: 2278 - DNA, 203 bp, Homo sapiens
ggcgcgccagtcctggtcaccaacccaagcacaggacacctgtttgatctgagctccttaagtggcagggcgggattcacagctgcttacagcgagaaggggttggtttacatgagcatctgtggggagaatgaaaactgccctcctggcgtgggggcctgctttggacagaccaggattagcgtgggcgactcggaccgatg

SEQ ID NO: 2279 - DNA, 203 bp, Homo sapiens
ggcgcgccagtcctcaaggccaacaagaggctgagatacgtggaccaggtcctgcagctggtgtacaaggatgggtccccttgtccctccaaatccggcctgagctataagagtgtgatcagtttcgtgtgcaggcctgaggccgggccaaccaataggcccatgctcatctccctggacaagcagaccgactcggaccgatg

SEQ ID NO: 2280 - DNA, 203 bp, Homo sapiens
ggcgcgccagtcctagatgagcagctcctctacagcttcaacttgtccagcctttccacgagcacctttaaggtgactcgcgactcgcgcacctacagcgttggggtgtgcacctttgcagtcgggccagaacaaggaggctgtaaggacggaggagtctgtctgctctcaggcaccaagggggcatccgactcggaccgatg

SEQ ID NO: 2281 - DNA, 203 bp, Homo sapiens
ggcgcgccagtcctctttggacggctgcaatcaatgaaactggattacaggcaccaggatgaagcggtcgttttaagttacgtgaatggtgatcgttgccctccagaaaccgatgacggcgtcccctgtgtcttccccttcatattcaatgggaagagctacgaggagtgcatcatagagagcagggccgactcggaccgatg

SEQ ID NO: 2282 - DNA, 203 bp, Homo sapiens
ggcgcgccagtcctaaagacggtgggcagacctgcattcaagaggtttgatatcgacagctgcacttactacttcagctgggactcccgggctgcctgcgccgtgaagcctcaggaggtgcagatggtgaatgggaccatcaccaaccctataaatggcaagagcttcagcctcggagatatttatttcgactcggaccgatg

SEQ ID NO: 2283 - DNA, 203 bp, Homo sapiens
ggcgcgccagtccttaagctgttcagagcctctggggacatgaggaccaatggggacaactacctgtatgagatccaactttcctccatcacaagctccagaaacccggcgtgctctggagccaacatatgccaggtgaagcccaacgatcagcacttcagtcggaaagttggaacctctgacaagaccgactcggaccgatg

SEQ ID NO: 2284 - DNA, 203 bp, Homo sapiens
ggcgcgccagtcctcaagtactaccttcaagacggcgatctcgatgtcgtgtttgcctcttcctctaagtgcggaaaggataagaccaagtctgtttcttccaccatcttcttccactgtgaccctctggtggaggacgggatccccgagttcagtcacgagactgccgactgccagtacctcttctccgactcggaccgatg

SEQ ID NO: 2285 - DNA, 203 bp, Homo sapiens
ggcgcgccagtcctttggtacacctcagccgtgtgtcctctgggggtgggctttgacagcgagaatcccggggacgacgggcagatgcacaaggggctgtcagaacggagccaggcagtcggcgcggtgctcagcctgctgctggtggcgctcacctgctgcctgctggccctgttgctctacaagaacgactcggaccgatg

SEQ ID NO: 2286 - DNA, 203 bp, Homo sapiens
ggcgcgccagtcctgaacggccatattaccaccaagtcagtgaaagccctcagctccctgcatggggatgaccaggacagtgaggatgaggttctgaccatcccagaggtgaaagttcactcgggcaggggagctggggcagagagctcccacccagtgagaaacgcacagagcaatgcccttcaggacgactcggaccgatg

SEQ ID NO: 2287 - DNA, 203 bp, Homo sapiens
ggcgcgccagtcctgcgtgaggacgatagggtggggctggtcaggggtgagaaggcgaggaaagggaagtccagctctgcacagcagaagacagtgagctccaccaagctggtgtccttccatgacgacagcgacgaggacctcttacacatctgactccgcagtgcctgcaggggagcacggagccgcgactcggaccgatg

SEQ ID NO: 2288 - DNA, 203 bp, Homo sapiens
ggcgcgccagtccttataggtctcatctcttcaggttctcatgataccacctttactgtgcttatttttttaagaaaaaagtgttgatcaaccattcgacctataagaagccttaatttgcacagtgtgtgacttacagaaactgcatgaaaaatcatgggccagagcctcggccctagcattgcactcgactcggaccgatg

SEQ ID NO: 2289 - DNA, 203 bp, Homo sapiens
ggcgcgccagtccttggcctcatgctggagggaggctgggcgggtacagcgcggaggaggagggaggccaggcgggcatggcgtggaggaggagggaggccgggcggtcacagcatggaggaggagggaggcgctgctggtgttcttattctggcggcagcgcctttcctgccatgtttagtgaatgacgactcggaccgatg

SEQ ID NO: 2290 - DNA, 203 bp, Homo sapiens
ggcgcgccagtcctgctgagaagcaaaccgccctgcagcatccctcagcctgtaccggtttggctggcttgtttgatttcaacatgagtgtattttttaaaattgatttttctcttcatttttttttcaatcaactttactgtaatataaagtattcaacaatttcaataaaagataaattattaaaacgactcggaccgatg

SEQ ID NO: 2291 - DNA, 203 bp, Homo sapiens
ggcgcgccagtcctcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtcgactcggaccgatg

SEQ ID NO: 2292 - DNA, 203 bp, Homo sapiens
ggcgcgccagtcctctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaagcgactcggaccgatg

SEQ ID NO: 2293 - DNA, 203 bp, Homo sapiens
ggcgcgccagtcctgtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatcgactcggaccgatg

SEQ ID NO: 2294 - DNA, 203 bp, Homo sapiens
ggcgcgccagtcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggcatggggcttctcccgactcggaccgatg

SEQ ID NO: 2295 - DNA, 203 bp, Homo sapiens
ggcgcgccagtcctcctactgtatcgtcagccacttgcaggaggacaaaaaatgcttcatatgcaattcccaagatccttatcatgagaccctgaatcctgacagccatctcattgaaaatgtggtcactacatttgctccaaaccgccttaagatttggtggcaatctgaaaatggtgtggaaaatgcgactcggaccgatg

SEQ ID NO: 2296 - DNA, 203 bp, Homo sapiens
ggcgcgccagtcctgccagtgctcatgccggcctcacatgattggacgtcagtgcaacgaagtggaacctggttactactttgccaccctggatcactacctctatgaagcggaggaagccaacttggggcctggggttagcatagtggagcggcaatatatccaggaccggattccctcctggactgcgactcggaccgatg

SEQ ID NO: 2297 - DNA, 203 bp, Homo sapiens
ggcgcgccagtcctgagccggcttcgtccgagtgcctgaaggggcttatttggagtttttcattgacaacataccatattccatggagtacgacatcctaattcgctacgagccacagctacccgaccactgggaaaaagctgtcatcacagtgcagcgacctggaaggattccaaccagcagccgatcgactcggaccgatg

SEQ ID NO: 2298 - DNA, 203 bp, Homo sapiens
ggcgcgccagtcctgatgcaaaccttgtgagtgccatctgcaaggatctgtcaatgccttctgcaatcccgtcactggccagtgccactgtttccagggagtgtatgctcggcagtgtgatcggtgcttacctgggcactggggctttccaagttgccagccctgccagtgcaatggccacgccgatgcgactcggaccgatg

SEQ ID NO: 2299 - DNA, 203 bp, Homo sapiens
ggcgcgccagtcctactgcgacccagtgactggggagtgcttgaactgccaggactacaccatgggtcataactgtgaaaggtgcttggctggttactatggcgaccccatcattgggtcaggagatcactgccgcccttgcccttgcccagatggtcccgacagtggacgccagtttgccaggagctcgactcggaccgatg

SEQ ID NO: 2300 - DNA, 203 bp, Homo sapiens
ggcgcgccagtcctacaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgacacgactcggaccgatg

SEQ ID NO: 2301 - DNA, 203 bp, Homo sapiens
ggcgcgccagtcctctgggtttggaggccgcacctgcagcgagtgccaggaactcttctggggagaccccgacgtggagtgccgagcctgtgactgtgaccccaggggcattgagacgccacagtgtgaccagtccacgggccagtgtgtctgcgttgagggtgttgagggtccacgctgtgacaagtcgactcggaccgatg

SEQ ID NO: 2302 - DNA, 203 bp, Homo sapiens
ggcgcgccagtcctgcacgcgagggtactcgggggtcttccctgactgcacaccctgccaccagtgctttgctctctgggatgtgatcattgccgagctgaccaacaggacacacagattcctggagaaagccaaggccttgaagatcagtggtgtgatcgggccttaccgtgagactgtggactcggcgactcggaccgatg

SEQ ID NO: 2303 - DNA, 203 bp, Homo sapiens
ggcgcgccagtccttggagaggaaagtcagcgagataaaagacatcctggcgcagagccccgcagcagagccactgaaaaacattgggaatctctttgaggaagcagagaaactgattaaagatgttacagaaatgatggctcaagtagaagtgaaattatctgacacaacttcccaaagcaacagcacgactcggaccgatg

SEQ ID NO: 2304 - DNA, 203 bp, Homo sapiens
ggcgcgccagtcctcagccaaagaactggattctctacagacagaagccgaaagcctagacaacactgtgaaagaacttgctgaacaactggaatttatcaaaaactcagatattcggggtgccttggatagcattaccaagtatttccagatgtctcttgaggcagaggagagggtgaatgcctccacgactcggaccgatg

SEQ ID NO: 2305 - DNA, 203 bp, Homo sapiens
ggcgcgccagtcctcctgtggaacacccccaggggcctcctgttccgagactgaatgtggcgggccaaactgcagaactgacgaaggagagaggaagtgtggggggcctggctgtggtggtctggttactgttgcacacaacgcctggcagaaagccatggacttggaccaagatgtcctgagtgccccgactcggaccgatg

SEQ ID NO: 2306 - DNA, 203 bp, Homo sapiens
ggcgcgccagtcctaggatagtgctgatttggacagcattgaagcagttgctaatgaagtattgaaaatggagatgcctagcaccccacagcagttacagaacttgacagaagatatacgtgaacgagttgaaagcctttctcaagtagaggttattcttcagcatagtgctgctgacattgccagagcgactcggaccgatg

SEQ ID NO: 2307 - DNA, 203 bp, Homo sapiens
ggcgcgccagtcctctgagatgttgttagaagaagctaaaagagcaagcaaaagtgcaacagatgttaaagtcactgcagatatggtaaaggaagctctggaagaagcagaaaaggcccaggtcgcagcagagaaggcaattaaacaagcagatgaagacattcaaggaacccagaacctgttaacttcgactcggaccgatg

SEQ ID NO: 2308 - DNA, 203 bp, Homo sapiens
ggcgcgccagtcctcgattgagtctgaaacagcagcttctgaggaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttacgactcggaccgatg

SEQ ID NO: 2309 - DNA, 203 bp, Homo sapiens
ggcgcgccagtcctctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggatgccccaactctccggaggaggtggcggcgactcggaccgatg

SEQ ID NO: 2310 - DNA, 203 bp, Homo sapiens
ggcgcgccagtcctgtccagacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacacgactcggaccgatg

SEQ ID NO: 2311 - DNA, 203 bp, Homo sapiens
ggcgcgccagtcctggaacatccccacactgacagtgacctaatgcacgtgaagcctcagcatgaacagagaaaggagcaggagccaaaaagacctcacattaagaagcctctgaatgcttttatgttatacatgaaagaaatgagagcgaatgtcgttgctgagtgtactctaaaagaaagtgcagccgactcggaccgatg

SEQ ID NO: 2312 - DNA, 203 bp, Homo sapiens
ggcgcgccagtccttgagcagcttttctcccctcatatctgcgtgcacttcccagagcatcttgcatccaaacctgtaacctttcggcaaggacggtaacttggctgcatttgcctgtcatgcgcaactggagccagcaaccagcacatccatcagcaccccagtggaggagttcatggaagagttcccgactcggaccgatg

SEQ ID NO: 2313 - DNA, 203 bp, Homo sapiens
ggcgcgccagtcctctctttgtttctgcttcatttttctttcttttcttttctcctaaagcttttatttaacagtgcaaaaggatcgtttttttttgcttttttaaacttgaatttttttaatttacactttttagttttaattttcttgtatattttgctagctatgagcttttaaataaaattgaacgactcggaccgatg

SEQ ID NO: 2314 - DNA, 203 bp, Homo sapiens
ggcgcgccagtcctcaattggcagccctatttcagtttattttttcttctgttttcttcttttctttttttaaacagtaaaccttaacagatgcgttcagcagactggtttgcagtgaattttcatttctttccttatcacccccttgttgtaaaaagcccagcacttgaattgttattactttaaatcgactcggaccgatg

SEQ ID NO: 2315 - DNA, 203 bp, Homo sapiens
ggcgcgccagtcctttttatttggggtttgggaccggatcaggccttaaatctacgcagaagaaaggcggagaagcagcggaagccgggcactagtcctgcagggtggaaggcgctttatcgggtcttctggcccgctgcgggcgatagagctggtaacctgagtagagtaaatagagacacgtgggtcgactcggaccgatg

SEQ ID NO: 2316 - DNA, 203 bp, Homo sapiens
ggcgcgccagtccttggatctctttctccacccatcccgagaacatcaaataaagtgcccgtggtgcagccatcccatgcggtccatcctctcacccccctcatcacttacagtgacgagcacttttctccaggatcacacccgtcacacatcccatcagatgtcaactccaaacaaggcatgtccagcgactcggaccgatg

SEQ ID NO: 2317 - DNA, 203 bp, Homo sapiens
ggcgcgccagtcctacatcctccagctcctgatatccctactttttatcccttgtctccgggtggtgttggacagatcaccccacctcttggctggttttcccatcatatgattcccggtcctcctggtccccacacaactggcatccctcatccagctattgtaacacctcaggtcaaacaggaacacgactcggaccgatg

SEQ ID NO: 2318 - DNA, 203 bp, Homo sapiens
ggcgcgccagtcctaggtacaggtccaagaatgacagctgcctacatctgaaacatggtggaaaacgaagctcattcccaacgtgcaaagccaaggcagcgaccccaggacctcttctggagatggaagcttgttgaaaacccagactgtctccacggcctgcccagtcgaccccaaaggaacactgacgactcggaccgatg

SEQ ID NO: 2319 - DNA, 203 bp, Homo sapiens
ggcgcgccagtcctccgccctgttcgagctgtgcgggcgggcggtgagcgcccatatgggggttctggagagcggggtgtgggccctcccaggcccaatacttcaaagcatcctacctctgctcaatatatattacttggagaggattgaggaaactgccctcaagaaaggcctctcaactcaggccacgactcggaccgatg

SEQ ID NO: 2320 - DNA, 203 bp, Homo sapiens
ggcgcgccagtcctgctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgtcgactcggaccgatg

SEQ ID NO: 2321 - DNA, 203 bp, Homo sapiens
ggcgcgccagtccttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcgactcggaccgatg

SEQ ID NO: 2322 - DNA, 203 bp, Homo sapiens
ggcgcgccagtcctcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcagcgactcggaccgatg

SEQ ID NO: 2323 - DNA, 203 bp, Homo sapiens
ggcgcgccagtcctgcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcacgactcggaccgatg

SEQ ID NO: 2324 - DNA, 203 bp, Homo sapiens
ggcgcgccagtcctttccagcactggaagcttcacaaagattccgcagcatctccaccttggagctattcacagttccactctccacagaggcagccctgacactatgccacctgctgagctcctgggtgtcactggagagcctcacactctcctacaatggcctgggctctaacatcttccgcctgccgactcggaccgatg

SEQ ID NO: 2325 - DNA, 203 bp, Homo sapiens
ggcgcgccagtccttagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaacccgactcggaccgatg

SEQ ID NO: 2326 - DNA, 203 bp, Homo sapiens
ggcgcgccagtccttgtttgagaagcgcccagcccaatttctgcctgagatggttgctgctatgaagggcaactccacactgaagggcctccggctgccagggaaccgcctggggaatgctggcctgctggccttggcagatgttttctcagaggattcatcctcctctctctgtcagctggacatcacgactcggaccgatg

SEQ ID NO: 2327 - DNA, 203 bp, Homo sapiens
ggcgcgccagtccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcccgactcggaccgatg

SEQ ID NO: 2328 - DNA, 203 bp, Homo sapiens
ggcgcgccagtcctcatgggactgtctctggtagagatggcggttgggaggtatcccatccctcctccagatgccaaggagctggagctgatgtttgggtgccaggtggaaggagatgcggctgagaccccacccaggccaaggacccccgggaggccccttagctcatacggaatggacagccgacccgactcggaccgatg

SEQ ID NO: 2329 - DNA, 203 bp, Homo sapiens
ggcgcgccagtccttcccatggcaatttttgagttgttggattacatagtcaacgagcctcctccaaaactgcccagtggagtgttcagtctggaatttcaagattttgtgaataaatgcttaataaaaaaccccgcagagagagcagatttgaagcaactcatggttcatgcttttatcaagagatccgactcggaccgatg

SEQ ID NO: 2330 - DNA, 203 bp, Homo sapiens
ggcgcgccagtcctgttcagatgtgcatttcacctgtgacaaaggatgaagaacacagcatgtgccaagattctactcttgtcatttttaatattactgtctttattcttattactattattgttcccctaagtggattggctttgtgcttggggctatttgtgtgtatgctgatgatcaaaacctgtcgactcggaccgatg

SEQ ID NO: 2331 - DNA, 203 bp, Homo sapiens
ggcgcgccagtcctactgccatcctggcccagggcatctgggaggaaccgagggggctgctcccacctggctctgtggcgagccatttgtcccaagtgccaaagaagcagaccattggggctcccagccaggcccttgtcggccccaccagtgcctctccctgctgctcctaggacccgtctccagctcgactcggaccgatg

SEQ ID NO: 2332 - DNA, 203 bp, Homo sapiens
ggcgcgccagtcctggtggccacacctctatcccggctttggtgcggggtacacaagaggggatgagttgtgtgaataccccaagactcccatgagggagatgccatgagccgcccaaggccttcccctggcactggcaaacagggcctctgcggagcacactggctcacccagtcctgcccgccacccgactcggaccgatg

SEQ ID NO: 2333 - DNA, 203 bp, Homo sapiens
ggcgcgccagtcctctttgaggtggaggctgatgacttggtgaccatctcagaactgggccgtggagcctatggggtggtagagaaggtgcggcacgcccagagcggcaccatcatggccgtgaagcggatccgggccaccgtgaactcacaggagcagaagcggctgctcatggacctggacatcaacgactcggaccgatg

SEQ ID NO: 2334 - DNA, 203 bp, Homo sapiens
ggcgcgccagtccttatcgtgcgggccctggagcatctgcacagcaagctgtcggtgatccacagagatgtgaagccctccaatgtccttatcaacaaggagggccatgtgaagatgtgtgactttggcatcagtggctacttggtggactctgtggccaagacgatggatgccggctgcaagccctacgactcggaccgatg

SEQ ID NO: 2335 - DNA, 203 bp, Homo sapiens
ggcgcgccagtcctcatggcccctgagaggatcaacccagagctgaaccagaagggctacaatgtcaagtccgacgtctggagcctgggcatcaccatgattgagatggccatcctgcggttcccttacgagtcctgggggaccccgttccagcagctgaagcaggtggtggaggagccgtccccccacgactcggaccgatg

SEQ ID NO: 2336 - DNA, 203 bp, Homo sapiens
ggcgcgccagtcctgctcccagccgaccgtttctcccccgagtttgtggacttcactgctcagtgcctgaggaagaaccccgcagagcgtatgagctacctggagctgatggagcaccccttcttcaccttgcacaaaaccaagaagacggacattgctgccttcgtgaaggagatcctgggagaagacgactcggaccgatg

SEQ ID NO: 2337 - DNA, 203 bp, Homo sapiens
ggcgcgccagtcctctcataggggctgggcctcggaccccactccggccctccagagccccacagccccatctgcgggggcagtgctcacccacaccataagctactgccatcctggcccagggcatctgggaggaaccgagggggctgctcccacctggctctgtggcgagccatttgtcccaagtgcgactcggaccgatg

SEQ ID NO: 2338 - DNA, 203 bp, Homo sapiens
ggcgcgccagtcctccaaagaagcagaccattggggctcccagccaggcccttgtcggccccaccagtgcctctccctgctgctcctaggacccgtctccagctgctgagatcctggactgagggggcctggatgccccctgtggatgctgctgcccctgcacagcaggctgccagtgcctgggtggacgactcggaccgatg

SEQ ID NO: 2339 - DNA, 203 bp, Homo sapiens
ggcgcgccagtcctagatgccatgagccgcccaaggccttcccctggcactggcaaacagggcctctgcggagcacactggctcacccagtcctgcccgccaccgttatcggtgtcattcacctttcgtgttttttttaatttatcctctgttgattttttcttttgctttatgggtttggcttgtttcgactcggaccgatg

SEQ ID NO: 2340 - DNA, 203 bp, Homo sapiens
ggcgcgccagtcctttcttgcatggtttggagctgatcgcttctcccccaccccctagggtaccagcaggcagagccttgccctctgctcaggctggggtccagtgggaggggcccaagatctctgctcagagaagtgcagggggagccttccagctcactctccctgaggactggcttgacaggggccgactcggaccgatg

SEQ ID NO: 2341 - DNA, 203 bp, Homo sapiens
ggcgcgccagtcctttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttcgactcggaccgatg

SEQ ID NO: 2342 - DNA, 203 bp, Homo sapiens
ggcgcgccagtcctagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcacgactcggaccgatg

SEQ ID NO: 2343 - DNA, 203 bp, Homo sapiens
ggcgcgccagtcctgaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagcgactcggaccgatg

SEQ ID NO: 2344 - DNA, 203 bp, Homo sapiens
ggcgcgccagtccttggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacgactcggaccgatg

SEQ ID NO: 2345 - DNA, 203 bp, Homo sapiens
ggcgcgccagtcctcagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtcgactcggaccgatg

SEQ ID NO: 2346 - DNA, 203 bp, Homo sapiens
ggcgcgccagtcctgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacaccccgactcggaccgatg

SEQ ID NO: 2347 - DNA, 203 bp, Homo sapiens
ggcgcgccagtcctggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatccgactcggaccgatg

SEQ ID NO: 2348 - DNA, 203 bp, Homo sapiens
ggcgcgccagtccttccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagcgactcggaccgatg

SEQ ID NO: 2349 - DNA, 203 bp, Homo sapiens
ggcgcgccagtccttaaggactcgactacctccgaagaaagccgaaacatgtggctccgcccacactggcctcagctctccgttctcgactattgccgaagtgagccgaagtttgtggccccgcttccggagaactcaagctcccgattgtgcccgaaggaacccgaagggagaccccgcctcattcccgactcggaccgatg

SEQ ID NO: 2350 - DNA, 203 bp, Homo sapiens
ggcgcgccagtccttcacggcgagctccagaccccgcctcctttccggagcccgtctgttccccttcgggtccaaagcttttggctcctccttgttccgagcccgaaggcccgccccttcacgtactcggagctcggatcccagtgtggacctggactcgaatcccgttgccgactcgcgctctcggccgactcggaccgatg

SEQ ID NO: 2351 - DNA, 203 bp, Homo sapiens
ggcgcgccagtcctctcctgcccggcgagcagctcaggtcctgggctgaagagatggggagcagccgctgtgggcctggggctcaccctgttcacctgtggcccccacactttgcattctctggtcaccatcctcgggacctgggccctcattcaggcccagccctgctggtgagcctggccagtgaacgactcggaccgatg

SEQ ID NO: 2352 - DNA, 203 bp, Homo sapiens
ggcgcgccagtcctctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgcgactcggaccgatg

SEQ ID NO: 2353 - DNA, 203 bp, Homo sapiens
ggcgcgccagtcctctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgaccgactcggaccgatg

SEQ ID NO: 2354 - DNA, 203 bp, Homo sapiens
ggcgcgccagtccttacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccacgactcggaccgatg

SEQ ID NO: 2355 - DNA, 203 bp, Homo sapiens
ggcgcgccagtcctgagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagaccccgactcggaccgatg

SEQ ID NO: 2356 - DNA, 203 bp, Homo sapiens
ggcgcgccagtccttttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggcgactcggaccgatg

SEQ ID NO: 2357 - DNA, 203 bp, Homo sapiens
ggcgcgccagtcctggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctccgactcggaccgatg

SEQ ID NO: 2358 - DNA, 203 bp, Homo sapiens
ggcgcgccagtcctctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtcgactcggaccgatg

SEQ ID NO: 2359 - DNA, 203 bp, Homo sapiens
ggcgcgccagtcctcctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccgactcggaccgatg

SEQ ID NO: 2360 - DNA, 203 bp, Homo sapiens
ggcgcgccagtcctagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagctcgactcggaccgatg

SEQ ID NO: 2361 - DNA, 203 bp, Homo sapiens
ggcgcgccagtccttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcacgactcggaccgatg

SEQ ID NO: 2362 - DNA, 203 bp, Homo sapiens
ggcgcgccagtcctcgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacgactcggaccgatg

SEQ ID NO: 2363 - DNA, 203 bp, Homo sapiens
ggcgcgccagtcctcatgatgtcacacctggtgaagatccctggcatcatcatcgcggcctctggggtccgtgccaaggccacccgcatctctatccagtgccgcagctgccgcaacaccctcaccaacattgccatgcgccctggcctcgagggctatgccctgcccaggaagtgcaacacagatcacgactcggaccgatg

SEQ ID NO: 2364 - DNA, 203 bp, Homo sapiens
ggcgcgccagtcctggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccccgactcggaccgatg

SEQ ID NO: 2365 - DNA, 203 bp, Homo sapiens
ggcgcgccagtcctggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcgactcggaccgatg

SEQ ID NO: 2366 - DNA, 203 bp, Homo sapiens
ggcgcgccagtcctcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccgactcggaccgatg

SEQ ID NO: 2367 - DNA, 203 bp, Homo sapiens
ggcgcgccagtcctgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggccgactcggaccgatg

SEQ ID NO: 2368 - DNA, 203 bp, Homo sapiens
ggcgcgccagtcctcatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagcgactcggaccgatg

SEQ ID NO: 2369 - DNA, 203 bp, Homo sapiens
ggcgcgccagtcctccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcacgactcggaccgatg

SEQ ID NO: 2370 - DNA, 203 bp, Homo sapiens
ggcgcgccagtcctgagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctcgactcggaccgatg

SEQ ID NO: 2371 - DNA, 203 bp, Homo sapiens
ggcgcgccagtcctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctccccgactcggaccgatg

SEQ ID NO: 2372 - DNA, 203 bp, Homo sapiens
ggcgcgccagtcctctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaacgactcggaccgatg

SEQ ID NO: 2373 - DNA, 203 bp, Homo sapiens
ggcgcgccagtcctgaggatgaccaggcctccacctccaccgcctctgagggtgaggacaacatagacgaggatatggaggaggaccgggcgggcctgggcccacctaagctgagccatcgtccccagccggagctgctgaagtccaccctgccaccccccagcaccacccctgcgcctctgcctccacgactcggaccgatg

SEQ ID NO: 2374 - DNA, 203 bp, Homo sapiens
ggcgcgccagtcctcacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctcccgactcggaccgatg

SEQ ID NO: 2375 - DNA, 203 bp, Homo sapiens
ggcgcgccagtcctacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgcccgactcggaccgatg

SEQ ID NO: 2376 - DNA, 203 bp, Homo sapiens
ggcgcgccagtcctccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccgactcggaccgatg

SEQ ID NO: 2377 - DNA, 203 bp, Homo sapiens
ggcgcgccagtcctcagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccagcgactcggaccgatg

SEQ ID NO: 2378 - DNA, 203 bp, Homo sapiens
ggcgcgccagtcctttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctcgactcggaccgatg

SEQ ID NO: 2379 - DNA, 203 bp, Homo sapiens
ggcgcgccagtcctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccccgactcggaccgatg

SEQ ID NO: 2380 - DNA, 203 bp, Homo sapiens
ggcgcgccagtccttgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggtcgactcggaccgatg

SEQ ID NO: 2381 - DNA, 203 bp, Homo sapiens
ggcgcgccagtccttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagcgactcggaccgatg

SEQ ID NO: 2382 - DNA, 203 bp, Homo sapiens
ggcgcgccagtcctccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacacgactcggaccgatg

SEQ ID NO: 2383 - DNA, 203 bp, Homo sapiens
ggcgcgccagtcctgatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagccgactcggaccgatg

SEQ ID NO: 2384 - DNA, 203 bp, Homo sapiens
ggcgcgccagtccttcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagccagctgccgcagccattcagagcgactcggaccgatg

SEQ ID NO: 2385 - DNA, 203 bp, Homo sapiens
ggcgcgccagtcctaaggtcaatcttagaaagctctccaagaactcctacaccattcaaacatgcacttgcagctcaagaaattaaatacggtcccctgaagatgctacctcagacaccctctcatctagtagaagatctgcaggatgtgatcaaacaggaatctgatgaatctggaattgttgctgacgactcggaccgatg

SEQ ID NO: 2386 - DNA, 203 bp, Homo sapiens
ggcgcgccagtcctgtttcaagaaaatggaccacccttactgaagaaaatcaaacaagaggtggaatctccaactgataaatcaggaaacttcttctgctcacaccactgggaaggggacagtctgaatacccaactgttcacgcagacctcgcctgtggcagatgcaccgaatattcttacaagctccgactcggaccgatg

SEQ ID NO: 2387 - DNA, 203 bp, Homo sapiens
ggcgcgccagtcctcgttttaatggcaccagcatcagaagatgaagacaatgttctcaaagcatttacagtacctaaaaacaggtccctggcgagccccttgcagccttgtagcagtacctgggaacctgcatcctgtggaaagatggaggagcagatgacatcttccagtcaagctcgtaaatacgtcgactcggaccgatg

SEQ ID NO: 2388 - DNA, 203 bp, Homo sapiens
ggcgcgccagtcctgaatgcattctcagcccggacgctggtcatgtgagacatttccagaaaagcattatggttttcagaacacttcaagttgacttgggatatatcattcctcaacatgaaacttttcatgaatgggagaagaacctatttttgttgtggtacaacagttgagagcagcaccaagtgcgactcggaccgatg

SEQ ID NO: 2389 - DNA, 203 bp, Homo sapiens
ggcgcgccagtcctctctgcattttttattgtggtttttttgttattgttggtttatacaagcatgcgttgcacttcttttttgggagatgtgtgttgttgatgttctatgttttgttttgagtgtagcctgactgttttataatttgggagttctgcatttgatccgcatcccctgtggtttctaagcgactcggaccgatg

SEQ ID NO: 2390 - DNA, 203 bp, Homo sapiens
ggcgcgccagtccttgtatggtctcagaactgttgcatggatcctgtgtttgcaactggggagacagaaactgtggttgatagccagtcactgccttaagaacatttgatgcaagatggccagcactgaacttttgagatatgacggtgtacttactgccttgtagcaaaataaagatgtgcccttatcgactcggaccgatg

SEQ ID NO: 2391 - DNA, 203 bp, Homo sapiens
ggcgcgccagtccttaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccaggggtccgcaacccttgcccgactcggaccgatg

SEQ ID NO: 2392 - DNA, 203 bp, Homo sapiens
ggcgcgccagtcctgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagcgactcggaccgatg

SEQ ID NO: 2393 - DNA, 203 bp, Homo sapiens
ggcgcgccagtcctatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagaccgactcggaccgatg

SEQ ID NO: 2394 - DNA, 203 bp, Homo sapiens
ggcgcgccagtcctagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttccgactcggaccgatg

SEQ ID NO: 2395 - DNA, 203 bp, Homo sapiens
ggcgcgccagtccttctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggccgactcggaccgatg

SEQ ID NO: 2396 - DNA, 203 bp, Homo sapiens
ggcgcgccagtcctaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtccgactcggaccgatg

SEQ ID NO: 2397 - DNA, 203 bp, Homo sapiens
ggcgcgccagtcctctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccgactcggaccgatg

SEQ ID NO: 2398 - DNA, 203 bp, Homo sapiens
ggcgcgccagtcctacacagaatttcaatcctagtatatagtacctagtattataggtactataaaccctaattttttttatttaagtacattttgctttttaaagttgatttttttctattgtttttagaaaaaataaaataactggcaaatatatcattgagccaaatcttaaaaaaaaaaaaaaacgactcggaccgatg

SEQ ID NO: 2399 - DNA, 203 bp, Homo sapiens
ggcgcgccagtccttgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcacgactcggaccgatg

SEQ ID NO: 2400 - DNA, 203 bp, Homo sapiens
ggcgcgccagtcctagatgagaaaaaagatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagcgactcggaccgatg

SEQ ID NO: 2401 - DNA, 203 bp, Homo sapiens
ggcgcgccagtcctttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcaccgactcggaccgatg

SEQ ID NO: 2402 - DNA, 203 bp, Homo sapiens
ggcgcgccagtccttttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggcgactcggaccgatg

SEQ ID NO: 2403 - DNA, 203 bp, Homo sapiens
ggcgcgccagtcctgctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctcgactcggaccgatg

SEQ ID NO: 2404 - DNA, 203 bp, Homo sapiens
ggcgcgccagtcctgtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataattcgactcggaccgatg

SEQ ID NO: 2405 - DNA, 203 bp, Homo sapiens
ggcgcgccagtcctactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatatcgactcggaccgatg

SEQ ID NO: 2406 - DNA, 203 bp, Homo sapiens
ggcgcgccagtcctggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggacccgactcggaccgatg

SEQ ID NO: 2407 - DNA, 203 bp, Homo sapiens
ggcgcgccagtcctatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatcgactcggaccgatg

SEQ ID NO: 2408 - DNA, 203 bp, Homo sapiens
ggcgcgccagtccttggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatgcgactcggaccgatg

SEQ ID NO: 2409 - DNA, 203 bp, Homo sapiens
ggcgcgccagtcctactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgagcgactcggaccgatg

SEQ ID NO: 2410 - DNA, 203 bp, Homo sapiens
ggcgcgccagtcctggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaacttaaaaaaaacgactcggaccgatg

SEQ ID NO: 2411 - DNA, 203 bp, Homo sapiens
ggcgcgccagtcctgcaagcatcagaggccacccaggcggtggcatcgttggcagaggccgcagtggcagcttctcaggagatgcagcagggagctacagtcactatggcgcttaacagcgaagctgccgcccatgctgtcgccaccctggctgaggccaccttacaaggtgggggacagatcgtcttcgactcggaccgatg

SEQ ID NO: 2412 - DNA, 203 bp, Homo sapiens
ggcgcgccagtcctgtctggggaaaccgcagcagccgtcggagcacttactggagtccaagatgctaatggcctggtccagatccctgtgagcatgtaccagactgtggtgaccagcctcgcccagggcaacggaccagtgcaggtggccatggcccctgtgaccaccaggatatcagacagcgcagtcgactcggaccgatg

SEQ ID NO: 2413 - DNA, 203 bp, Homo sapiens
ggcgcgccagtcctgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattacgactcggaccgatg

SEQ ID NO: 2414 - DNA, 203 bp, Homo sapiens
ggcgcgccagtcctgtggcccagcaagtgcagcaggtccatgtggctacttacaccgagcatagtatgctgagtgctgatgaagactcgccttcttctcccgaggacacctcttacgatgactcagatatactcaactccacagcagctgatgaggtgacagctcatctggcagctgcaggtcctgtgcgactcggaccgatg

SEQ ID NO: 2415 - DNA, 203 bp, Homo sapiens
ggcgcgccagtccttggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggcgactcggaccgatg

SEQ ID NO: 2416 - DNA, 203 bp, Homo sapiens
ggcgcgccagtcctggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactatcgactcggaccgatg

SEQ ID NO: 2417 - DNA, 203 bp, Homo sapiens
ggcgcgccagtcctaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggcgactcggaccgatg

SEQ ID NO: 2418 - DNA, 203 bp, Homo sapiens
ggcgcgccagtccttcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctcgactcggaccgatg

SEQ ID NO: 2419 - DNA, 203 bp, Homo sapiens
ggcgcgccagtcctggggccatggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaacccgactcggaccgatg

SEQ ID NO: 2420 - DNA, 203 bp, Homo sapiens
ggcgcgccagtcctctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttcgactcggaccgatg

SEQ ID NO: 2421 - DNA, 203 bp, Homo sapiens
ggcgcgccagtcctttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttccgactcggaccgatg

SEQ ID NO: 2422 - DNA, 203 bp, Homo sapiens
ggcgcgccagtccttttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagccccgactcggaccgatg

SEQ ID NO: 2423 - DNA, 203 bp, Homo sapiens
ggcgcgccagtcctttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctatcgactcggaccgatg

SEQ ID NO: 2424 - DNA, 203 bp, Homo sapiens
ggcgcgccagtcctaaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgccgactcggaccgatg

SEQ ID NO: 2425 - DNA, 203 bp, Homo sapiens
ggcgcgccagtcctccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtccgactcggaccgatg

SEQ ID NO: 2426 - DNA, 203 bp, Homo sapiens
ggcgcgccagtcctgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattcagctcgactcggaccgatg

SEQ ID NO: 2427 - DNA, 203 bp, Homo sapiens
ggcgcgccagtcctcctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctcgactcggaccgatg

SEQ ID NO: 2428 - DNA, 203 bp, Homo sapiens
ggcgcgccagtcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggccgactcggaccgatg

SEQ ID NO: 2429 - DNA, 203 bp, Homo sapiens
ggcgcgccagtcctcgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagcgactcggaccgatg

SEQ ID NO: 2430 - DNA, 203 bp, Homo sapiens
ggcgcgccagtcctacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttacgactcggaccgatg

SEQ ID NO: 2431 - DNA, 203 bp, Homo sapiens
ggcgcgccagtcctcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtgcgactcggaccgatg

SEQ ID NO: 2432 - DNA, 203 bp, Homo sapiens
ggcgcgccagtcctttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagttcgactcggaccgatg

SEQ ID NO: 2433 - DNA, 203 bp, Homo sapiens
ggcgcgccagtcctcgtgcccgccgcccgggccccgcgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgcttcgactcggaccgatg

SEQ ID NO: 2434 - DNA, 203 bp, Homo sapiens
ggcgcgccagtcctctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcacgactcggaccgatg

SEQ ID NO: 2435 - DNA, 203 bp, Homo sapiens
ggcgcgccagtcctacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccgactcggaccgatg

SEQ ID NO: 2436 - DNA, 203 bp, Homo sapiens
ggcgcgccagtcctcggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcgactcggaccgatg

SEQ ID NO: 2437 - DNA, 203 bp, Homo sapiens
ggcgcgccagtcctcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccgactcggaccgatg

SEQ ID NO: 2438 - DNA, 203 bp, Homo sapiens
ggcgcgccagtcctcggcgtcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtgcgactcggaccgatg

SEQ ID NO: 2439 - DNA, 203 bp, Homo sapiens
ggcgcgccagtcctgactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacacccgactcggaccgatg

SEQ ID NO: 2440 - DNA, 203 bp, Homo sapiens
ggcgcgccagtcctcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcgactcggaccgatg

SEQ ID NO: 2441 - DNA, 203 bp, Homo sapiens
ggcgcgccagtcctaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtggcgactcggaccgatg

SEQ ID NO: 2442 - DNA, 203 bp, Homo sapiens
ggcgcgccagtcctgctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttacgactcggaccgatg

SEQ ID NO: 2443 - DNA, 203 bp, Homo sapiens
ggcgcgccagtcctggaggtaagaactaagacgttcttaaaccctactacgtgctggaatcctgaagtgcctgccatcattcaaacttaagcactaactctctagagagacactgccattcataccacagaacgagaaggcagtggcgatcctcaacggctacatgtcactgcctgccacttccggctcgactcggaccgatg

SEQ ID NO: 2444 - DNA, 203 bp, Homo sapiens
ggcgcgccagtcctacgtgaagttggctttgaatacatgaatagggaacttctctggcatggttttgctgaatttctgatttttctcttaccacttatcaatgtccagaagttgaaagccaagctgtcttcatggtgtattcctcttactggtgcacctaatagtgacaatacattagccaccagtggcgactcggaccgatg

SEQ ID NO: 2445 - DNA, 203 bp, Homo sapiens
ggcgcgccagtcctcaaagaatgcgctctatgtggagagtggcccaccatgcctcacaccataggatgtgagcatattttctgttatttctgtgctaagagtagtttcttatttgacgtgtactttacttgtcctaagtgtggcacagaagtacacagtctgcagccactgaaatcaggaatcgagatcgactcggaccgatg

SEQ ID NO: 2446 - DNA, 203 bp, Homo sapiens
ggcgcgccagtccttttggagactctgggatgagtgtgcatttattttcagagttgacataatatgataatgtgacaattatgagactgttttaaaccttaagacctgatgcctcagttgtaacttttttttttttttctgagacggtgtcctgctctgtcacccaggctggagtgcagtggcgcgatcgactcggaccgatg

SEQ ID NO: 2447 - DNA, 203 bp, Homo sapiens
ggcgcgccagtccttaattctgtatccttcactctttttctctgcctttttttacttaaaagtaaattcagactcttaaaatggtatagaattattagcttgaacattgaattatctcgtcttaactagaatgttttttaaaaaacagtttttaaatgtttttaaataaacatcttgctagtatgatgcgactcggaccgatg

SEQ ID NO: 2448 - DNA, 203 bp, Homo sapiens
ggcgcgccagtcctcatctgagcctcccaagttgctgggaccacaggcccataccaccatgcctggctaatttttgtagagatgaggtctcactttgttgcccaggctggtcttgaacttctgggctcaagcagtcctcctaccctggcctcccaaagttgtgggattacaggcatgagccactgcaccgactcggaccgatg

SEQ ID NO: 2449 - DNA, 203 bp, Homo sapiens
ggcgcgccagtcctcctaaaggagtcctggaggaggccgttcaccacaggaaactgaggtgttcttagaagggtggatgctggcagatctctactagttagagtctacatttgccttactcatttcaaaagtccacattgcagtctcattttaccagtgatctagcttgataaggacattcataagtacgactcggaccgatg

SEQ ID NO: 2450 - DNA, 203 bp, Homo sapiens
ggcgcgccagtccttcgctccggaagcctgcgagttccggaagccttggtaatccagattcggctaggaaaagacaagctttccagagaatgtttcagagaaagttacgtggagcgtgggcgtttcgcagactcctaagtggtctggaacctaacctgcagtgtctctgagcttctggcaagtatgagcgactcggaccgatg

SEQ ID NO: 2451 - DNA, 203 bp, Homo sapiens
ggcgcgccagtcctgtgtgaattttgtgattggacttttgaaattaggtgggctgattaattttttgattttccttcagaggggaaagtttgcaactttgacagaacgtctcctaggtattcattctgtattttgcaagcctcaaaacatacgtgaagttggctttgaatacatgaatagggaacttccgactcggaccgatg

SEQ ID NO: 2452 - DNA, 203 bp, Homo sapiens
ggcgcgccagtcctctttgaggaaaaaaatgcaccgtgtttaaattcttaatattagtcatcctaagtataccatttatgtatcctttataaggaatgtgctcctagccactgtcttctcctttccaggcatgactgaaatctaatcactggaaaccatgtgattctaaatatattatgtaaatgttacgactcggaccgatg

SEQ ID NO: 2453 - DNA, 203 bp, Homo sapiens
ggcgcgccagtcctgtatgaacagcactatttacaggtctctttctcttgcctttgattcagagctgtcattctcagtaaatattgatagttttattgaaacaaaaggggtctttagcatgggaatagtaacagcagtgcataatcaagataattctgtatccttcactctttttctctgccttttttcgactcggaccgatg

SEQ ID NO: 2454 - DNA, 203 bp, Homo sapiens
ggcgcgccagtccttaagagtattttacatcttaagaatttgccttcttttgccttctgtaattttaaaacattattgtagaaaacaccaacaattcaggaaaaaatataaaatcaactttcccacaattttttgagagagatcatcactatattttactatatttgtagatttgttgcacgtacattcgactcggaccgatg

SEQ ID NO: 2455 - DNA, 203 bp, Homo sapiens
ggcgcgccagtcctatacaaacgtctttgttttttgtttgtttgtttgtttttggtgagaaagggcctcacccagtcacccaggttggagtgcagtggtgtgatcatggctaaccgcagcctttccctcccagggctcaagcgatcctcccatctgagcctcccaagttgctgggaccacaggcccatcgactcggaccgatg

SEQ ID NO: 2456 - DNA, 203 bp, Homo sapiens
ggcgcgccagtccttgacacatagtaaatagaatataatagtagtgctttcctttgctgttgtcagtattactctgagtcggtttcattctcacacagaatgatggccgctagaagctcaaggcttataatctgctagctttctgatcccactggcatgagatactcttgcctaatagttacagctaacgactcggaccgatg

SEQ ID NO: 2457 - DNA, 203 bp, Homo sapiens
ggcgcgccagtcctagtccaggagctcactgttactggtctgccttggattatgtgcacattcctgaaccagccactatagctaggggatggaaaatactgttcctggttacttaaatgtaggtgatgctcctcccatataccacatgaacctaaaggagtcctggaggaggccgttcaccacaggaacgactcggaccgatg

SEQ ID NO: 2458 - DNA, 203 bp, Homo sapiens
ggcgcgccagtcctactgaggtgttcttagaagggtggatgctggcagatctctactagttagagtctacatttgccttactcatttcaaaagtccacattgcagtctcattttaccagtgatctagcttgataaggacattcataagtaactggatgattctttaacattgcagatttgaaaggattcgactcggaccgatg

SEQ ID NO: 2459 - DNA, 203 bp, Homo sapiens
ggcgcgccagtcctcgagccgctcaccccgccgttctcagcgctgcccgaccccgctcgcgcgccctcccgccgccagtcccggcagcgccctcagttgtcctccgactcgccctcggccttccgcgccagccgcagccacagccgcaacgccacccgcagccacagccacagccacagccccaggcacgactcggaccgatg

SEQ ID NO: 2460 - DNA, 203 bp, Homo sapiens
ggcgcgccagtccttagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaacgactcggaccgatg

SEQ ID NO: 2461 - DNA, 203 bp, Homo sapiens
ggcgcgccagtcctggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggacgactcggaccgatg

SEQ ID NO: 2462 - DNA, 203 bp, Homo sapiens
ggcgcgccagtcctagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcgactcggaccgatg

SEQ ID NO: 2463 - DNA, 203 bp, Homo sapiens
ggcgcgccagtccttcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcgactcggaccgatg

SEQ ID NO: 2464 - DNA, 203 bp, Homo sapiens
ggcgcgccagtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccgactcggaccgatg

SEQ ID NO: 2465 - DNA, 203 bp, Homo sapiens
ggcgcgccagtcctcaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggcgactcggaccgatg

SEQ ID NO: 2466 - DNA, 203 bp, Homo sapiens
ggcgcgccagtcctcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcccgactcggaccgatg

SEQ ID NO: 2467 - DNA, 203 bp, Homo sapiens
ggcgcgccagtccttgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgcgactcggaccgatg

SEQ ID NO: 2468 - DNA, 203 bp, Homo sapiens
ggcgcgccagtcctcacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagacgactcggaccgatg

SEQ ID NO: 2469 - DNA, 203 bp, Homo sapiens
ggcgcgccagtcctgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccacgactcggaccgatg

SEQ ID NO: 2470 - DNA, 203 bp, Homo sapiens
ggcgcgccagtcctctcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagcgactcggaccgatg

SEQ ID NO: 2471 - DNA, 203 bp, Homo sapiens
ggcgcgccagtcctaccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggctcgactcggaccgatg

SEQ ID NO: 2472 - DNA, 203 bp, Homo sapiens
ggcgcgccagtcctcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggccgactcggaccgatg

SEQ ID NO: 2473 - DNA, 203 bp, Homo sapiens
ggcgcgccagtcctccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactcgactcggaccgatg

SEQ ID NO: 2474 - DNA, 203 bp, Homo sapiens
ggcgcgccagtccttctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcaccaaaaaaaaaaaaaaacgactcggaccgatg

SEQ ID NO: 2475 - DNA, 203 bp, Homo sapiens
ggcgcgccagtcctggccggccccgggcacgcaggcagggcggcgcaggatccagggcgtctgggatgcagtggagctcagagagaggagaacggctcctcacgcctggggcctgctcttcagaagtccccagcgccgttccttccagatcaggacctcagcagccatgtcgaagccccatagtgaagcgactcggaccgatg

SEQ ID NO: 2476 - DNA, 203 bp, Homo sapiens
ggcgcgccagtcctccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattacgactcggaccgatg

SEQ ID NO: 2477 - DNA, 203 bp, Homo sapiens
ggcgcgccagtcctagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcacgactcggaccgatg

SEQ ID NO: 2478 - DNA, 203 bp, Homo sapiens
ggcgcgccagtccttgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgcgactcggaccgatg

SEQ ID NO: 2479 - DNA, 203 bp, Homo sapiens
ggcgcgccagtcctaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgccgactcggaccgatg

SEQ ID NO: 2480 - DNA, 203 bp, Homo sapiens
ggcgcgccagtccttccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaagcgactcggaccgatg

SEQ ID NO: 2481 - DNA, 203 bp, Homo sapiens
ggcgcgccagtcctgcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctacgactcggaccgatg

SEQ ID NO: 2482 - DNA, 203 bp, Homo sapiens
ggcgcgccagtcctcttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctccgactcggaccgatg

SEQ ID NO: 2483 - DNA, 203 bp, Homo sapiens
ggcgcgccagtccttcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattaccgactcggaccgatg

SEQ ID NO: 2484 - DNA, 203 bp, Homo sapiens
ggcgcgccagtcctcaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgcgactcggaccgatg

SEQ ID NO: 2485 - DNA, 203 bp, Homo sapiens
ggcgcgccagtcctggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgcgactcggaccgatg

SEQ ID NO: 2486 - DNA, 203 bp, Homo sapiens
ggcgcgccagtcctgcgccgcctccttcggcgttcgccccagggaccggcaggcgggggaccgcggcccaggctgaagctcagggccctgtctgctctgtggactcaacagtttgtggcaagacaagctcagaactgagaagctgtcaccacagtagcttggagctcggcggcacaaccagcaccatccgactcggaccgatg

SEQ ID NO: 2487 - DNA, 203 bp, Homo sapiens
ggcgcgccagtccttggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtcgactcggaccgatg

SEQ ID NO: 2488 - DNA, 203 bp, Homo sapiens
ggcgcgccagtcctatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattcgactcggaccgatg

SEQ ID NO: 2489 - DNA, 203 bp, Homo sapiens
ggcgcgccagtcctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacgactcggaccgatg

SEQ ID NO: 2490 - DNA, 203 bp, Homo sapiens
ggcgcgccagtcctgcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtacgactcggaccgatg

SEQ ID NO: 2491 - DNA, 203 bp, Homo sapiens
ggcgcgccagtcctaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatccgactcggaccgatg

SEQ ID NO: 2492 - DNA, 203 bp, Homo sapiens
ggcgcgccagtcctctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgaccgactcggaccgatg

SEQ ID NO: 2493 - DNA, 203 bp, Homo sapiens
ggcgcgccagtcctgtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgacgactcggaccgatg

SEQ ID NO: 2494 - DNA, 203 bp, Homo sapiens
ggcgcgccagtcctaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaacgactcggaccgatg

SEQ ID NO: 2495 - DNA, 203 bp, Homo sapiens
ggcgcgccagtcctatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagcgactcggaccgatg

SEQ ID NO: 2496 - DNA, 203 bp, Homo sapiens
ggcgcgccagtccttctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcacgactcggaccgatg

SEQ ID NO: 2497 - DNA, 203 bp, Homo sapiens
ggcgcgccagtcctcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaaccgactcggaccgatg

SEQ ID NO: 2498 - DNA, 203 bp, Homo sapiens
ggcgcgccagtcctgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaacgactcggaccgatg

SEQ ID NO: 2499 - DNA, 203 bp, Homo sapiens
ggcgcgccagtccttggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggcgactcggaccgatg

SEQ ID NO: 2500 - DNA, 203 bp, Homo sapiens
ggcgcgccagtcctaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttcgactcggaccgatg

SEQ ID NO: 2501 - DNA, 203 bp, Homo sapiens
ggcgcgccagtcctccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcaccgactcggaccgatg

SEQ ID NO: 2502 - DNA, 203 bp, Homo sapiens
ggcgcgccagtcctagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcccgactcggaccgatg

SEQ ID NO: 2503 - DNA, 203 bp, Homo sapiens
ggcgcgccagtcctagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagcgactcggaccgatg

SEQ ID NO: 2504 - DNA, 203 bp, Homo sapiens
ggcgcgccagtcctccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatatcgactcggaccgatg

SEQ ID NO: 2505 - DNA, 203 bp, Homo sapiens
ggcgcgccagtcctggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacggggcgactcggaccgatg

SEQ ID NO: 2506 - DNA, 203 bp, Homo sapiens
ggcgcgccagtcctgagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgcgactcggaccgatg

SEQ ID NO: 2507 - DNA, 203 bp, Homo sapiens
ggcgcgccagtcctcgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacgactcggaccgatg

SEQ ID NO: 2508 - DNA, 203 bp, Homo sapiens
ggcgcgccagtcctcagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgcgactcggaccgatg

SEQ ID NO: 2509 - DNA, 203 bp, Homo sapiens
ggcgcgccagtcctttgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccgactcggaccgatg

SEQ ID NO: 2510 - DNA, 203 bp, Homo sapiens
ggcgcgccagtccttgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaacgactcggaccgatg

SEQ ID NO: 2511 - DNA, 203 bp, Homo sapiens
ggcgcgccagtcctgacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaacgactcggaccgatg

SEQ ID NO: 2512 - DNA, 203 bp, Homo sapiens
ggcgcgccagtcctttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagcgactcggaccgatg

SEQ ID NO: 2513 - DNA, 203 bp, Homo sapiens
ggcgcgccagtcctactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcgactcggaccgatg

SEQ ID NO: 2514 - DNA, 203 bp, Homo sapiens
ggcgcgccagtcctcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttcgactcggaccgatg

SEQ ID NO: 2515 - DNA, 203 bp, Homo sapiens
ggcgcgccagtcctaaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttcccgactcggaccgatg

SEQ ID NO: 2516 - DNA, 203 bp, Homo sapiens
ggcgcgccagtcctgctccagtcctgaaggcggagaagattctgacagagaagatggaaattactgccctcctgtcaagcgagaaagaacatcctctttaacccagttcccaccctcacagtcagaggaaaggagcagtggcttccggttgaagccaccaacgctgatccacggccaagcccccagcgcgactcggaccgatg

SEQ ID NO: 2517 - DNA, 203 bp, Homo sapiens
ggcgcgccagtcctcaggtctgccaagccagaagcccaaggagcagcagcggagcgtgcttcgcccggcagtgttacaagctccgcagccaaaggcgctgtcccagactgtccccagcagtggcaccaacggggtcagcctcccagcagactgcacgggggcagtgcccgcagcatcccctgacactgcgactcggaccgatg

SEQ ID NO: 2518 - DNA, 203 bp, Homo sapiens
ggcgcgccagtccttaaatgagagcgtggacgaagccgacatggagaatgctggacaccccagcgcagacacgccaaccgcaacgaactatttcctccagtatatcagttccagtttagagaactcaaccaatagtgccgacgcctccagcaacaaatttgtatttggccagaacatgagcgagcgagcgactcggaccgatg

SEQ ID NO: 2519 - DNA, 203 bp, Homo sapiens
ggcgcgccagtccttggaagtcatcaccggggaggaggcggagagcaatgtgttacagatgcagtgcaagctgtttgtctttgacaagacctcacagtcctgggtggagagaggccgggggctgctcagactcaatgacatggcgtccaccgatgacggcacactacagtcccgactagtgatgcggacgactcggaccgatg

SEQ ID NO: 2520 - DNA, 203 bp, Homo sapiens
ggcgcgccagtcctcccaggggagcctgcgactgatcctcaacaccaagctgtgggcccagatgcagatcgacaaggccagcgagaagagcattcgcatcacagccatggacaccgaggaccagggcgtgaaggtcttcctgatctcggccagctccaaggacacaggtcagttgtatgcagccctgccgactcggaccgatg

SEQ ID NO: 2521 - DNA, 203 bp, Homo sapiens
ggcgcgccagtcctagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcgactcggaccgatg

SEQ ID NO: 2522 - DNA, 203 bp, Homo sapiens
ggcgcgccagtcctcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacaccgactcggaccgatg

SEQ ID NO: 2523 - DNA, 203 bp, Homo sapiens
ggcgcgccagtcctcaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccgactcggaccgatg

SEQ ID NO: 2524 - DNA, 203 bp, Homo sapiens
ggcgcgccagtcctcagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgactcggaccgatg

SEQ ID NO: 2525 - DNA, 203 bp, Homo sapiens
ggcgcgccagtcctgaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaaaaaaaaaaaaaaacgactcggaccgatg

SEQ ID NO: 2526 - DNA, 203 bp, Homo sapiens
ggcgcgccagtcctggacagtgcgcatctccctggtcaccaaggaccctcctcaccggcctcacccccacgagcttgtaggaaaggactgccgggatggcttctatgaggctgagctctgccgggaccgctgcatccacagtttccagaacctgggaatccagtgtgtgaagaagcgggacctggagccgactcggaccgatg

SEQ ID NO: 2527 - DNA, 203 bp, Homo sapiens
ggcgcgccagtcctaggctatcagtcagcgcatccagaccaacaacaaccccttccaagttcctatagaagagcagcgtggggactacgacctgaatgctgtgcggctctgcttccaggtgacagtgcgggacccatcaggcaggcccctccgcctgccgcctgtcctttctcatcccatctttgacacgactcggaccgatg

SEQ ID NO: 2528 - DNA, 203 bp, Homo sapiens
ggcgcgccagtcctatcgtgcccccaacactgccgagctcaagatctgccgagtgaaccgaaactctggcagctgcctcggtggggatgagatcttcctactgtgtgacaaggtgcagaaagaggacattgaggtgtatttcacgggaccaggctgggaggcccgaggctccttttcgcaagctgatgcgactcggaccgatg

SEQ ID NO: 2529 - DNA, 203 bp, Homo sapiens
ggcgcgccagtcctctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagccgactcggaccgatg

SEQ ID NO: 2530 - DNA, 203 bp, Homo sapiens
ggcgcgccagtcctagctgctgaaccagggcatacctgtggccccccacacaactgagcccatgctgatggagtaccctgaggctataactcgcctagtgacaggggcccagaggccccccgacccagctcctgctccactgggggccccggggctccccaatggcctcctttcaggagatgaagactcgactcggaccgatg

SEQ ID NO: 2531 - DNA, 203 bp, Homo sapiens
ggcgcgccagtcctccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcgactcggaccgatg

SEQ ID NO: 2532 - DNA, 203 bp, Homo sapiens
ggcgcgccagtcctaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctcgactcggaccgatg

SEQ ID NO: 2533 - DNA, 203 bp, Homo sapiens
ggcgcgccagtcctcaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggcgactcggaccgatg

SEQ ID NO: 2534 - DNA, 203 bp, Homo sapiens
ggcgcgccagtcctactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccacgactcggaccgatg

SEQ ID NO: 2535 - DNA, 203 bp, Homo sapiens
ggcgcgccagtcctaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattcgactcggaccgatg

SEQ ID NO: 2536 - DNA, 203 bp, Homo sapiens
ggcgcgccagtcctgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactcgactcggaccgatg

SEQ ID NO: 2537 - DNA, 203 bp, Homo sapiens
ggcgcgccagtccttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatcgactcggaccgatg

SEQ ID NO: 2538 - DNA, 203 bp, Homo sapiens
ggcgcgccagtcctctctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacgcgactcggaccgatg

SEQ ID NO: 2539 - DNA, 203 bp, Homo sapiens
ggcgcgccagtccttgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagccgactcggaccgatg

SEQ ID NO: 2540 - DNA, 203 bp, Homo sapiens
ggcgcgccagtccttctcgctgctgcccgagtcagggctgagtcacccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggacgactcggaccgatg

SEQ ID NO: 2541 - DNA, 203 bp, Homo sapiens
ggcgcgccagtcctctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgctcgactcggaccgatg

SEQ ID NO: 2542 - DNA, 203 bp, Homo sapiens
ggcgcgccagtccttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggcgactcggaccgatg

SEQ ID NO: 2543 - DNA, 203 bp, Homo sapiens
ggcgcgccagtccttccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctccgactcggaccgatg

SEQ ID NO: 2544 - DNA, 203 bp, Homo sapiens
ggcgcgccagtccttctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgcgactcggaccgatg

SEQ ID NO: 2545 - DNA, 203 bp, Homo sapiens
ggcgcgccagtcctggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgcgactcggaccgatg

SEQ ID NO: 2546 - DNA, 203 bp, Homo sapiens
ggcgcgccagtcctccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccgcgactcggaccgatg

SEQ ID NO: 2547 - DNA, 203 bp, Homo sapiens
ggcgcgccagtcctgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtcgactcggaccgatg

SEQ ID NO: 2548 - DNA, 203 bp, Homo sapiens
ggcgcgccagtcctatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagcgactcggaccgatg

SEQ ID NO: 2549 - DNA, 203 bp, Homo sapiens
ggcgcgccagtccttggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatcccgactcggaccgatg

SEQ ID NO: 2550 - DNA, 203 bp, Homo sapiens
ggcgcgccagtcctaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagccttcgactcggaccgatg

SEQ ID NO: 2551 - DNA, 203 bp, Homo sapiens
ggcgcgccagtccttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaacgactcggaccgatg

SEQ ID NO: 2552 - DNA, 203 bp, Homo sapiens
ggcgcgccagtccttctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagcgactcggaccgatg

SEQ ID NO: 2553 - DNA, 203 bp, Homo sapiens
ggcgcgccagtcctttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaacgactcggaccgatg

SEQ ID NO: 2554 - DNA, 203 bp, Homo sapiens
ggcgcgccagtcctaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccacgactcggaccgatg

SEQ ID NO: 2555 - DNA, 203 bp, Homo sapiens
ggcgcgccagtcctcctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagcgactcggaccgatg

SEQ ID NO: 2556 - DNA, 203 bp, Homo sapiens
ggcgcgccagtccttgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcgactcggaccgatg

SEQ ID NO: 2557 - DNA, 203 bp, Homo sapiens
ggcgcgccagtccttatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatcgactcggaccgatg

SEQ ID NO: 2558 - DNA, 203 bp, Homo sapiens
ggcgcgccagtcctttttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcagcgactcggaccgatg

SEQ ID NO: 2559 - DNA, 203 bp, Homo sapiens
ggcgcgccagtcctttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtcgactcggaccgatg

SEQ ID NO: 2560 - DNA, 203 bp, Homo sapiens
ggcgcgccagtcctgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctcgactcggaccgatg

SEQ ID NO: 2561 - DNA, 203 bp, Homo sapiens
ggcgcgccagtcctatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctggcgactcggaccgatg

SEQ ID NO: 2562 - DNA, 203 bp, Homo sapiens
ggcgcgccagtcctgagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgtcgactcggaccgatg

SEQ ID NO: 2563 - DNA, 203 bp, Homo sapiens
ggcgcgccagtcctagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgccgactcggaccgatg

SEQ ID NO: 2564 - DNA, 203 bp, Homo sapiens
ggcgcgccagtcctaatctaggctgactcctccaacaatgccacctcccccaactactcaaggagctccaagaaccagttcatttacaccgacaacgttaactaatggcacgagccattctcctacagccttgaatggcgccccctcaccacccaatggcttcagcaatgggccttcctcttcttcctcgactcggaccgatg

SEQ ID NO: 2565 - DNA, 203 bp, Homo sapiens
ggcgcgccagtcctcctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaagcgactcggaccgatg

SEQ ID NO: 2566 - DNA, 203 bp, Homo sapiens
ggcgcgccagtcctaatttcattccaaactgcaagaagctactaacttcccactgagaccttttgtcatcccatttttgaaggccaacttgcccctgctgcagcgtgagctcctccactgcgcaagactggccaaacagaaccctgcccagtacctcgcccagcatgaacagctgcttctggatgccacgactcggaccgatg

SEQ ID NO: 2567 - DNA, 203 bp, Homo sapiens
ggcgcgccagtcctacggcttatcctaccagcccaatggcctgcctcaccctaccccacctccacctcagcattaccgtttggatgatatggccattgcccaccactacagggactcctatcgacaccccagccacagggacctcagggacagaaacagacctatggggttgcatggcacacgtcaagcgactcggaccgatg

SEQ ID NO: 2568 - DNA, 203 bp, Homo sapiens
ggcgcgccagtcctaagaaatgattgatcacagactaacagacagagaatgggcagaagagtggaaacatcttgaccatctgttaaactgcataatggacatggtagaaaaaacaaggcgatctctcaccgtactaaggcggtgtcaagaagcagaccgggaagaattgaattactggatccggcggtcgactcggaccgatg

SEQ ID NO: 2569 - DNA, 203 bp, Homo sapiens
ggcgcgccagtcctacagtgacgccgaggacttaaaaaaaggtggcggcagtagcagcagccactctaggcagcagagtcccgtcaacccagacccagttgcactagacgcgcatcgggaattccttcacaggcctgcgtctggatacgtgccagaggagatctggaagaaagctgaggaggccgtcacgactcggaccgatg

SEQ ID NO: 2570 - DNA, 203 bp, Homo sapiens
ggcgcgccagtccttgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgacgactcggaccgatg

SEQ ID NO: 2571 - DNA, 203 bp, Homo sapiens
ggcgcgccagtcctaaagggaagtcagccaaagactgatctgatggaccaaaatcggaattttgaaaagcaccagtactactttccaaatgatcagcaggttaaacatgttcagcaaggtatagtatgaatccattaacccttcgttgtccagggtccagaccagaactacttgttagttttgaaaaccgactcggaccgatg

SEQ ID NO: 2572 - DNA, 203 bp, Homo sapiens
ggcgcgccagtcctaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactcgactcggaccgatg

SEQ ID NO: 2573 - DNA, 203 bp, Homo sapiens
ggcgcgccagtccttacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctaccgactcggaccgatg

SEQ ID NO: 2574 - DNA, 203 bp, Homo sapiens
ggcgcgccagtccttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctccgactcggaccgatg

SEQ ID NO: 2575 - DNA, 203 bp, Homo sapiens
ggcgcgccagtcctgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggcgactcggaccgatg

SEQ ID NO: 2576 - DNA, 203 bp, Homo sapiens
ggcgcgccagtcctaataaaaaagttgaaaaaaatctggatcctctgtctccctcgtccccggtgtgccatggttgcccaccagtgaccccagcctgaggagtccatcctccatggtgctgaatcaaatctgtagagtttattcagctacaaagcgtggctctgtaacaggagttggcttatccatgccgactcggaccgatg

SEQ ID NO: 2577 - DNA, 203 bp, Homo sapiens
ggcgcgccagtcctgtgttgagtagggaatgatgtcagaactttgcaaaagtcgagctcattcataaggggatgtttctcaggcaggaggagtaggaagagtgggaggagaattactaccttccataggaaaggagagcttggcttgcctagattagctgctgcatagatagcagaggcccttttggccgactcggaccgatg

SEQ ID NO: 2578 - DNA, 203 bp, Homo sapiens
ggcgcgccagtcctaaggtgaatgctggttacatgggagggtgacttggagccctctagtttccttcttgtgccagctgggttcctgtttcaaggccaggcttctctaacttgtcttcctgggaaatgtagcttttccaagaatttggtagtgcacaccaggaaaaactaggtatcagaacagattttcgactcggaccgatg

SEQ ID NO: 2579 - DNA, 203 bp, Homo sapiens
ggcgcgccagtcctccctcctgcctgtccctttctgtcttctctctctctctcccacttttcctccctctcccgctccgtctcacacgcaccctctgtttattttcctgcctccatctgggccctgctgatattgtaatcaccctgatgcacgttggcttctctcctctccctcctgcgctcacacaccgactcggaccgatg

SEQ ID NO: 2580 - DNA, 203 bp, Homo sapiens
ggcgcgccagtcctactcagcaagctgaaaaggttccttactaccctgcagcagtttggcaatgacatttcacccgagataggagaaagagttcgcaccctcgttctgggactagtgaactccactttgacaattgaagaatttcattccaaactgcaagaagctactaacttcccactgagacctttcgactcggaccgatg

SEQ ID NO: 2581 - DNA, 203 bp, Homo sapiens
ggcgcgccagtccttgtcatcccatttttgaaggccaacttgcccctgctgcagcgtgagctcctccactgcgcaagactggccaaacagaaccctgcccagtacctcgcccagcatgaacagctgcttctggatgccagcaccacctcacctgttgactcctcagagctgcttctcgatgtgaacgacgactcggaccgatg

SEQ ID NO: 2582 - DNA, 203 bp, Homo sapiens
ggcgcgccagtcctaaacgggaagaggcgaactccagacagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctcccgactcggaccgatg

SEQ ID NO: 2583 - DNA, 203 bp, Homo sapiens
ggcgcgccagtcctggcggagcggaaagcccacgacatgatcacaacagagagggccaagatggagcgcacggtcgccgaggccaaacggcaggcggcggaggacgcactggcagttatcaatcagcaggaggattcaagcgagagttgctggaattgtggccgtaaagcgagtgaaacctgcagtggcgactcggaccgatg

SEQ ID NO: 2584 - DNA, 203 bp, Homo sapiens
ggcgcgccagtcctctgtaacacagcccgatactgtggctcattttgccagcacaaagactgggagaagcaccatcacatctgtggacagaccctgcaggcccagcagcagggagacacacctgcagtcagctcctctgtcacgcccaacagcggggctgggagcccgatggacacaccaccagcagccgactcggaccgatg

SEQ ID NO: 2585 - DNA, 203 bp, Homo sapiens
ggcgcgccagtcctggctgtgtagacaaccaaagtttacaaggctgggaagacacttctccaaatacatatacaccaggcatttctttaaaatcaaaaacaatccattagctttggggcggggggtggggggagggttaaatgtaggccttggaaacagttttaagtggcttttaagtatctgcatagcgactcggaccgatg

SEQ ID NO: 2586 - DNA, 203 bp, Homo sapiens
ggcgcgccagtcctttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggcgactcggaccgatg

SEQ ID NO: 2587 - DNA, 203 bp, Homo sapiens
ggcgcgccagtcctctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacacgactcggaccgatg

SEQ ID NO: 2588 - DNA, 203 bp, Homo sapiens
ggcgcgccagtcctaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcgactcggaccgatg

SEQ ID NO: 2589 - DNA, 203 bp, Homo sapiens
ggcgcgccagtcctataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtctttttttcgactcggaccgatg

SEQ ID NO: 2590 - DNA, 203 bp, Homo sapiens
ggcgcgccagtccttgtgccatggttgcccaccagtgaccccagcctgaggagtccatcctccatggtgctgaatcaaatctgtagagtttattcagctacaaagcgtggctctgtaacaggagttggcttatccatgcgtgttgagtagggaatgatgtcagaactttgcaaaagtcgagctcattccgactcggaccgatg

SEQ ID NO: 2591 - DNA, 203 bp, Homo sapiens
ggcgcgccagtcctataaggggatgtttctcaggcaggaggagtaggaagagtgggaggagaattactaccttccataggaaaggagagcttggcttgcctagattagctgctgcatagatagcagaggcccttttggctgtgttttgataaaattagaaatgagtacctaaatctggatcactctgccgactcggaccgatg

SEQ ID NO: 2592 - DNA, 203 bp, Homo sapiens
ggcgcgccagtccttcagagaggttcgtgccaacctcatgaggctctgactcttgtcaggttgcttggctgccttgtgcatacccgaatggcagatcagctgacatgacatggaactgctctatctgccttgtcccctctcctctaattaaaagtcgctaccattgtcactcttggttatgtagttaacgactcggaccgatg

SEQ ID NO: 2593 - DNA, 203 bp, Homo sapiens
ggcgcgccagtccttatccactgtggctatctccaacttgctgggacatccagttatctcctctgacacatattttttcattctctagttacaaagtttgttagagtttgaaaaacaaacccttctcccctaccctgtgaatgctgttagtttttatgtgtagttttcaaaacacagattatcttatacgactcggaccgatg

SEQ ID NO: 2594 - DNA, 203 bp, Homo sapiens
ggcgcgccagtcctttatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccacgactcggaccgatg

SEQ ID NO: 2595 - DNA, 203 bp, Homo sapiens
ggcgcgccagtcctacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaacgactcggaccgatg

SEQ ID NO: 2596 - DNA, 203 bp, Homo sapiens
ggcgcgccagtcctaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgtcgactcggaccgatg

SEQ ID NO: 2597 - DNA, 203 bp, Homo sapiens
ggcgcgccagtccttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggcgactcggaccgatg

SEQ ID NO: 2598 - DNA, 203 bp, Homo sapiens
ggcgcgccagtcctgcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgactcggaccgatg

SEQ ID NO: 2599 - DNA, 203 bp, Homo sapiens
ggcgcgccagtcctcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcgcgactcggaccgatg

SEQ ID NO: 2600 - DNA, 203 bp, Homo sapiens
ggcgcgccagtcctatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttcgactcggaccgatg

SEQ ID NO: 2601 - DNA, 203 bp, Homo sapiens
ggcgcgccagtccttttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtcgactcggaccgatg

SEQ ID NO: 2602 - DNA, 203 bp, Homo sapiens
ggcgcgccagtcctgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgcgactcggaccgatg

SEQ ID NO: 2603 - DNA, 203 bp, Homo sapiens
ggcgcgccagtcctagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggcgactcggaccgatg

SEQ ID NO: 2604 - DNA, 203 bp, Homo sapiens
ggcgcgccagtcctaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcatcgactcggaccgatg

SEQ ID NO: 2605 - DNA, 203 bp, Homo sapiens
ggcgcgccagtcctaccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaacgactcggaccgatg

SEQ ID NO: 2606 - DNA, 203 bp, Homo sapiens
ggcgcgccagtcctacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggcgactcggaccgatg

SEQ ID NO: 2607 - DNA, 203 bp, Homo sapiens
ggcgcgccagtcctccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagccgactcggaccgatg

SEQ ID NO: 2608 - DNA, 203 bp, Homo sapiens
ggcgcgccagtccttccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggaccgactcggaccgatg

SEQ ID NO: 2609 - DNA, 203 bp, Homo sapiens
ggcgcgccagtccttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaacgactcggaccgatg

SEQ ID NO: 2610 - DNA, 203 bp, Homo sapiens
ggcgcgccagtccttttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaacgactcggaccgatg

SEQ ID NO: 2611 - DNA, 203 bp, Homo sapiens
ggcgcgccagtcctgtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattccgactcggaccgatg

SEQ ID NO: 2612 - DNA, 203 bp, Homo sapiens
ggcgcgccagtcctacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaacgactcggaccgatg

SEQ ID NO: 2613 - DNA, 203 bp, Homo sapiens
ggcgcgccagtccttgaggcatgagtaggggctgtatttgcgtgcaggcgggcccccaaagcttccactcgctgccttaaaacgccaacccagcctctcagacaatgctgccctcccactatgtactctaccacctatgaagagaggaatatcaccggaaccagggtgaaggtgcccgtggggcaggacgactcggaccgatg

SEQ ID NO: 2614 - DNA, 203 bp, Homo sapiens
ggcgcgccagtcctggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcgactcggaccgatg

SEQ ID NO: 2615 - DNA, 203 bp, Homo sapiens
ggcgcgccagtcctcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtcgactcggaccgatg

SEQ ID NO: 2616 - DNA, 203 bp, Homo sapiens
ggcgcgccagtcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgacgactcggaccgatg

SEQ ID NO: 2617 - DNA, 203 bp, Homo sapiens
ggcgcgccagtcctgtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttccgactcggaccgatg

SEQ ID NO: 2618 - DNA, 203 bp, Homo sapiens
ggcgcgccagtccttgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtcgactcggaccgatg

SEQ ID NO: 2619 - DNA, 203 bp, Homo sapiens
ggcgcgccagtcctcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccgactcggaccgatg

SEQ ID NO: 2620 - DNA, 203 bp, Homo sapiens
ggcgcgccagtcctcaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggcgactcggaccgatg

SEQ ID NO: 2621 - DNA, 203 bp, Homo sapiens
ggcgcgccagtcctcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggcgactcggaccgatg

SEQ ID NO: 2622 - DNA, 203 bp, Homo sapiens
ggcgcgccagtcctagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgactcggaccgatg

SEQ ID NO: 2623 - DNA, 203 bp, Homo sapiens
ggcgcgccagtccttcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatcccgactcggaccgatg

SEQ ID NO: 2624 - DNA, 203 bp, Homo sapiens
ggcgcgccagtcctctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggcgactcggaccgatg

SEQ ID NO: 2625 - DNA, 203 bp, Homo sapiens
ggcgcgccagtccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttcgactcggaccgatg

SEQ ID NO: 2626 - DNA, 203 bp, Homo sapiens
ggcgcgccagtcctaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccacgactcggaccgatg

SEQ ID NO: 2627 - DNA, 203 bp, Homo sapiens
ggcgcgccagtcctaccgcatcggcgaccttcaggccttccagggccacggcgcgggcaacctggcgggtctgaaggggcgtctcgattacctgagctctctgaaggtgaagggccttgtgctgggtccaattcacaagaaccagaaggatgatgtcgctcagactgacttgctgcagatcgaccccacgactcggaccgatg

SEQ ID NO: 2628 - DNA, 203 bp, Homo sapiens
ggcgcgccagtcctattttggctccaaggaagattttgacagtctcttgcaatcggctaaaaaaaagagcatccgtgtcattctggaccttactcccaactaccggggtgagaactcgtggttctccactcaggttgacactgtggccaccaaggtgaaggatgctctggagttttggctgcaagctgcgactcggaccgatg

SEQ ID NO: 2629 - DNA, 203 bp, Homo sapiens
ggcgcgccagtccttcttcaccctgccagggacccctgttttcagctacggggatgagattggcctggatgcagctgcccttcctggacagcctatggaggctccagtcatgctgtgggatgagtccagcttccctgacatcccaggggctgtaagtgccaacatgactgtgaagggccagagtgaagcgactcggaccgatg

SEQ ID NO: 2630 - DNA, 203 bp, Homo sapiens
ggcgcgccagtcctgacttcagcctgacatggacccactacccttctcctttccttcccaggccctttggcttctgatttttctcttttttaaaaacaaacaaacaaactgttgcagattatgagtgaacccccaaatagggtgttttctgccttcaaataaaagtcacccctgcatggtgaagtcttcgactcggaccgatg

SEQ ID NO: 2631 - DNA, 203 bp, Homo sapiens
ggcgcgccagtcctagttccagggaaggagggcgtagacaaagcgccacctgaacttgcggcgcgaaaaaggcgcgcatgcgtcctacgggagcgtgctggctcaccgaccgcattgcggcttggttttctcacccagtgcatgtggcaggagcggtgagatcactgcctcacggcgatcctggactgcgactcggaccgatg

SEQ ID NO: 2632 - DNA, 203 bp, Homo sapiens
ggcgcgccagtcctacggtcacgactgcctaccctctaaccctgttctgagctgccccttgcccacacaccccaaacctgtgtgcaggatccgcctccatggagctacagcctcctgaagcctcgatcgccgtcgtgtcgattccgcgccagttgcctggctcacattcggaggctggtgtccagggtcgactcggaccgatg

SEQ ID NO: 2633 - DNA, 203 bp, Homo sapiens
ggcgcgccagtcctctcagcgcgggggacgactcagagacggggtctgactgtgttacccaggctggtcttcaactcttggcctcaagtgatcctcctgccttagcttccaagaatgctgaggttacagtagaaacggggtttcaccatgttagccaggctgatattgaattcctgacctcaattgatcgactcggaccgatg

SEQ ID NO: 2634 - DNA, 203 bp, Homo sapiens
ggcgcgccagtcctatcaaggtggcggaagacgaggcggaggcggcagccgcggctaagttcacgggcctgtccaaggaggagctgctgaaggtggcaggcagccccggctgggtacgcacccgctgggcactgctgctgctcttctggctcggctggctcggcatgcttgctggtgccgtggtcatacgactcggaccgatg

SEQ ID NO: 2635 - DNA, 203 bp, Homo sapiens
ggcgcgccagtcctatcgtgcgagcgccgcgttgtcgcgagctaccggcgcagaagtggtggcacacgggcgccctctaccgcatcggcgaccttcaggccttccagggccacggcgcgggcaacctggcgggtctgaaggggcgtctcgattacctgagctctctgaaggtgaagggccttgtgctgcgactcggaccgatg

SEQ ID NO: 2636 - DNA, 203 bp, Homo sapiens
ggcgcgccagtcctaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcgactcggaccgatg

SEQ ID NO: 2637 - DNA, 203 bp, Homo sapiens
ggcgcgccagtcctcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggcccgactcggaccgatg

SEQ ID NO: 2638 - DNA, 203 bp, Homo sapiens
ggcgcgccagtcctgagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatccgactcggaccgatg

SEQ ID NO: 2639 - DNA, 203 bp, Homo sapiens
ggcgcgccagtcctgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaacgactcggaccgatg

SEQ ID NO: 2640 - DNA, 203 bp, Homo sapiens
ggcgcgccagtcctaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctccgactcggaccgatg

SEQ ID NO: 2641 - DNA, 203 bp, Homo sapiens
ggcgcgccagtcctatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgactcggaccgatg

SEQ ID NO: 2642 - DNA, 203 bp, Homo sapiens
ggcgcgccagtcctgcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattcgactcggaccgatg

SEQ ID NO: 2643 - DNA, 203 bp, Homo sapiens
ggcgcgccagtcctcgagacgcccattctgcccccggccccgcgcggaggggcgggggaggcgccgggaagtcgacggcgccggcggctcctgcgtctcgcccttttgcccaggctagagtgcagtggtgcggtcatggttcactgcagcctcaacctcctggactcagcaggaggccactgtctgcacgactcggaccgatg

SEQ ID NO: 2644 - DNA, 203 bp, Homo sapiens
ggcgcgccagtcctggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccacgactcggaccgatg

SEQ ID NO: 2645 - DNA, 203 bp, Homo sapiens
ggcgcgccagtcctaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatccgactcggaccgatg

SEQ ID NO: 2646 - DNA, 203 bp, Homo sapiens
ggcgcgccagtcctatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagaccgactcggaccgatg

SEQ ID NO: 2647 - DNA, 203 bp, Homo sapiens
ggcgcgccagtcctcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaacgactcggaccgatg

SEQ ID NO: 2648 - DNA, 203 bp, Homo sapiens
ggcgcgccagtcctcacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccgactcggaccgatg

SEQ ID NO: 2649 - DNA, 203 bp, Homo sapiens
ggcgcgccagtcctcgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtcgactcggaccgatg

SEQ ID NO: 2650 - DNA, 203 bp, Homo sapiens
ggcgcgccagtccttttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaatacgactcggaccgatg

SEQ ID NO: 2651 - DNA, 203 bp, Homo sapiens
ggcgcgccagtcctcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccacgactcggaccgatg

SEQ ID NO: 2652 - DNA, 203 bp, Homo sapiens
ggcgcgccagtcctgaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaacgactcggaccgatg

SEQ ID NO: 2653 - DNA, 203 bp, Homo sapiens
ggcgcgccagtcctaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccacgactcggaccgatg

SEQ ID NO: 2654 - DNA, 203 bp, Homo sapiens
ggcgcgccagtcctctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatcgactcggaccgatg

SEQ ID NO: 2655 - DNA, 203 bp, Homo sapiens
ggcgcgccagtcctgcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttcgactcggaccgatg

SEQ ID NO: 2656 - DNA, 203 bp, Homo sapiens
ggcgcgccagtcctatcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatcttcgactcggaccgatg

SEQ ID NO: 2657 - DNA, 203 bp, Homo sapiens
ggcgcgccagtcctaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgcgactcggaccgatg

SEQ ID NO: 2658 - DNA, 203 bp, Homo sapiens
ggcgcgccagtcctttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtcccgactcggaccgatg

SEQ ID NO: 2659 - DNA, 203 bp, Homo sapiens
ggcgcgccagtcctatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagccgactcggaccgatg

SEQ ID NO: 2660 - DNA, 203 bp, Homo sapiens
ggcgcgccagtcctgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgactcggaccgatg

SEQ ID NO: 2661 - DNA, 203 bp, Homo sapiens
ggcgcgccagtcctcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagaccgactcggaccgatg

SEQ ID NO: 2662 - DNA, 203 bp, Homo sapiens
ggcgcgccagtcctgcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgacccgactcggaccgatg

SEQ ID NO: 2663 - DNA, 203 bp, Homo sapiens
ggcgcgccagtcctagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctacgactcggaccgatg

SEQ ID NO: 2664 - DNA, 203 bp, Homo sapiens
ggcgcgccagtcctgagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaagcgactcggaccgatg

SEQ ID NO: 2665 - DNA, 203 bp, Homo sapiens
ggcgcgccagtcctgacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccgactcggaccgatg

SEQ ID NO: 2666 - DNA, 203 bp, Homo sapiens
ggcgcgccagtcctcaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgactcggaccgatg

SEQ ID NO: 2667 - DNA, 203 bp, Homo sapiens
ggcgcgccagtcctcgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccaccgactcggaccgatg

SEQ ID NO: 2668 - DNA, 203 bp, Homo sapiens
ggcgcgccagtcctctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcgcgactcggaccgatg

SEQ ID NO: 2669 - DNA, 203 bp, Homo sapiens
ggcgcgccagtcctgagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggcgactcggaccgatg

SEQ ID NO: 2670 - DNA, 203 bp, Homo sapiens
ggcgcgccagtcctctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccgactcggaccgatg

SEQ ID NO: 2671 - DNA, 203 bp, Homo sapiens
ggcgcgccagtcctcagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcgactcggaccgatg

SEQ ID NO: 2672 - DNA, 203 bp, Homo sapiens
ggcgcgccagtcctgagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcccgactcggaccgatg

SEQ ID NO: 2673 - DNA, 203 bp, Homo sapiens
ggcgcgccagtcctgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttcgactcggaccgatg

SEQ ID NO: 2674 - DNA, 203 bp, Homo sapiens
ggcgcgccagtcctctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctcgactcggaccgatg

SEQ ID NO: 2675 - DNA, 203 bp, Homo sapiens
ggcgcgccagtcctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgcccgactcggaccgatg

SEQ ID NO: 2676 - DNA, 203 bp, Homo sapiens
ggcgcgccagtcctcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtccgactcggaccgatg

SEQ ID NO: 2677 - DNA, 203 bp, Homo sapiens
ggcgcgccagtccttgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaacgactcggaccgatg

SEQ ID NO: 2678 - DNA, 203 bp, Homo sapiens
ggcgcgccagtccttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgcccgactcggaccgatg

SEQ ID NO: 2679 - DNA, 203 bp, Homo sapiens
ggcgcgccagtccttatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatccgactcggaccgatg

SEQ ID NO: 2680 - DNA, 203 bp, Homo sapiens
ggcgcgccagtcctatcaaagctttctcttaactctcttacctctaggcaaactgagacctcaccatcctctcccctgcttcccacgacagtcctttgcccttgccatgctcagggttggaatcaagttgttctattctcaacagaccaaaatgtttagttaaggcaaagtatcttggaaacaattgtcgactcggaccgatg

SEQ ID NO: 2681 - DNA, 203 bp, Homo sapiens
ggcgcgccagtcctgattaattacagtcttgtactcttgacaaagctgtgcagatggcaataagttcataccagcaatcctggagtcccataataaatacgtacatgtggaacatcgtgcacataatttcaacagttcgcagatctgtagttatgaagccagggtttggtggtatttgctctctcttgcgactcggaccgatg

SEQ ID NO: 2682 - DNA, 203 bp, Homo sapiens
ggcgcgccagtcctttcttccactatcatgttttttgaggattttgcatatttcttgttgccataatgctgtgctattttaccctgattttcagtgatacaatatgggtgacaatactggcccctccataaatctgaagagtaagaagtagtgaaaataaggcttaggatatgaaatggcgttgtcaccgactcggaccgatg

SEQ ID NO: 2683 - DNA, 203 bp, Homo sapiens
ggcgcgccagtcctttgaatcaaggccactttttgtcctacttgagcatctcaagttgggatgcatcttctgatggcacttccggaactggctgtggtttttttgggtgtaccgagagtgccagtgactgtgcttcttacaattcctggcatcttgagtaggtgaaacactgtatcagactgggtgatcgactcggaccgatg

SEQ ID NO: 2684 - DNA, 203 bp, Homo sapiens
ggcgcgccagtcctggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaacgactcggaccgatg

SEQ ID NO: 2685 - DNA, 203 bp, Homo sapiens
ggcgcgccagtcctttagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttcgactcggaccgatg

SEQ ID NO: 2686 - DNA, 203 bp, Homo sapiens
ggcgcgccagtcctccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaagatgagcgtgaagccgtgcagaagaagaccgactcggaccgatg

SEQ ID NO: 2687 - DNA, 203 bp, Homo sapiens
ggcgcgccagtcctcttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacgactcggaccgatg

SEQ ID NO: 2688 - DNA, 203 bp, Homo sapiens
ggcgcgccagtccttgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagacgactcggaccgatg

SEQ ID NO: 2689 - DNA, 203 bp, Homo sapiens
ggcgcgccagtcctactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgacgactcggaccgatg

SEQ ID NO: 2690 - DNA, 203 bp, Homo sapiens
ggcgcgccagtcctggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcgcgactcggaccgatg

SEQ ID NO: 2691 - DNA, 203 bp, Homo sapiens
ggcgcgccagtcctagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcgactcggaccgatg

SEQ ID NO: 2692 - DNA, 203 bp, Homo sapiens
ggcgcgccagtcctcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccgactcggaccgatg

SEQ ID NO: 2693 - DNA, 203 bp, Homo sapiens
ggcgcgccagtcctgcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtgcgactcggaccgatg

SEQ ID NO: 2694 - DNA, 203 bp, Homo sapiens
ggcgcgccagtcctgcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacgactcggaccgatg

SEQ ID NO: 2695 - DNA, 203 bp, Homo sapiens
ggcgcgccagtcctcgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctcgactcggaccgatg

SEQ ID NO: 2696 - DNA, 203 bp, Homo sapiens
ggcgcgccagtcctggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacgactcggaccgatg

SEQ ID NO: 2697 - DNA, 203 bp, Homo sapiens
ggcgcgccagtcctttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggctcgactcggaccgatg

SEQ ID NO: 2698 - DNA, 203 bp, Homo sapiens
ggcgcgccagtcctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgcgactcggaccgatg

SEQ ID NO: 2699 - DNA, 203 bp, Homo sapiens
ggcgcgccagtcctctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagcgactcggaccgatg

SEQ ID NO: 2700 - DNA, 203 bp, Homo sapiens
ggcgcgccagtcctacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaaccgactcggaccgatg

SEQ ID NO: 2701 - DNA, 203 bp, Homo sapiens
ggcgcgccagtccttttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagacgactcggaccgatg

SEQ ID NO: 2702 - DNA, 203 bp, Homo sapiens
ggcgcgccagtcctgtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttcccgactcggaccgatg

SEQ ID NO: 2703 - DNA, 203 bp, Homo sapiens
ggcgcgccagtcctgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtcgactcggaccgatg

SEQ ID NO: 2704 - DNA, 203 bp, Homo sapiens
ggcgcgccagtcctagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaacgactcggaccgatg

SEQ ID NO: 2705 - DNA, 203 bp, Homo sapiens
ggcgcgccagtcctggggggaggtgctagcagggccagccttgaactcgctggacagagctacagacctatggggcctggaagtgcccgctgagaaagggagaagacagcagaggggttgccgaggtgaggggttgcctccgaggcaacctccaagtcccagatcatgtctctgtggggtctggtctccgactcggaccgatg

SEQ ID NO: 2706 - DNA, 203 bp, Homo sapiens
ggcgcgccagtcctcaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggccgactcggaccgatg

SEQ ID NO: 2707 - DNA, 203 bp, Homo sapiens
ggcgcgccagtcctctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaacgactcggaccgatg

SEQ ID NO: 2708 - DNA, 203 bp, Homo sapiens
ggcgcgccagtcctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcacgactcggaccgatg

SEQ ID NO: 2709 - DNA, 203 bp, Homo sapiens
ggcgcgccagtcctggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcgactcggaccgatg

SEQ ID NO: 2710 - DNA, 203 bp, Homo sapiens
ggcgcgccagtcctctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtcgactcggaccgatg

SEQ ID NO: 2711 - DNA, 203 bp, Homo sapiens
ggcgcgccagtcctgagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacgactcggaccgatg

SEQ ID NO: 2712 - DNA, 203 bp, Homo sapiens
ggcgcgccagtcctcatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcgactcggaccgatg

SEQ ID NO: 2713 - DNA, 203 bp, Homo sapiens
ggcgcgccagtcctaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgcgactcggaccgatg

SEQ ID NO: 2714 - DNA, 203 bp, Homo sapiens
ggcgcgccagtcctctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggccgactcggaccgatg

SEQ ID NO: 2715 - DNA, 203 bp, Homo sapiens
ggcgcgccagtcctacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagccgactcggaccgatg

SEQ ID NO: 2716 - DNA, 203 bp, Homo sapiens
ggcgcgccagtcctagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacaccccaacacgactcggaccgatg

SEQ ID NO: 2717 - DNA, 203 bp, Homo sapiens
ggcgcgccagtccttgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttcgactcggaccgatg

SEQ ID NO: 2718 - DNA, 203 bp, Homo sapiens
ggcgcgccagtccttgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaacgactcggaccgatg

SEQ ID NO: 2719 - DNA, 203 bp, Homo sapiens
ggcgcgccagtcctttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggcgactcggaccgatg

SEQ ID NO: 2720 - DNA, 203 bp, Homo sapiens
ggcgcgccagtcctagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcgactcggaccgatg

SEQ ID NO: 2721 - DNA, 203 bp, Homo sapiens
ggcgcgccagtcctccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcgactcggaccgatg

SEQ ID NO: 2722 - DNA, 203 bp, Homo sapiens
ggcgcgccagtcctttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcacgactcggaccgatg

SEQ ID NO: 2723 - DNA, 203 bp, Homo sapiens
ggcgcgccagtcctctccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagcgactcggaccgatg

SEQ ID NO: 2724 - DNA, 203 bp, Homo sapiens
ggcgcgccagtcctctgagacacaccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcagcgactcggaccgatg

SEQ ID NO: 2725 - DNA, 203 bp, Homo sapiens
ggcgcgccagtcctctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctaccgactcggaccgatg

SEQ ID NO: 2726 - DNA, 203 bp, Homo sapiens
ggcgcgccagtccttttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtacgactcggaccgatg

SEQ ID NO: 2727 - DNA, 203 bp, Homo sapiens
ggcgcgccagtccttggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccacgactcggaccgatg

SEQ ID NO: 2728 - DNA, 203 bp, Homo sapiens
ggcgcgccagtcctgtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccatcgactcggaccgatg

SEQ ID NO: 2729 - DNA, 203 bp, Homo sapiens
ggcgcgccagtccttttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttaccgactcggaccgatg

SEQ ID NO: 2730 - DNA, 203 bp, Homo sapiens
ggcgcgccagtccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttcgactcggaccgatg

SEQ ID NO: 2731 - DNA, 203 bp, Homo sapiens
ggcgcgccagtcctagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatcgactcggaccgatg

SEQ ID NO: 2732 - DNA, 203 bp, Homo sapiens
ggcgcgccagtcctggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccgactcggaccgatg

SEQ ID NO: 2733 - DNA, 203 bp, Homo sapiens
ggcgcgccagtcctcccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagcccgactcggaccgatg

SEQ ID NO: 2734 - DNA, 203 bp, Homo sapiens
ggcgcgccagtcctaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgcgactcggaccgatg

SEQ ID NO: 2735 - DNA, 203 bp, Homo sapiens
ggcgcgccagtcctaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgcgactcggaccgatg

SEQ ID NO: 2736 - DNA, 203 bp, Homo sapiens
ggcgcgccagtcctaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgactcggaccgatg

SEQ ID NO: 2737 - DNA, 203 bp, Homo sapiens
ggcgcgccagtcctcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctacgactcggaccgatg

SEQ ID NO: 2738 - DNA, 203 bp, Homo sapiens
ggcgcgccagtccttttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttcgactcggaccgatg

SEQ ID NO: 2739 - DNA, 203 bp, Homo sapiens
ggcgcgccagtccttttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcccgactcggaccgatg

SEQ ID NO: 2740 - DNA, 203 bp, Homo sapiens
ggcgcgccagtcctcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttcgactcggaccgatg

SEQ ID NO: 2741 - DNA, 203 bp, Homo sapiens
ggcgcgccagtcctgcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaagcgactcggaccgatg

SEQ ID NO: 2742 - DNA, 203 bp, Homo sapiens
ggcgcgccagtcctaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgcgactcggaccgatg

SEQ ID NO: 2743 - DNA, 203 bp, Homo sapiens
ggcgcgccagtcctgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtcgactcggaccgatg

SEQ ID NO: 2744 - DNA, 203 bp, Homo sapiens
ggcgcgccagtcctgacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaacgactcggaccgatg

SEQ ID NO: 2745 - DNA, 203 bp, Homo sapiens
ggcgcgccagtcctgcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattcgactcggaccgatg

SEQ ID NO: 2746 - DNA, 203 bp, Homo sapiens
ggcgcgccagtcctccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgcgactcggaccgatg

SEQ ID NO: 2747 - DNA, 203 bp, Homo sapiens
ggcgcgccagtcctccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggccgactcggaccgatg

SEQ ID NO: 2748 - DNA, 203 bp, Homo sapiens
ggcgcgccagtcctcattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagacgactcggaccgatg

SEQ ID NO: 2749 - DNA, 203 bp, Homo sapiens
ggcgcgccagtccttgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgcgactcggaccgatg

SEQ ID NO: 2750 - DNA, 203 bp, Homo sapiens
ggcgcgccagtccttagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttcgactcggaccgatg

SEQ ID NO: 2751 - DNA, 203 bp, Homo sapiens
ggcgcgccagtcctaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattcgactcggaccgatg

SEQ ID NO: 2752 - DNA, 203 bp, Homo sapiens
ggcgcgccagtccttctttaagatttgtagctactaagaaagaaaggagctttttttccttgggccttcaaactgaaagaaccgcatgagcctgaagctgcgcatggtcttaacatcaggctgtgcaggaagaagctatctgcagatggatgccagcacacacaaggaagcagagctctggcaacattcgactcggaccgatg

SEQ ID NO: 2753 - DNA, 203 bp, Homo sapiens
ggcgcgccagtcctactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagcgactcggaccgatg

SEQ ID NO: 2754 - DNA, 203 bp, Homo sapiens
ggcgcgccagtcctgtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagcgactcggaccgatg

SEQ ID NO: 2755 - DNA, 203 bp, Homo sapiens
ggcgcgccagtcctgatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctcgactcggaccgatg

SEQ ID NO: 2756 - DNA, 203 bp, Homo sapiens
ggcgcgccagtccttgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttccgactcggaccgatg

SEQ ID NO: 2757 - DNA, 203 bp, Homo sapiens
ggcgcgccagtcctaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgcgactcggaccgatg

SEQ ID NO: 2758 - DNA, 203 bp, Homo sapiens
ggcgcgccagtcctatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacacgactcggaccgatg

SEQ ID NO: 2759 - DNA, 203 bp, Homo sapiens
ggcgcgccagtcctgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatacgactcggaccgatg

SEQ ID NO: 2760 - DNA, 203 bp, Homo sapiens
ggcgcgccagtcctgtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatggcgactcggaccgatg

SEQ ID NO: 2761 - DNA, 203 bp, Homo sapiens
ggcgcgccagtcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgcgactcggaccgatg

SEQ ID NO: 2762 - DNA, 203 bp, Homo sapiens
ggcgcgccagtcctccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagcgactcggaccgatg

SEQ ID NO: 2763 - DNA, 203 bp, Homo sapiens
ggcgcgccagtcctaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttcgactcggaccgatg

SEQ ID NO: 2764 - DNA, 203 bp, Homo sapiens
ggcgcgccagtcctggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctcgactcggaccgatg

SEQ ID NO: 2765 - DNA, 203 bp, Homo sapiens
ggcgcgccagtcctatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatcgactcggaccgatg

SEQ ID NO: 2766 - DNA, 203 bp, Homo sapiens
ggcgcgccagtcctgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttacgactcggaccgatg

SEQ ID NO: 2767 - DNA, 203 bp, Homo sapiens
ggcgcgccagtcctgagagcccccggtggggccggcggaggagcgcccttccccccgcgcgctgattgctgtggcgtcctgcccgtccccgcccgcgtgtgtgcgagggagggcgagtgcgccgggtcggcctgatgggggtaatcgagggtttcggggacgccgagcggcactttcctcttcccagccgactcggaccgatg

SEQ ID NO: 2768 - DNA, 203 bp, Homo sapiens
ggcgcgccagtcctcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccgactcggaccgatg

SEQ ID NO: 2769 - DNA, 203 bp, Homo sapiens
ggcgcgccagtcctttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaaccgactcggaccgatg

SEQ ID NO: 2770 - DNA, 203 bp, Homo sapiens
ggcgcgccagtcctaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcgactcggaccgatg

SEQ ID NO: 2771 - DNA, 203 bp, Homo sapiens
ggcgcgccagtcctcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggccgactcggaccgatg

SEQ ID NO: 2772 - DNA, 203 bp, Homo sapiens
ggcgcgccagtcctttttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacaccccgactcggaccgatg

SEQ ID NO: 2773 - DNA, 203 bp, Homo sapiens
ggcgcgccagtccttttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtccgactcggaccgatg

SEQ ID NO: 2774 - DNA, 203 bp, Homo sapiens
ggcgcgccagtcctacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgacgactcggaccgatg

SEQ ID NO: 2775 - DNA, 203 bp, Homo sapiens
ggcgcgccagtcctggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccgcgactcggaccgatg

SEQ ID NO: 2776 - DNA, 203 bp, Homo sapiens
ggcgcgccagtcctaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggcgactcggaccgatg

SEQ ID NO: 2777 - DNA, 203 bp, Homo sapiens
ggcgcgccagtccttggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagccgactcggaccgatg

SEQ ID NO: 2778 - DNA, 203 bp, Homo sapiens
ggcgcgccagtcctctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtcgactcggaccgatg

SEQ ID NO: 2779 - DNA, 203 bp, Homo sapiens
ggcgcgccagtcctctcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagacgactcggaccgatg

SEQ ID NO: 2780 - DNA, 203 bp, Homo sapiens
ggcgcgccagtcctgccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttcgactcggaccgatg

SEQ ID NO: 2781 - DNA, 203 bp, Homo sapiens
ggcgcgccagtcctgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtcgactcggaccgatg

SEQ ID NO: 2782 - DNA, 203 bp, Homo sapiens
ggcgcgccagtcctcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttctttttttcgactcggaccgatg

SEQ ID NO: 2783 - DNA, 203 bp, Homo sapiens
ggcgcgccagtccttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgccgactcggaccgatg

SEQ ID NO: 2784 - DNA, 203 bp, Homo sapiens
ggcgcgccagtcctatctccgtccctcagccgctcacagcctcctcccagcgcccatcgccttgagctgcccactacctctagactgccctcccgggctggcgtcccacggagtctcagccgcgcaccccttcctcgcgttaccctccttccggacagcaccccctcccttctccggtagctcctacccgactcggaccgatg

SEQ ID NO: 2785 - DNA, 203 bp, Homo sapiens
ggcgcgccagtcctcctgcctgtgcgggcctcgtccccgcgcccagccctcggtgctgcctccgacagcgccgcgctctctcagccgcccccctgcccctcgggcccccctctctgctgcccctggcgccatggcgtgcagcctcaaggacgagctgctgtgctccatctgcctgagcatctaccaggcgactcggaccgatg

SEQ ID NO: 2786 - DNA, 203 bp, Homo sapiens
ggcgcgccagtcctacccggtgagcctgggctgcgagcattacttctgccgccgctgcatcacggagcactgggtgcggcaggaggcgcagggcgcccgcgactgccccgagtgccggcgcacgttcgccgagcccgcgctggcgcccagcctcaagctggccaacatcgtggagcgctacagctcctcgactcggaccgatg

SEQ ID NO: 2787 - DNA, 203 bp, Homo sapiens
ggcgcgccagtccttcccgctggacgccatcctcaacgcgcgccgcgccgcgcgaccctgccaggcgcacgacaaggtcaagctcttctgcctcagggaccgcgcgcttctctgcttcttctgcgacgagcctgcactgcacgagcagcatcaggtcaccggcatcgacgacgccttcgacgagctgccgactcggaccgatg

SEQ ID NO: 2788 - DNA, 203 bp, Homo sapiens
ggcgcgccagtcctagagggagctgaaggaccaacttcaggcccttcaagacagcgagcgggaacacaccgaagcgctgcagctgctcaagcgacaactggcggagaccaagtcttccaccaagagcctgcggaccactatcggcgaggccttcgagcggctgcaccggctgctgcgtgaacgccagacgactcggaccgatg

SEQ ID NO: 2789 - DNA, 203 bp, Homo sapiens
ggcgcgccagtcctaggccatgctagaggagctggaggcggacacggcccgcacgctgaccgacatcgagcagaaagtccagcgctacagccagcagctgcgcaaggtccaggagggagcccagatcctgcaggagcggctggctgaaaccgaccggcacaccttcctggctggggtggcctcactgtcgactcggaccgatg

SEQ ID NO: 2790 - DNA, 203 bp, Homo sapiens
ggcgcgccagtcctccgagcggctcaagggaaaaatccatgagaccaacctcacatatgaagacttcccgacctccaagtacacaggccccctgcagtacaccatctggaagtccctgttccaggacatccacccagtgccagccgccctaaccctggacccgggcacagcccaccagcgcctgatcccgactcggaccgatg

SEQ ID NO: 2791 - DNA, 203 bp, Homo sapiens
ggcgcgccagtcctcacacgaagccgcaagccgcaagggcagcatccagatccagcccagccgcggcttctactgcatcgtgatgcacgatggcaaccagtacagcgcctgcacggagccctggacgcggcttaacgtccgggacaagcttgacaaggtgggtgtcttcctggactatgaccaaggctcgactcggaccgatg

SEQ ID NO: 2792 - DNA, 203 bp, Homo sapiens
ggcgcgccagtcctcctcctgggaccactgccacctgcaagagccctgcccaggagatagaagacctggactccagcccaccgtggccactggagacctcaggccagttgtttaccctccagcctccagtctgtaaaatggaggttgcattccctacttcctaaactctcttccagcatcgatgttctcgactcggaccgatg

SEQ ID NO: 2793 - DNA, 203 bp, Homo sapiens
ggcgcgccagtcctaaaagcaactgcaggacaagcctccctggatgatcgaggtccccagtagctctgaacaagagtccagccaaccctcttcagccaggcctctgtgacctgctagggtgcaggaggcttccagaagcagttgttgtaattaggacccaagcactgggaggggctgttggctggacccgactcggaccgatg

SEQ ID NO: 2794 - DNA, 203 bp, Homo sapiens
ggcgcgccagtcctttcatcatgtctgttgtgaccaggaaagctgcccccatctgcaggaagccactatgccagaaagctgctgactgcagaactaggctccctctgccagggtccgtgccagccaatagatgtcctgaggcctgcccctctcccacttcactcagttcccaaatctaaatttttacacgactcggaccgatg

SEQ ID NO: 2795 - DNA, 203 bp, Homo sapiens
ggcgcgccagtcctattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaaccgactcggaccgatg

SEQ ID NO: 2796 - DNA, 203 bp, Homo sapiens
ggcgcgccagtcctcggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgcgactcggaccgatg

SEQ ID NO: 2797 - DNA, 203 bp, Homo sapiens
ggcgcgccagtccttacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagcgactcggaccgatg

SEQ ID NO: 2798 - DNA, 203 bp, Homo sapiens
ggcgcgccagtcctctcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatacgactcggaccgatg

SEQ ID NO: 2799 - DNA, 203 bp, Homo sapiens
ggcgcgccagtccttagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgacttggacaggttgcttcactcctggcgactcggaccgatg

SEQ ID NO: 2800 - DNA, 203 bp, Homo sapiens
ggcgcgccagtcctcctttggctgaggaggaggagaaggaggaatcgcgccaggcggagcgtcaggtcccgttttcctctccggcgtctccaatacaaagattacggtgcagaaggaaattgcactcgtctcctccgcgcccccggtacccaacacaatgcaccagccgcctgagtccaccgccgcggcgactcggaccgatg

SEQ ID NO: 2801 - DNA, 203 bp, Homo sapiens
ggcgcgccagtcctccgccgccgctgcagacattagcgctaggaagatggcgcacccggcaatgttccctcgaaggggcagcggtagtggcagcgcctctgctctcaatgcagcaggtaccggcgtcggtagtaatgccacatcttccgaggattttccgcctccgtcgctgcttcagccgccgcccccgactcggaccgatg

SEQ ID NO: 2802 - DNA, 203 bp, Homo sapiens
ggcgcgccagtcctctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagctcgactcggaccgatg

SEQ ID NO: 2803 - DNA, 203 bp, Homo sapiens
ggcgcgccagtcctctgtggccagtgcatccattactggtgggccaccctcaagcccagtatctagaaaactctctacaactggaagctctgacagtatcacaccagttgcaccaacttctgctgtatcatccagtggttcacctgcatctgtaatgactaatatgcgtgctccaagtactacaggtgcgactcggaccgatg

SEQ ID NO: 2804 - DNA, 203 bp, Homo sapiens
ggcgcgccagtccttaggtcagcagccttccatttccagtttggctcaaccccagctaccatattctcaggcggctcctccagtgcaaactccccttccaggggcaccaccaccccaacagttacagtatggacaacagcaaccaatggtttctacacagatggccccaggccatgtcaaatcagtgacgactcggaccgatg

SEQ ID NO: 2805 - DNA, 203 bp, Homo sapiens
ggcgcgccagtcctctcaaaatcctgcttcagagtatgtacaacagcagccaattcttcaaacagcaatgtcctccggacagcccagttctgcaggagtaggagcaggaacaacagtgattcctgtggctcagccacagggtatccagctgccagtgcagcccacagcagtcccagcacaacctgcagcgactcggaccgatg

SEQ ID NO: 2806 - DNA, 203 bp, Homo sapiens
ggcgcgccagtcctcagatgggagtagcagcagcctagcagcctctgcttctcttttcccgttgaaggtgctaccgctgacgacacccctggtggatggcgaggatgagagctcctctggtgcaagtgtggtagctattgacaacaaaatcgagcaagctatggatctagtgaaaagccatttgatgtcgactcggaccgatg

SEQ ID NO: 2807 - DNA, 203 bp, Homo sapiens
ggcgcgccagtcctatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccaccgactcggaccgatg

SEQ ID NO: 2808 - DNA, 203 bp, Homo sapiens
ggcgcgccagtcctagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagaccgactcggaccgatg

SEQ ID NO: 2809 - DNA, 203 bp, Homo sapiens
ggcgcgccagtccttccaggtaaagttaacaatttgactagtaaaatcctgaagggcagtggaatgattggaaaagtaggggcgtgatttgactgcatgaagtaaaaggaaattgacacattgagttgttcagcaggtaagagaagagacagtggaggagtccagctcaattctaactactgtgtgaccgactcggaccgatg

SEQ ID NO: 2810 - DNA, 203 bp, Homo sapiens
ggcgcgccagtcctttggacaggttgcttcactcctggacggatgtaggggtttgaaagagatgatctcttacattcccctttggctttaaaattctaggagtccttgaaaatcttaattttttactgaactgagaggaagaaggagccttattctgtgtataattggaataagcagatctaggatcacgactcggaccgatg

SEQ ID NO: 2811 - DNA, 203 bp, Homo sapiens
ggcgcgccagtcctagtggccccctgcccagtaggaattggaccaatcccaagttctaaggcttgtcttaagtccttgcagaacaaggacaaactttctgaatcattcatttctctcatctagagctggtgggagattgagaggtgaatgggacatccaagatccctaaaaagaattgttcgatagcgcgactcggaccgatg

SEQ ID NO: 2812 - DNA, 203 bp, Homo sapiens
ggcgcgccagtccttgcatgtgttataaagtggtgacacgggcatcctgttgaaatgatggatggctcactgccataggctgatagcagttgtcataaagatattttgggggaatttgaaaaggacgtaaagaaaaatctttcatattggcttgttggttatataacttcaaatttaataaaggaatacgactcggaccgatg

SEQ ID NO: 2813 - DNA, 203 bp, Homo sapiens
ggcgcgccagtcctgccactgcagactccagagccctgcttcaggcctatatagatggtcactctgtggtcatcttcagtaggtccacatgcacacgctgtactgaggtaaagaagttatttaaatctctgtgtgttccttattttgtgcttgaacttgatcaaacagaggacggtcgggccctggaacgactcggaccgatg

SEQ ID NO: 2814 - DNA, 203 bp, Homo sapiens
ggcgcgccagtcctagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtagggcgactcggaccgatg

SEQ ID NO: 2815 - DNA, 203 bp, Homo sapiens
ggcgcgccagtcctgtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagcgactcggaccgatg

SEQ ID NO: 2816 - DNA, 203 bp, Homo sapiens
ggcgcgccagtcctgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacacgactcggaccgatg

SEQ ID NO: 2817 - DNA, 203 bp, Homo sapiens
ggcgcgccagtcctacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtcgactcggaccgatg

SEQ ID NO: 2818 - DNA, 203 bp, Homo sapiens
ggcgcgccagtcctgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagcccgactcggaccgatg

SEQ ID NO: 2819 - DNA, 203 bp, Homo sapiens
ggcgcgccagtcctaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatccgactcggaccgatg

SEQ ID NO: 2820 - DNA, 203 bp, Homo sapiens
ggcgcgccagtcctcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttcgactcggaccgatg

SEQ ID NO: 2821 - DNA, 203 bp, Homo sapiens
ggcgcgccagtccttcacccaattaggagctctcagcttacgaggcaattagcataggttgccagggctgcacgaggagtggatttctgctttgtcattctgactctggcagttagcccgcccgctcggcgcagggcgtggcttctcgtagccattaggaaacagcaaccctttcacctcagttttctcgactcggaccgatg

SEQ ID NO: 2822 - DNA, 203 bp, Homo sapiens
ggcgcgccagtccttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccacgactcggaccgatg

SEQ ID NO: 2823 - DNA, 203 bp, Homo sapiens
ggcgcgccagtcctcgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccgactcggaccgatg

SEQ ID NO: 2824 - DNA, 203 bp, Homo sapiens
ggcgcgccagtcctagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagacgactcggaccgatg

SEQ ID NO: 2825 - DNA, 203 bp, Homo sapiens
ggcgcgccagtcctagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatcgactcggaccgatg

SEQ ID NO: 2826 - DNA, 203 bp, Homo sapiens
ggcgcgccagtcctgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactcgactcggaccgatg

SEQ ID NO: 2827 - DNA, 203 bp, Homo sapiens
ggcgcgccagtcctgccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgttcgactcggaccgatg

SEQ ID NO: 2828 - DNA, 203 bp, Homo sapiens
ggcgcgccagtccttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatcgactcggaccgatg

SEQ ID NO: 2829 - DNA, 203 bp, Homo sapiens
ggcgcgccagtcctttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtacgactcggaccgatg

SEQ ID NO: 2830 - DNA, 203 bp, Homo sapiens
ggcgcgccagtcctttccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttacgactcggaccgatg

SEQ ID NO: 2831 - DNA, 203 bp, Homo sapiens
ggcgcgccagtcctaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagcgactcggaccgatg

SEQ ID NO: 2832 - DNA, 203 bp, Homo sapiens
ggcgcgccagtccttaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggcgactcggaccgatg

SEQ ID NO: 2833 - DNA, 203 bp, Homo sapiens
ggcgcgccagtcctccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacccgactcggaccgatg

SEQ ID NO: 2834 - DNA, 203 bp, Homo sapiens
ggcgcgccagtcctggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcgactcggaccgatg

SEQ ID NO: 2835 - DNA, 203 bp, Homo sapiens
ggcgcgccagtcctaatttcccaaattcaacaaatcttccaagaaatccatccatggcagattatgaagcacggatctttacttttgggacatggatatactcagttaacaaggagcagcttgcaagagctggattttatgctttaggtgaaggtgataaagtaaagtgctttcactgtggaggagggcgactcggaccgatg

SEQ ID NO: 2836 - DNA, 203 bp, Homo sapiens
ggcgcgccagtcctctaactgattggaagcccagtgaagacccttgggaacaacatgctaaatggtatccagggtgcaaatatctgttagaacagaagggacaagaatatataaacaatattcatttaactcattcacttgaggagtgtctggtaagaactactgagaaaacaccatcactaactagacgactcggaccgatg

SEQ ID NO: 2837 - DNA, 203 bp, Homo sapiens
ggcgcgccagtcctagaattgatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcgactcggaccgatg

SEQ ID NO: 2838 - DNA, 203 bp, Homo sapiens
ggcgcgccagtccttgtcccatgtgctacacagtcattactttcaagcaaaaaatttttatgtcttaatctaactctatagtaggcatgttatgttgttcttattaccctgattgaatgtgtgatgtgaactgactttaagtaatcaggattgaattccattagcatttgctaccaagtaggaaaaaacgactcggaccgatg

SEQ ID NO: 2839 - DNA, 203 bp, Homo sapiens
ggcgcgccagtccttttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgcgactcggaccgatg

SEQ ID NO: 2840 - DNA, 203 bp, Homo sapiens
ggcgcgccagtccttttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgtcgactcggaccgatg

SEQ ID NO: 2841 - DNA, 203 bp, Homo sapiens
ggcgcgccagtcctgggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaagcgactcggaccgatg

SEQ ID NO: 2842 - DNA, 203 bp, Homo sapiens
ggcgcgccagtcctaaacctcttggaaattataaaaatattggcaagaaaagaagaatagttgtttaaatattttttaaaaaacacttgaataagaatcagtagggtataaactagaagtttaaaaatgcttcatagaacgtccagggtttacattacaagattctcacaacaaacctattgtagaggcgactcggaccgatg

SEQ ID NO: 2843 - DNA, 203 bp, Homo sapiens
ggcgcgccagtcctcaagtcaggtaggtagttcaatctagttgttagccaaggactcaaggactgaattgttttaacataaggcttttcctgttctgggagccgcacttcattaaaattcttctaaaacttgtatgtttagagttaagcaagactttttttcttcctctccatgagttgtgaaatttacgactcggaccgatg

SEQ ID NO: 2844 - DNA, 203 bp, Homo sapiens
ggcgcgccagtcctcttacatgataactcagtgatgcttactcatagtttttggtgtttctcatagataagatataaatcagctgggcgcggtggctcatgcctgtaatcccagcactttgggaggccgaggcgggcagatcacctgaggtcgggaggtcgagaccagcctgaccaacatggagaaaccgactcggaccgatg

SEQ ID NO: 2845 - DNA, 203 bp, Homo sapiens
ggcgcgccagtcctcccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactccagcctgggcaacaagagcaaaactctgtctccgactcggaccgatg

SEQ ID NO: 2846 - DNA, 203 bp, Homo sapiens
ggcgcgccagtcctcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattagctgggcatggtggtgtgtgcctgtagtcctggcgactcggaccgatg

SEQ ID NO: 2847 - DNA, 203 bp, Homo sapiens
ggcgcgccagtcctggaagcagagatcattttgccttagacaggccatctgagacacatgcagactatcttttgagaactgggcaggttgtagatatatcagacaccatatacccgaggaaccctgccatgtatagtgaagaagctagattaaagtcctttcagaactggccagactatgctcacctacgactcggaccgatg

SEQ ID NO: 2848 - DNA, 203 bp, Homo sapiens
ggcgcgccagtcctcgaagtgaatctgatgctgtgagttctgataggaatttcccaaattcaacaaatcttccaagaaatccatccatggcagattatgaagcacggatctttacttttgggacatggatatactcagttaacaaggagcagcttgcaagagctggattttatgctttaggtgaaggtcgactcggaccgatg

SEQ ID NO: 2849 - DNA, 203 bp, Homo sapiens
ggcgcgccagtcctgcagatctagtgaatgctcagaaagacagtatgcaagatgagtcaagtcagacttcattacagaaagagattagtactgaagagcagctaaggcgcctgcaagaggagaagctttgcaaaatctgtatggatagaaatattgctatcgtttttgttccttgtggacatctagtccgactcggaccgatg

SEQ ID NO: 2850 - DNA, 203 bp, Homo sapiens
ggcgcgccagtcctgtacactgcttgtagttatagtgacagctttccatgttgagattctcatatcatcttgtatcttaaagtttcatgtgagtttttaccgttaggatgattaagatgtatataggacaaaatgttaagtctttcctctacctacatttgttttcttggctagtaatagtagtagatcgactcggaccgatg

SEQ ID NO: 2851 - DNA, 203 bp, Homo sapiens
ggcgcgccagtcctacttctgaaataaatgttctctcaagatccttaaaacctcttggaaattataaaaatattggcaagaaaagaagaatagttgtttaaatattttttaaaaaacacttgaataagaatcagtagggtataaactagaagtttaaaaatgcttcatagaacgtccagggtttacatcgactcggaccgatg

SEQ ID NO: 2852 - DNA, 203 bp, Homo sapiens
ggcgcgccagtcctcatgcccgactaatttttttttatttttagtagagacggggtttcaccatgttggccaggctggtatcaaactcctgacctcaagagatccactcgccttgccctcccaaagtgctgggattacaggcttgagccaccacgcccggctaaaacattgcaaatttaaatgagagtcgactcggaccgatg

SEQ ID NO: 2853 - DNA, 203 bp, Homo sapiens
ggcgcgccagtcctataaaaagcaccggatcttttccatctaattccgcaaaaattgatcatttgcaaagtcaaaactatagccatatccaaatcttttccccctcccaagagttctcagtgtctacatgtagactattccttttctgtataaagttcactctaggatttcaagtcaccacttattttcgactcggaccgatg

SEQ ID NO: 2854 - DNA, 203 bp, Homo sapiens
ggcgcgccagtccttttggttttttcccctgtccctttgattacgggctaaggtagggtagagtgggtgtagtgagtgtatataatgtgatttggccctgtgtattatgatattttgttatttttgttgttatattatttacatttcagtagttgttttttgtgtttccattttagtggataaaatttcgactcggaccgatg

SEQ ID NO: 2855 - DNA, 203 bp, Homo sapiens
ggcgcgccagtcctgtattttgaactatgaatggagactaccgccccagcattagtttcacatgatataccctttaaacccgaatcattgttttatttcctgattacacaggtgttgaatggggaaaggggctagtatatcagtaggatatactatgggatgtatatatatcattgctgttagagaaacgactcggaccgatg

SEQ ID NO: 2856 - DNA, 203 bp, Homo sapiens
ggcgcgccagtccttttagtcaaatctacttgttaaaaaaagggtagcagtttattcatctgtgaaaggaaaataatacttatcttacaaggttgcaagagctcaaggagaccatgtatgtaaagttcctgctgtaaatatgaactcccatcctaatacccttttacctctctgtgggtttgtcttgacgactcggaccgatg

SEQ ID NO: 2857 - DNA, 203 bp, Homo sapiens
ggcgcgccagtcctaggtcgagaccagcctgaccaacatggagaaaccccgtctctactaaaaatacaaaattagctgggcgtggtggctcatgcctgtaatcccagctacttgggaggctgaggcaggagaatcgcttgaacccaggaggcggaggttgtggtgagcgaagatcgtgccattgcactcgactcggaccgatg

SEQ ID NO: 2858 - DNA, 203 bp, Homo sapiens
ggcgcgccagtcctagtgagctatgattgtgccactgtactccagtctgggtgacagagtgagaccccatctctaaataaataggtcaaacccttaaaaatatttaaattcttaaaaaattgaaaagattattcttctcaaatttagttgagctttctaagagaagcaattggctttttcccacttcacgactcggaccgatg

SEQ ID NO: 2859 - DNA, 203 bp, Homo sapiens
ggcgcgccagtcctataatcattttcagtttgactcatacagttaacacaatgtgaatttcttcctcagcataacagagttatagaatgacagggctggaagtgaccttagagagtatccagttctttcattttacaggtgaggcaactgagactcaaaggtgatgtaatttgtgcaaagattatagccgactcggaccgatg

SEQ ID NO: 2860 - DNA, 203 bp, Homo sapiens
ggcgcgccagtccttaattagtagcagagccctgactgggacatagtttgaaggtgaaaaacttcaccaagctacctttcttgaaaggtccaaatgtttatgttttcaactactctttccactgtaccataactttcactacatattaaatgacactttataactaatataataggacaatcatcaatcgactcggaccgatg

SEQ ID NO: 2861 - DNA, 203 bp, Homo sapiens
ggcgcgccagtccttatttacatagcattaaggttggtgcaaaaatgcaaaaaaaaaaaaagcaattatttttaaaccaacctaatatattgtattaggtattaaagtcatctggacatgaattaaagtatatgatgccagcctggacaaaaggcaaaaccctgtctctacaaaaaatacaaaaattacgactcggaccgatg

SEQ ID NO: 2862 - DNA, 203 bp, Homo sapiens
ggcgcgccagtcctgctgggcatggtggtgtgtgcctgtagtcctggctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgcgactcggaccgatg

SEQ ID NO: 2863 - DNA, 203 bp, Homo sapiens
ggcgcgccagtcctgtagagacagggtttcaccatgttggccaggctagtcttgaatttctgacctcaagtgattcatctcccaaagtgctgggattacaggcgtgagccaccacggccggctaatttttgtattttttagtagtgactggtttcgcggtgttgaccaggctggtctcgaactcctgacgactcggaccgatg

SEQ ID NO: 2864 - DNA, 203 bp, Homo sapiens
ggcgcgccagtccttgacctgggccactgatgtagccaaaggaatgcattatttacatatggaggctcctgtcaaggtgattcacagagacctcaagtcaagaaacgttgttatagctgctgatggagtattgaagatctgtgactttggtgcctctcggttccataaccatacaacacacatgtcctcgactcggaccgatg

SEQ ID NO: 2865 - DNA, 203 bp, Homo sapiens
ggcgcgccagtcctctgggatgcagataaacatgcaagccaagcagaattcttccaaaaccacatctaagagaagggggaagaaagtcaacatggctctggggttcagtgattttgacttgtcagaaggtgacgatgatgatgatgatgacggtgaggaggaggataatgacatggataatagtgaatcgactcggaccgatg

SEQ ID NO: 2866 - DNA, 203 bp, Homo sapiens
ggcgcgccagtcctcttttttcaaactaaattagaaaggagtgtcattatttgactgttaaaccaaaatatttttggtgggtctttttatggaagtttaaagaaaggacatcatcatagatatgatctaacagtatttctaactatatttgatcattaaaagcctcttggaatttgaagcgtgacgtgcgactcggaccgatg

SEQ ID NO: 2867 - DNA, 203 bp, Homo sapiens
ggcgcgccagtccttagtcattcattcaacacatattcatagagctccttctctgtgccagacactgttctggaagatagctagatgaaaatctttgcactcacagagcttacatgccagtgagtgaagatcgatgataaataaagcaaatgcatcatatgttcacatttgataagtatatgccaaaacgactcggaccgatg

SEQ ID NO: 2868 - DNA, 203 bp, Homo sapiens
ggcgcgccagtccttcatttaagaatgatcagcaatacgtttagaacatatgaactgaatgaaatggacattttttcttaatttatgtataaatccatatgattatacataaagttctgatgcattaataaaagcagccaaatagggccaaagagaaaaataacaggactctgtactggacctaacttcgactcggaccgatg

SEQ ID NO: 2869 - DNA, 203 bp, Homo sapiens
ggcgcgccagtccttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggaccgactcggaccgatg

SEQ ID NO: 2870 - DNA, 203 bp, Homo sapiens
ggcgcgccagtccttattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaattttaaacgactcggaccgatg

SEQ ID NO: 2871 - DNA, 203 bp, Homo sapiens
ggcgcgccagtcctttgcagtgagctgagattgcaccactacactccagcctggatgacagagtgagacttcatctcaaaaaaaaaaaaaaacaaaaaaaaacaacccggtagcattgtcccttccccactgacaaacttatcaaatccagaagctttagagtttcgtctctaattatttttctcctgcgactcggaccgatg

SEQ ID NO: 2872 - DNA, 203 bp, Homo sapiens
ggcgcgccagtcctaacaaaattacccaagtcaaaacaaaatgtatttttagaattacggcagcatacgacctgaattttgtgagtttcgtggctttatcttaaatcaccatttccctaaaaatggtttctttctccttagaaatgctggtggcaacttgatgaaacagccaaatgcaccagggcaggcgactcggaccgatg

SEQ ID NO: 2873 - DNA, 203 bp, Homo sapiens
ggcgcgccagtcctcccagaattactgtgcgtacaactttatttttcagagttttcattggaatggtaagagttttatgaaagacagttttaaaacttattctgagttaaatattaatactttaaaaaattattgtactagacttattgcagccttttgaaagtagcagagtttcatcataccacatacgactcggaccgatg

SEQ ID NO: 2874 - DNA, 203 bp, Homo sapiens
ggcgcgccagtcctggctggacaacgttcatggctctcgggtagaacctagtgaaacggccagaatgaattctatggacaggcacatccagcagaccaatgaccgactgcagtgcatcaagcagcacttacagaatcctgccaacttccacaatgccgccacggagctgctggactggtgcggagacccgactcggaccgatg

SEQ ID NO: 2875 - DNA, 203 bp, Homo sapiens
ggcgcgccagtcctgcgaagagctcggccgcctgctgctgctccgacatcagaagagccgccagagcgatccccctgggaaactccccatgcagccccctctcagctccatgagctccatgaaacccactctgtcgcacagtgatgggtcgttcccctatgactctgtcccttggcagcagaacaccacgactcggaccgatg

SEQ ID NO: 2876 - DNA, 203 bp, Homo sapiens
ggcgcgccagtcctttgcggggcagcagcagcagttctcagccaaggctggccccgctcagccctacatccagcagagcatgtatggccggcccaactaccccggcagcgggggctttggggccagttaccctgggggtcctaacgcccccgcaggcatgggcatccctccgcacaccaggccgcctgcgactcggaccgatg

SEQ ID NO: 2877 - DNA, 203 bp, Homo sapiens
ggcgcgccagtcctaccagcccgggccgcgggggcctgcctccatggggggcagcatgaaccccgcgagcatggcggctggcatgacgccctcggggatgagcggccctcccatgggcatgaaccagccccggccgcccggcatcagcccctttggcacacacgggcagcggatgccccagcagacctcgactcggaccgatg

SEQ ID NO: 2878 - DNA, 203 bp, Homo sapiens
ggcgcgccagtcctacccgggcccccggccccagtcccttcctattcagaacataaagaggccataccctggagagcccaactatggaaaccagcaatatggaccaaacagccagttccccacccagccaggccagtacccagcccccaaccccccgaggccactcacctcccccaactacccaggaccgactcggaccgatg

SEQ ID NO: 2879 - DNA, 203 bp, Homo sapiens
ggcgcgccagtcctagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaacgactcggaccgatg

SEQ ID NO: 2880 - DNA, 203 bp, Homo sapiens
ggcgcgccagtcctattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggccgactcggaccgatg

SEQ ID NO: 2881 - DNA, 203 bp, Homo sapiens
ggcgcgccagtccttcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacacgactcggaccgatg

SEQ ID NO: 2882 - DNA, 203 bp, Homo sapiens
ggcgcgccagtcctagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggcgactcggaccgatg

SEQ ID NO: 2883 - DNA, 203 bp, Homo sapiens
ggcgcgccagtcctagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctaccgactcggaccgatg

SEQ ID NO: 2884 - DNA, 203 bp, Homo sapiens
ggcgcgccagtcctctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtcgactcggaccgatg

SEQ ID NO: 2885 - DNA, 203 bp, Homo sapiens
ggcgcgccagtcctccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaacgactcggaccgatg

SEQ ID NO: 2886 - DNA, 203 bp, Homo sapiens
ggcgcgccagtcctcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatgggggggaggggggcgactcggaccgatg

SEQ ID NO: 2887 - DNA, 203 bp, Homo sapiens
ggcgcgccagtcctcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggacgactcggaccgatg

SEQ ID NO: 2888 - DNA, 203 bp, Homo sapiens
ggcgcgccagtcctgcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagccgactcggaccgatg

SEQ ID NO: 2889 - DNA, 203 bp, Homo sapiens
ggcgcgccagtccttctcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattacgactcggaccgatg

SEQ ID NO: 2890 - DNA, 203 bp, Homo sapiens
ggcgcgccagtcctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagacgactcggaccgatg

SEQ ID NO: 2891 - DNA, 203 bp, Homo sapiens
ggcgcgccagtcctgtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtcgactcggaccgatg

SEQ ID NO: 2892 - DNA, 203 bp, Homo sapiens
ggcgcgccagtccttacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtcgactcggaccgatg

SEQ ID NO: 2893 - DNA, 203 bp, Homo sapiens
ggcgcgccagtcctttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggcgactcggaccgatg

SEQ ID NO: 2894 - DNA, 203 bp, Homo sapiens
ggcgcgccagtccttgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcacgactcggaccgatg

SEQ ID NO: 2895 - DNA, 203 bp, Homo sapiens
ggcgcgccagtcctattcagccccgtgctcagcagacatcagggatcaccgactctgtgccaggagctgttcttgatgctgggaacgcaggggtggacaaaacagagaaagccctgccctcagtgagaaatatgctgtcatgtaaattgctttttcccctatagaatgccagcagttactctgcagagcgactcggaccgatg

SEQ ID NO: 2896 - DNA, 203 bp, Homo sapiens
ggcgcgccagtcctctcaaccacaacttctgacctcccagggtgtctgaggcctctaaagagcttagtttgcccctctgggaagtgaatccttggcttatggtgccggggggaccctggaggccccctcacacgaaggctgcttcttgcagagtcgctcaaaagtagggccccagggctcgcagcagccgactcggaccgatg

SEQ ID NO: 2897 - DNA, 203 bp, Homo sapiens
ggcgcgccagtcctggcaagatggctcccctgcatgtctccggctgatcgctgccgctccgccaatacaatagagccagccactaccagcagcctggccctcttcctccttctccagagagaccaatccagccgaactcggggtttgccaaagggataaacagcacttccagggggagaaaaaaaatccgactcggaccgatg

SEQ ID NO: 2898 - DNA, 203 bp, Homo sapiens
ggcgcgccagtccttaagcacctcgtgtgtgttcttcggcctcactgctctgtggcttaggtatctgtgctgtggggtttgagaaacatggtgaaggtgtatgaacagagcttgacatttgtgctctgctgtgtgcgtgcaccagctgcctccaggccaactacacgtgtgagacagatggggcctgccgactcggaccgatg

SEQ ID NO: 2899 - DNA, 203 bp, Homo sapiens
ggcgcgccagtccttcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagaccgactcggaccgatg

SEQ ID NO: 2900 - DNA, 203 bp, Homo sapiens
ggcgcgccagtccttatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagacgactcggaccgatg

SEQ ID NO: 2901 - DNA, 203 bp, Homo sapiens
ggcgcgccagtcctagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaacgactcggaccgatg

SEQ ID NO: 2902 - DNA, 203 bp, Homo sapiens
ggcgcgccagtcctgagagaaagaaaaggaacgggagctgagagctgatcacctgcctttccagaccggagacgggcggcaagtttgaagtcgacacccagaggccagtttgtcccccttcccgcgcgcgggcggcccgagcctcggcggcggcggtagcggcggcggcgacgctgacacctcccacccgactcggaccgatg

SEQ ID NO: 2903 - DNA, 203 bp, Homo sapiens
ggcgcgccagtcctagaacttaagaaacttgagacagggaaggagagccgggagcagccaaaacctgctaagtctcagaagactggtttctgcacaagggaatggaagaagtgactggaggtggctgtggattcaactctggcctgagattgattcccttgagataacaaatccagtttgctgatgaccgactcggaccgatg

SEQ ID NO: 2904 - DNA, 203 bp, Homo sapiens
ggcgcgccagtcctaggccacagtaccctattcacgctctgtgcttgtgccaaggtttcaagtgatcctcccgcctcagcctgcccaggtgctgagattacatgtatgagccactgcacctggaaaggagccagaaatgtgaagtgctagctgaaggatgagcagcagctagccaggcaaagggggcacgactcggaccgatg

SEQ ID NO: 2905 - DNA, 203 bp, Homo sapiens
ggcgcgccagtcctaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaagggggcacgactcggaccgatg

SEQ ID NO: 2906 - DNA, 203 bp, Homo sapiens
ggcgcgccagtcctcccggcccgccaccatgacttccagcaagatagagatgcccggcgaggtgaaggccgaccccgccgccctcatggcgtcgctgcacctcctgccgtcgcccacgcccaatctcgaaattaagtacaccaaggtgtgaaaattggacttgctggcagaatcctttttgggagaagcgactcggaccgatg

SEQ ID NO: 2907 - DNA, 203 bp, Homo sapiens
ggcgcgccagtcctcccacttgtgatgcttcaagacccctggagcacgtcaggttcttagatctcgttttgaggagtgatgtggagtgacgcatccttacagatcccaaagcgttgaataaacggttgtacaaagagatccaggatgagaagactgataaaagaagaagctagctgaacagctgtaaacgactcggaccgatg

SEQ ID NO: 2908 - DNA, 203 bp, Homo sapiens
ggcgcgccagtcctaaacgtattttggcatctctgggagacaggctgcacgacgatcccccacagaagccccctcggtccatcaccctcagggaacccagtggtaatcacactcctcctcagttgtctccatcacttagccaaagcacttacaccactggtggctccctagacgttcctcacattatccgactcggaccgatg

SEQ ID NO: 2909 - DNA, 203 bp, Homo sapiens
ggcgcgccagtcctagcggagcgcggaggccgctgggacgcggttcagctcattccctgaggccggcccgcgtcccgtcaggcgccgcgcggggttagcgcggggtcagcggaggtcagcgggggtcagcagcagcggctccgagggcgcggcggacgcagggcaggatgtacacgctgctgtcgggccgactcggaccgatg

SEQ ID NO: 2910 - DNA, 203 bp, Homo sapiens
ggcgcgccagtcctgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaaccgactcggaccgatg

SEQ ID NO: 2911 - DNA, 203 bp, Homo sapiens
ggcgcgccagtcctcctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagacgactcggaccgatg

SEQ ID NO: 2912 - DNA, 203 bp, Homo sapiens
ggcgcgccagtcctcctaccttgagtgagcttcctctgcatgttttctatatcactggcagagcctgtagttggaaaggggacagagtgactactggactttgtgtgaaaacaccaaccgggacaaaacttcagtcaaggctgagacgggtgggggtatataacttgtccttacgttaaacttggaaccgactcggaccgatg

SEQ ID NO: 2913 - DNA, 203 bp, Homo sapiens
ggcgcgccagtcctagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagacgactcggaccgatg

SEQ ID NO: 2914 - DNA, 203 bp, Homo sapiens
ggcgcgccagtcctttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagcccgactcggaccgatg

SEQ ID NO: 2915 - DNA, 203 bp, Homo sapiens
ggcgcgccagtcctagggttcttgtggcctctggcgggcctccagccagttagaccatttgaccagaacgtgtgcagctcagccagccacagaactggaatttttcaggagcagggggagcatggagtttggactttgctgagcaactgaagtggagcgcagagcttgctcgcttaggagagagcatccgactcggaccgatg

SEQ ID NO: 2916 - DNA, 203 bp, Homo sapiens
ggcgcgccagtcctgcgtcggggagcggcggtaccgggcggctgcggggctggctcgacccagcttgaggtctcggcgtccgcgtcctgcggtgccctggggtctcccgaggaccttgtacccgcgcggcttccttgggctggctttggacgacgctttcgccttcctgctgcctaggatccgccgaccgactcggaccgatg

SEQ ID NO: 2917 - DNA, 203 bp, Homo sapiens
ggcgcgccagtcctctcgcaccgctgccccgcgagcagctcctcttctcccgaggcgcgcggggcgcccccgcgagccccgcggctgagaccccgcagcctggaggagggctgtccggggctttggtgtggccgtggctgacactaaagactttgtagccatcaacccgagtgcagtttcgatggaaacgactcggaccgatg

SEQ ID NO: 2918 - DNA, 203 bp, Homo sapiens
ggcgcgccagtcctcagactgcgggacggacggtggacgctgggacgcgtttgtagctccggccccgccgttccgacccccgccgccgtcgccgccatgacggggctagcactgctctactccggggtcttcgtggccttctgggcctgcgcgctggccgtgggttcctgacggagacttcgcccttccgactcggaccgatg

SEQ ID NO: 2919 - DNA, 203 bp, Homo sapiens
ggcgcgccagtcctcactgctcagacctctggacctgacaggagacgcctacttggctctgacgcggcgccccagcccggctgtgtccccggcgccccggaccaccctccctgccggctttgggtgcgttgtggggtcccgaggattcgcgagatttgttgaaagacattcaagattacgaagtttagcgactcggaccgatg

SEQ ID NO: 2920 - DNA, 203 bp, Homo sapiens
ggcgcgccagtccttcttggtcttggactgagccacactcctggcatcccagcgtctccagcttgcatggcctgtcacgagaaccctgactaatacacctggagtgcagaatctgctggagaaactgccattccgttattgactggctggtcaggccatacagcctggtggtctagatgtgtttggagcgactcggaccgatg

SEQ ID NO: 2921 - DNA, 203 bp, Homo sapiens
ggcgcgccagtcctaaggccgcgaggttggagggcacggggacacagcatagcgaggaaggaacgctcgagatttctgtggctcctcaagatattggtcataatcctggtacttggcattgttggatttatgttcggaagcatgttccttcaagcagtgttcagcagccccaagccagaactcccaagcgactcggaccgatg

SEQ ID NO: 2922 - DNA, 203 bp, Homo sapiens
ggcgcgccagtccttgtgtcatccccggtagagggtgcccgtcacggccaaccacagagatcccggtcctccgggattctagagcgtccggccgaaccctccactgacttccggtggctgagcctctccgcagcttccggccaagttggactgcagctcgcggtttcctggcttctagtttccagagtcgactcggaccgatg

SEQ ID NO: 2923 - DNA, 203 bp, Homo sapiens
ggcgcgccagtcctctgcgcctgcgcatgccacacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgactcggaccgatg

SEQ ID NO: 2924 - DNA, 203 bp, Homo sapiens
ggcgcgccagtcctggtctgcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacacgactcggaccgatg

SEQ ID NO: 2925 - DNA, 203 bp, Homo sapiens
ggcgcgccagtcctaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccggttccaccaggtgagaagagtgcgactcggaccgatg

SEQ ID NO: 2926 - DNA, 203 bp, Homo sapiens
ggcgcgccagtcctgtaaaccaatagcccccatgctctgtgcgatttcattgtgtgctcgcgttcgcaagctccgtagtgcaggaagttccaccaggtgagaagagtgatgaccatccttttccttactatggttatttcatactttggttgcatgaaggctgcccccatgaaagaagcaaacatccgcgactcggaccgatg

SEQ ID NO: 2927 - DNA, 203 bp, Homo sapiens
ggcgcgccagtcctcagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggagttccaccaggtgagaagagtgcgactcggaccgatg

SEQ ID NO: 2928 - DNA, 203 bp, Homo sapiens
ggcgcgccagtccttgtgactccgccgccggggacccgtgaggtttgtgtggaccccgagcatgagcagagatcattaaaaattaaacttacaaagctgctaaagtgggaagaaggagaacttgaagccacaatttttgcacttgcttagaagccatctaatctcagttccaccaggtgagaagagtgcgactcggaccgatg

SEQ ID NO: 2929 - DNA, 203 bp, Homo sapiens
ggcgcgccagtcctatcaccatcattgtgggcagcatccgcagggacaggcaggcccggcttcagcggcaccgccaccgccaccaccgccaccaccaccaccatcatcaccaccgccggcgtcgacaccgagagtacgagcacggctacgtgtcggacgagcacacatacagccgctcaagccgcaggcgactcggaccgatg

SEQ ID NO: 2930 - DNA, 203 bp, Homo sapiens
ggcgcgccagtcctaccgaggccacagctgcgatttcatagtgtgggaccccactggcaaagacacgctggctgctgtggccgtggtttctgtcccagccgtctgtttccatagaaaaagacccgtgcctgtatattccacgctttgcgcacctgctggaattcggggagaagaaccacgaggtgtcccgactcggaccgatg

SEQ ID NO: 2931 - DNA, 203 bp, Homo sapiens
ggcgcgccagtcctctttttcctttcttccggatgagaggctaagccataatagaaagaatggagaattattgattgaccgtctttattctgtgggctctgattctccaatgggaataccaagggctcagttttctgtgcttggaccctctgggcccatcctggccatggtgggtgaagacgctgatccgactcggaccgatg

SEQ ID NO: 2932 - DNA, 203 bp, Homo sapiens
ggcgcgccagtcctggagcaaaggaggaaaactagggaatgggaggtgagagtggctgacaccgacccaacgtccgggttgccggaaggctgcagcgcccggagcggtgtcgggcaaaccgctaccctggtattgctggagcctctcctggggacttttgaacagatactgtggcctcatgaataggacgactcggaccgatg

SEQ ID NO: 2933 - DNA, 203 bp, Homo sapiens
ggcgcgccagtcctaaagctgacaagcaggtggcattcttcttcagagcagggcaagtgtaattctggaccaatgtgtgattctgagaccagaccaaccaactgaaggagccaagttacaccctgtttaaccctgccttcaaagggacgactctgtaagattctctgctacttattcaagttgacacgcgactcggaccgatg

SEQ ID NO: 2934 - DNA, 203 bp, Homo sapiens
ggcgcgccagtcctcgactaggcctagtcgtagcggcggccagcgggagggcgtagccgtagtcttggcccacgtcattctgtgccccgggtcaggtcaccgcccggagggtatgggaagagaaatgaagaagactggtactcccagacccttccgtatcgaggaccccaatcaacaacccacctgagcgactcggaccgatg

SEQ ID NO: 2935 - DNA, 203 bp, Homo sapiens
ggcgcgccagtcctccccacctcctgctcccatccccctggctcccgccgccctgtagctcggcagccctgccaggagcccggaagtgggtccgcacgagacagaatagactacactcaaactccaggggaaccgttcattgggcttggacacgaaggcgggaccctgccgacgcagtgattggatgccgactcggaccgatg

SEQ ID NO: 2936 - DNA, 203 bp, Homo sapiens
ggcgcgccagtcctaaggaagctgtaaatgtatttgagttaagcttttgcgagaaaccctacagcttggggcctgggctcctctgaccatcctcattgagaaaggaaagtgagtccagagaagttgatgcttcctacctgttggagcggcccagcagtgtaagcgtggttgttactgccccatccgcccgactcggaccgatg

SEQ ID NO: 2937 - DNA, 203 bp, Homo sapiens
ggcgcgccagtcctggagactcgagacttgaagccagcttattctggacccacgcaggcgactgaagacgatgggacccactgccctgcattcggtaagtcccgggtctaacggatgatccatatatttcaggtgaggagcaaaagaagggatccacctattcagttccaaaatctaaggagaagttgcgactcggaccgatg

SEQ ID NO: 2938 - DNA, 203 bp, Homo sapiens
ggcgcgccagtcctaggcgacatgtgagggccctgagccccctgactggaagcaggggctgtttttcaactcctggactaaagcccagaagcagctggggaagctccaggctacctacacaacctggcccaggctggtcacggtgtcccccctccctgctctgtgccctctccttccagaaatccacccgactcggaccgatg

SEQ ID NO: 2939 - DNA, 203 bp, Homo sapiens
ggcgcgccagtcctctgaaatgctggtttttgtttttgtttttttattttacgagtggacacaattctcacctgagtccttggccacgtggcgctatggcggtcactaccgggaattaaccacggccaccctctcagagcgccgggcgcggactcagggacacgccggctaccacctgagccggcccccgactcggaccgatg

SEQ ID NO: 2940 - DNA, 203 bp, Homo sapiens
ggcgcgccagtcctctctactcaaggaaatctttgtttccactgggacggaatcggagctctggaggctgggctggccaagcgccccgaaggcccgatgcctgacggctcatgcggcctccttgtttgcagggcctgggcaaaaatttacactgagtcccactcttcgctccagggcccggcaggaagcgactcggaccgatg

SEQ ID NO: 2941 - DNA, 203 bp, Homo sapiens
ggcgcgccagtcctccatgcactgagctggggacatgcaacaataacaggccatacaatgaaagtcgctgaagaagaatatgaattttgcctgcggatttgctaacactcgacaatcctaggaggtgagttccaacaaattggttcaaaaagaggggggataaacacgctggcccatgctgggcaagccgactcggaccgatg

SEQ ID NO: 2942 - DNA, 203 bp, Homo sapiens
ggcgcgccagtcctggcgaggcctcacggtggaactctcagatgacagcatgcaggcaccaagagagtggacgcacatacagaagacagccatgcactgagctggggacatgcaacaataacaggtgagttccaacaaattggttcaaaaagaggggggataaacacgctggcccatgctgggcaagccgactcggaccgatg

SEQ ID NO: 2943 - DNA, 203 bp, Homo sapiens
ggcgcgccagtccttagatacgtaaacacccaggaaggcagggggctccctttatccaaggaggtggctgtgcaggtggccaccacaggtggcaggaaccacaggctggggcactccggagtcaggagtgagtgggcaggttgactggcatcaggcagcctctcagccagggccctctccgcatcagccgactcggaccgatg

SEQ ID NO: 2944 - DNA, 203 bp, Homo sapiens
ggcgcgccagtcctacgtgatgcaggaggtgcccgaggcggcggggctcgcgcgggtggagccgcctcggcgttcgagcggggtgggggctgcccggttgagatttcccggcgggtcccggcctctgcgtgcacgcgcctgcgtgctcgcgctcgcggttctggcgctgccggaataatgctgacagccgactcggaccgatg

SEQ ID NO: 2945 - DNA, 203 bp, Homo sapiens
ggcgcgccagtcctcgctccgcactcacccgccctctgggcctcccacaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagcgactcggaccgatg

SEQ ID NO: 2946 - DNA, 203 bp, Homo sapiens
ggcgcgccagtccttctgcccaggcagggagcggctgggatgggactgaggaatcaaagatcaactcccactgaggacaaatggacctgtaattccgggtgtgacgagagaacgagatttaccttcctgaattaaaaaacaggtcattaagcttgggccctgactcttctttgtgagaaggtacagagcgactcggaccgatg

SEQ ID NO: 2947 - DNA, 203 bp, Homo sapiens
ggcgcgccagtcctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctccgactcggaccgatg

SEQ ID NO: 2948 - DNA, 203 bp, Homo sapiens
ggcgcgccagtcctataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctcccgactcggaccgatg

SEQ ID NO: 2949 - DNA, 203 bp, Homo sapiens
ggcgcgccagtcctaacacctccctccagtggtcaaatccagctcaacagactctgtactttgacgacaagaaagctttaagggacaataggatcgagctggttcgcgcttcctggcatgaattgagtattagtgtcagtgatgtgtctctctctgatgaaggacagtacacctgttctttatttacacgactcggaccgatg

SEQ ID NO: 2950 - DNA, 203 bp, Homo sapiens
ggcgcgccagtcctgggtcccaaagcaaaaaaggaacactgtcatcacaaacaggcttcagtggccaaagatctggcagtaagaaaaagaaagtcaccaaagctgaacgattgaagctgctacaagaggaggaggagagacgactgaaagaggaagaggaagcccgtttgaaatatgagaaagaagaacgactcggaccgatg

SEQ ID NO: 2951 - DNA, 203 bp, Homo sapiens
ggcgcgccagtcctcagtgatcggcttaggaccgctttctaggtggtgaggacaagagtgatggctgttttagtacttcaggtggaattcgtccttttcatcttcagaactggaagcagaaagttaatcagactaagaaagcagaatttgtacgcacagcagaaaaatttaaaaatcaagtaattaaccgactcggaccgatg

SEQ ID NO: 2952 - DNA, 203 bp, Homo sapiens
ggcgcgccagtcctccgaccctggggcgtcgggtccggtggtcttgcagcctccaaaccccgagtgctataccgaactgcgcgccaagggtgggagagctgacggcctgggccacccttcttccttcactgggcaggctttgaggtgcttgtcggtctggactgatgaaaatccatatgacctgaaagcgactcggaccgatg

SEQ ID NO: 2953 - DNA, 203 bp, Homo sapiens
ggcgcgccagtcctgggagagttgcatcgccctccacagagcaggcttgcatctgactgacccaccatgacacccacagacttcacatctcctccaggccccgctccagatcaccttccctcgctggcccaggaatccatctccttccaggaccttagcccaggactaacacaagccctattcctaaccgactcggaccgatg

SEQ ID NO: 2954 - DNA, 203 bp, Homo sapiens
ggcgcgccagtcctgggttcacagaggagggaactgaatgacatcccaggattacataaactgtcagaggcagccgaagagttcacaagtgtgaagcctggaagccggcgggtgccgctgtgtaggaaagaagctaaagcacttccagagcctgtccggagctcagaggttcggaagacttatcgacccgactcggaccgatg

SEQ ID NO: 2955 - DNA, 203 bp, Homo sapiens
ggcgcgccagtcctggctgccagcttcctttcggcccctgcttttgtgctccctccgctcccaaactgtacctgtcacagaccaggaaaaatgtttgctgtgctgcgtctgttggcgagtcccctcctcacccggttcccttcctctgcatcctttcctcagcttgagaaacacctctttgccccgtccgactcggaccgatg

SEQ ID NO: 2956 - DNA, 203 bp, Homo sapiens
ggcgcgccagtcctagtcctggcattatttctctctctacaaggagccttaggaggtacggggagctcgcaaatactccttttggtttattcttaccaccttgcttctgtgttccttgggaatgctgctgtgcttatgcatctggtctctttttggagctacagtggacaggcatttgtgacagcactcgactcggaccgatg

SEQ ID NO: 2957 - DNA, 203 bp, Homo sapiens
ggcgcgccagtcctcacccttctcctcctccgcccagtactcgtggccagggtcgtatcagttctccgtcaacttgcttggggccttggacgagcctcctggcgcttcctgtcagtggcgaaaagctgctttgctccccctgtggatgtaaccccttagctggcattttgcatctcaattggcttgtgcgactcggaccgatg

SEQ ID NO: 2958 - DNA, 203 bp, Homo sapiens
ggcgcgccagtccttagagccgctctctctcactggcacagcgaggttttgctcagcccttgtctcgggaccgcaggtacgtgcctggcgacttcttcgggtggtccccgtccgccctcctcgtccctacccagtttcttgcttccctgccccatctccgccgctccccgcagcctccgccgagcgcccgactcggaccgatg

SEQ ID NO: 2959 - DNA, 203 bp, Homo sapiens
ggcgcgccagtcctgagcaatcttctcagccgtgcactcacagcttggaaaataaagggaggaaggagtcccagccacagggtagaggaacggcctctccacagagaagctgctgctgctgagctgaagtgacagtcaagttcagcagctgtgtggggaccaaggggacacaatatgagaccaacagccgactcggaccgatg

SEQ ID NO: 2960 - DNA, 203 bp, Homo sapiens
ggcgcgccagtccttggcggagccagatctggagtgcgagcagatccgtctgaagtgtattcctgggacgatgccggagtgtgaaggagtttgagaagctgaaccgcattggagagggtacctacggcattgtgtatcgggcccgggacacccagacagatgagattgtcgcactgaagaaggtgcggcgactcggaccgatg

SEQ ID NO: 2961 - DNA, 203 bp, Homo sapiens
ggcgcgccagtccttttccggagcaggggaagctgccccgtgcccgggagggagcgggcgcaccgcggcccccaggacacgcgctgtgagtcccgcgggcggtgcgcctgggaggaagggggaggtcggaggagggggcaccgcggcgccgggtataaggagcaaaggacccggctgcccagtccctccgactcggaccgatg

SEQ ID NO: 2962 - DNA, 203 bp, Homo sapiens
ggcgcgccagtccttctcccaacaatgctaggaaacaaatctccagatccaccaacagcaacttttctaagacctctcctaaggcactcgtgattgggaaagaccacgaatccaaaaacagccagctgtttgctgccagccagaagttcaggaagaacacagctccatctctctccagccggaagaaccgactcggaccgatg

SEQ ID NO: 2963 - DNA, 203 bp, Homo sapiens
ggcgcgccagtcctgagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagcgactcggaccgatg

SEQ ID NO: 2964 - DNA, 203 bp, Homo sapiens
ggcgcgccagtcctcaagccggggaccaagccggggaccaagccggggactaaggcgagccggagaccgagcccgaacagcagtcccgcagcgtggacaagcagcatgccgtcatcaactacgaccaggacagggacgagcactgggtgaaggacctgggcagcctcaatgggacgtttgtgaatgaccgactcggaccgatg

SEQ ID NO: 2965 - DNA, 203 bp, Homo sapiens
ggcgcgccagtcctgctcccagctttgaaggtcttgcggtgaagcatcaagtgtacctgatttgtgaacctatcttgcttcagttggtttcctcctaaatattaggcagatgggattggctggtctgtgctctgctaggtgaaaaattagacgatttcaagaattggagctgaatctgatgttaagtacgactcggaccgatg

SEQ ID NO: 2966 - DNA, 203 bp, Homo sapiens
ggcgcgccagtcctaagtcggtaggacgtcttcgcgttgacttgtggggaatgtagtttcgatgctgccggcgcgttttgtttgcgacagaaactacaacccccaggggccaccgcgacgttgcctgtgggtgcccgcgaaccaacggttagcggtggcaggggctgactgagagcgtctgcttgatacgactcggaccgatg

SEQ ID NO: 2967 - DNA, 203 bp, Homo sapiens
ggcgcgccagtcctcattcccgcgcctccaaaacctaggccgggggcgctggaaacccttaccggcacccggccaccgcggcagacgcttgctcctgccacgccccccccccctcccccgcatcacgtgtctgcactcgctttcctcggattcccggatgtggttgccaaaacaaaggggatttggtgcgactcggaccgatg

SEQ ID NO: 2968 - DNA, 203 bp, Homo sapiens
ggcgcgccagtcctacgctcttaccagctggagggagtaaactggctcgcccagcgcttccattgtcagaatggctgtatcctgggagatgagatgggcctggggaagacctgccaggaagattaaatgatgaagggccatttctgattctttgtcccttgtctgttttgagcaactggaaagaagaacgactcggaccgatg

SEQ ID NO: 2969 - DNA, 203 bp, Homo sapiens
ggcgcgccagtccttgataaccacagaatcagaacatataaaaagctctgcgggactggtgctgactgcaaccatgacaaagcttattctcctcacaggtcttgtccttatactgaatttgcagctcggaacagccagctgaaaactctcctggccattggaggctggaacttcgggactgccccgaacgactcggaccgatg

SEQ ID NO: 2970 - DNA, 203 bp, Homo sapiens
ggcgcgccagtcctctgaaagccggaaggggcaagacgggttcagttcgtcatggggctgtttggaaagacccaggagaagccgcccaaagaactgatatccaaagagaagaagaaaaagtgaaacgatctgtgaaagatgctgccaagaagggccagaaggatgtctgcatagttctggccaaggagcgactcggaccgatg

SEQ ID NO: 2971 - DNA, 203 bp, Homo sapiens
ggcgcgccagtcctgccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcagcgactcggaccgatg

SEQ ID NO: 2972 - DNA, 203 bp, Homo sapiens
ggcgcgccagtcctcacggggcgctggctccgggtctggcggccgctgatgggagtcggagcccgggcgggcgagcggcggcgcggcggccaccatggggaacaagcagaccatcttcaccgaagagcagctagacaactaccaggctgcattcgcgattctatgagctggcccccaacctcgtcccacgactcggaccgatg

SEQ ID NO: 2973 - DNA, 203 bp, Homo sapiens
ggcgcgccagtcctagaatgttcttttggccactgtgaagcctcaggaaggggctcggattgctcaaggacccatgggagagaggaggctttgactgggctgcctgcctgtgaggtctctggactagaggtccaacgcagtccagctgacaaggatggaatacgccatgaagtcccttagccttctctcgactcggaccgatg

SEQ ID NO: 2974 - DNA, 203 bp, Homo sapiens
ggcgcgccagtcctactgttgaagccgcagtctccactctcctactgacaccagagaccacccagcccagccaaaccatatggcctcttgttttcctgatgtatgagggctccggctggcacctgaggagcggcgtgaccccgagggcccagggagctgcccggctggcctaggcaggcagccgcacccgactcggaccgatg

SEQ ID NO: 2975 - DNA, 203 bp, Homo sapiens
ggcgcgccagtccttccctatggttgcccaagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggacccgactcggaccgatg

SEQ ID NO: 2976 - DNA, 203 bp, Homo sapiens
ggcgcgccagtccttctcccgccacccacaccagctgtcccactcaccatggagaagatcctgatcctcctgcttgtcgccctctctgtggcctatgcagctcctggcccccgggggatcattatcaacctggctggagtgtagtggcacaatctcggctcactgcaatctctgcttcccgggttcaacgactcggaccgatg

SEQ ID NO: 2977 - DNA, 203 bp, Homo sapiens
ggcgcgccagtccttctgaaactatcttgttgttgatgcaggctattttcttgaccccttcatgggactcccaacaggggtaccccatttactcagcctgccctgctcaacctcttgcaggagggagcacacgagtgaacgagtgcaggaaccagctggctgctttagtgctgtgaggagtaaactcccgactcggaccgatg

SEQ ID NO: 2978 - DNA, 203 bp, Homo sapiens
ggcgcgccagtcctacctgcaggcccgggccgcggggttggtttccaccctggaggttgctgacaccctgtgccctcggctgacttccagccggtggcacagacgcctccagggggcagcactcaagcgcatcttaggaatgacagtaacagcgggaacatgaagccgccactcttggtgtttattgtcgactcggaccgatg

SEQ ID NO: 2979 - DNA, 203 bp, Homo sapiens
ggcgcgccagtccttagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagcgactcggaccgatg

SEQ ID NO: 2980 - DNA, 203 bp, Homo sapiens
ggcgcgccagtcctttgcggctggggaggtctacgcttctagagcttgagccagcggggcgaccctgcagtggcaggactcggcaccgcgccctccaccgccggttggtggcctgcgtgacagtttcctcccgtcgacatcgaaaggaagccggacgtgggcgggcagagagcttcatcgcagtaggacgactcggaccgatg

SEQ ID NO: 2981 - DNA, 203 bp, Homo sapiens
ggcgcgccagtcctcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctcccgactcggaccgatg

SEQ ID NO: 2982 - DNA, 203 bp, Homo sapiens
ggcgcgccagtcctggcagtgtcctcgcgggccagcgacgggcaggacgccccgttcgcctagcgcgtgctcaggagttggtgtcctgcctgcgctcaggatgagggggaatctggccctggtgggcgttctaatcagcctggccttcctgtcactgctgccatctggacatcctcagccggctggcgcgactcggaccgatg

SEQ ID NO: 2983 - DNA, 203 bp, Homo sapiens
ggcgcgccagtcctagcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcaggcgactcggaccgatg

SEQ ID NO: 2984 - DNA, 203 bp, Homo sapiens
ggcgcgccagtcctcgggcagcgaagatgttagccttcgctgccaggaccgtggaccgatcccagggctgtggtgtaacctcagcggccaggcagtctctgtcctccagccaagttttccctcatcaaaacgatcttcgcagattctgacaggtgaagcctctgggcttcctgaagcccttctccttgcgactcggaccgatg

SEQ ID NO: 2985 - DNA, 203 bp, Homo sapiens
ggcgcgccagtcctgatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctacccgactcggaccgatg

SEQ ID NO: 2986 - DNA, 203 bp, Homo sapiens
ggcgcgccagtcctgaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaacgactcggaccgatg

SEQ ID NO: 2987 - DNA, 203 bp, Homo sapiens
ggcgcgccagtcctgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactccgactcggaccgatg

SEQ ID NO: 2988 - DNA, 203 bp, Homo sapiens
ggcgcgccagtcctgtcgcagtcatcatcaactacctgggccactgtatctccctggtggccctcctggtggcctttgtcctctttctgcggctcaggagcatccggtgcctgcgaaacatcatccactggaacctcatctccgccttcatcctgcgcaacgccacctggttcgtggtccagctaacccgactcggaccgatg

SEQ ID NO: 2989 - DNA, 203 bp, Homo sapiens
ggcgcgccagtcctttgacagctctgggcgaccggaggtggcgcccaaaggctgcccgggagatcggggctgggctggcgggggccaggaccccgcgccctctcggccgctcactctcgcgtccactccctcgcagtcacgccgggcgcgcactcccactccctctccgcacgcggctgcgggacgcgcgactcggaccgatg

SEQ ID NO: 2990 - DNA, 203 bp, Homo sapiens
ggcgcgccagtcctctctgaagggagctactcagaagcgggagtctccgagagaagaaaagcaggtggaaggagaggaagcggatgccgtggggtttacagcaggaaaatccgtggagacagcagatccgagaagcggcgatgtttgcgtagaaccctctcttcccttctctctgaccagcaccatgccgactcggaccgatg

SEQ ID NO: 2991 - DNA, 203 bp, Homo sapiens
ggcgcgccagtcctaagcgggagtctccgagagaagaaaagcaggtggaaggagaggaagcggatgccgtggggtttacagcaggaaaatccgtggagacagcagatccgagaagcggcgatgtttgcgtagaaccctgtacgtgcttccttcggcctgtcgctcttcccttctctctgaccagcacccgactcggaccgatg

SEQ ID NO: 2992 - DNA, 203 bp, Homo sapiens
ggcgcgccagtcctagcatcccaaggcccgactccccgcaccactcagggtcctgtggacagctcacctagcggcaatggctgcaggaagaagcctatatcacaaaggaacagaagtattcattcctgcatgactcccagacctccttctgcttctcagactctattccgacatcctccaacatggagcgactcggaccgatg

SEQ ID NO: 2993 - DNA, 203 bp, Homo sapiens
ggcgcgccagtcctgcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggttgtggcagcactgcctgaaggtcgactcggaccgatg

SEQ ID NO: 2994 - DNA, 203 bp, Homo sapiens
ggcgcgccagtcctcagtatctcagtgcctcctgtgggccctcctcccctccttatccattccccctcagatctcccaggccccctgcaggccctcgtgccctccttacttcccccccgggtctcccagcgccccctgcggggccctcctcccttcctcatccacttcaaccccaaggccaagtcattcgactcggaccgatg

SEQ ID NO: 2995 - DNA, 203 bp, Homo sapiens
ggcgcgccagtccttcccttccccttccctgcccccttcccccacccccgactcgggcttggcgcggcggccagaggaaccccgagcccgcatttgctgcatcgagcagttggtttagtatcagccaaacttgcagctgttcagaccgcgctccgccgagtcccggcccaggcccctgagctggagggcgactcggaccgatg

SEQ ID NO: 2996 - DNA, 203 bp, Homo sapiens
ggcgcgccagtccttgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagagttctgagaaatcgagaaaccgactcggaccgatg

SEQ ID NO: 2997 - DNA, 203 bp, Homo sapiens
ggcgcgccagtcctagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaaccgactcggaccgatg

SEQ ID NO: 2998 - DNA, 203 bp, Homo sapiens
ggcgcgccagtcctgtaatggcagcgctgtgagcaggggaacgcgagctgacagccgccgccgccgccgcctccgcccaccttcctcgccggggcttcgtctttcactccttcgggctgcctccccctccccttgtcccctgccccttgccctgcttctgcagaagatttcaacactacacttgcacacgactcggaccgatg

SEQ ID NO: 2999 - DNA, 203 bp, Homo sapiens
ggcgcgccagtcctctcacgcgggtgcagctctgttccgcggaggcacgccccctcccgtctctccgtctcgaccccctcgcggggcccaggtggggcccaagtcgccgccagcgtctgtgccgcgtcccttgctctgtgaaggacaggcctcgcgccaggaccccggtggacttctgaggtgccaggcgactcggaccgatg

SEQ ID NO: 3000 - DNA, 203 bp, Homo sapiens
ggcgcgccagtcctctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgacgactcggaccgatg

SEQ ID NO: 3001 - DNA, 203 bp, Homo sapiens
ggcgcgccagtcctcccagtgtggtccagtgagtactctgggctccctctcgtgggcagggaagctgagggccccatgagctctcccagcttcctgaaggctccccattaatgagagctgactgtgctgtgctttgctgactgcagggcctgctccctgccccccacctccaggttggggccttcacccgactcggaccgatg

SEQ ID NO: 3002 - DNA, 203 bp, Homo sapiens
ggcgcgccagtcctccatgtttactactgtttgtgcggccagatggtcctagtgctgggtgagtagccgggaactgcgggggcgtctgcaaggagccagacttcgggttcttgaaggcgaatttcctctggctgtgatctgggagccacttctcaacgaagattgactgccagttagagaaattgccccgactcggaccgatg

SEQ ID NO: 3003 - DNA, 203 bp, Homo sapiens
ggcgcgccagtcctgtcatcgaccctgaagatgtggcccttctctttaagtccgagggccccaacccagaacgattcctcatcccgccctgggtcgcctatcaccagtattaccagagacccataggagtcctgttgaagaagtcggcagcctggaagaaagaccgggtggccctgaaccaggaggtgcgactcggaccgatg

SEQ ID NO: 3004 - DNA, 203 bp, Homo sapiens
ggcgcgccagtcctgagaaggaagctccctcctggccccactcctcttcctattattggaaatatgctacagatagatgttaaggacatctgcaaatctttcaccaatgtaagtctgccttatgttcctccagccaattgcaaaggttctcaaaagtctatggtcctgtgttcaccgtgtattttggccgactcggaccgatg

SEQ ID NO: 3005 - DNA, 203 bp, Homo sapiens
ggcgcgccagtccttttagatccagatatacattgggtaaaatctacttcataggttttcaaaggagcattcttctgagcaaatctgaaaactctctaaactctattgcaaaggagacagaagaaggaagagagacggtaacaaggaaagaaggatggaagagaaggcatgaggacggctatttggaacgactcggaccgatg

SEQ ID NO: 3006 - DNA, 203 bp, Homo sapiens
ggcgcgccagtcctcctctgggtggacgcctaggcgcacggccgttacttctctttcacctgtggattcgtcagtttctcgttcgtttcaggaggcgatcccgcgccctgggtgcggtgaggccgctgggacagcggaggtgcctcccgacgcgaagcagcgagctgaggcggcggccagcggggaagcgactcggaccgatg

SEQ ID NO: 3007 - DNA, 203 bp, Homo sapiens
ggcgcgccagtcctcctgtgactaaggagttgttgttaacgagcccgaaatacagattttggaagaaacgaattatatctattgaaatcgagactcctacccagatatctttagtggatgaagcatcaggagagaaggaagagattgttgtgactctcttaccagctggtcactgtccgggatcagttcgactcggaccgatg

SEQ ID NO: 3008 - DNA, 203 bp, Homo sapiens
ggcgcgccagtcctgaagagaagcagaggccagctgtttttgaggatcctgctccacagagaatgctctgcacccgttgatatgcctcccaggacccagagggagactgtagcctcatttctgtggagacctttggctggactctcctggctctcccagagactccagttccaacaccatcttctgagcgactcggaccgatg

SEQ ID NO: 3009 - DNA, 203 bp, Homo sapiens
ggcgcgccagtcctgattcccggggcctggctttcagcgtagcaattctgccggcgaagaaggtgagcgcagtgctgtgtggcagcagagctccttaggacgaggagcagcgggacgaggaagggcagactggtgaaatcgcaaactgggcgtctgttccggcgccggacccctatttgcaaaggtcccgactcggaccgatg

SEQ ID NO: 3010 - DNA, 203 bp, Homo sapiens
ggcgcgccagtcctaacagcgcgggccgcgcgggcgtaggcggggtatctggaggaggcgcagggaacctggagagggtccagccctcagtgccccggccagaggcgggaaggggctctagagcttcgggaggcaagatgacttctctgccccaagcttggaacagctaaagggaaaaacagtgcaagcgactcggaccgatg

SEQ ID NO: 3011 - DNA, 203 bp, Homo sapiens
ggcgcgccagtcctgagctcatctgagagttgtaagactctaaggcagcccctgcatctcagtcctgacatcgctgtccctggagcatcctccgctggagctggagcttgacagagtctccatctgtcgctcaggttggagtgcagtggcgtgatcttggctcactgcaagctccgcatcccgtgttccgactcggaccgatg

SEQ ID NO: 3012 - DNA, 203 bp, Homo sapiens
ggcgcgccagtcctctcagtgccttcaagacatgtcgttttgtagtcagagaaaacagagatcaatgcattttcaaactgacagagggaacggatgctctttagtagcacatgcccaggatcgtgtgtgtggggcttgcgctgtgctgagaagctgaataccggtccatatgctccttatttactgcacgactcggaccgatg

SEQ ID NO: 3013 - DNA, 203 bp, Homo sapiens
ggcgcgccagtcctaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtacgactcggaccgatg

SEQ ID NO: 3014 - DNA, 203 bp, Homo sapiens
ggcgcgccagtcctcgctcactctcattggtcagttgctcgctgtggtcccatcccacatgcttccattgcttgattcctcgaaaagggcggggactctgggcagcggttgtggagtgccgcgggtccacagtgctgcactgagcagagaggaaggggcgtcccgggatatttggaggataaagggtgcgactcggaccgatg

SEQ ID NO: 3015 - DNA, 203 bp, Homo sapiens
ggcgcgccagtcctcgctggacctgcaggctgaaagtcctcctgtggacccagactcccaggccgatacagtgcacagcaaccccgagctagatgtgctgcttctgggctctgtggatggacggcacctgctgcggaccctgtcccgagcgaagttctggcctcgcaggaggttcaacgtgagctgggcgactcggaccgatg

SEQ ID NO: 3016 - DNA, 203 bp, Homo sapiens
ggcgcgccagtcctctctcttgggggtttgtgtttttacatcgtctttctgcacggttctccagcttcttgtccgcacgggctctgcaggtgttgcttgcctggaactcctgtaaggccagtacagtggtagcagttggactgaccattgctgctgcaggatttgcaggccgttacgttttgcaagcccgactcggaccgatg

SEQ ID NO: 3017 - DNA, 203 bp, Homo sapiens
ggcgcgccagtcctccgagcgggccatggccaccgccattcagaacccgctcaagtcgcgaggacttctaccgcgaggccatcgagcactgccgcagttacaacgcgcgcctgtgcgccgagcgcagcctgcgactgcccttcctcgactcgcagaccggcgtggcccagaacaactgctacatctggcgactcggaccgatg

SEQ ID NO: 3018 - DNA, 203 bp, Homo sapiens
ggcgcgccagtcctggcggcgcagcatgaagcggcgcaggcccgctccatagcgcacgtcgggagggtccgggcggggccggggggaaggctttgatggtgaggaaaggaaagattcctgtgagaagagcaggatgagcagagggattctatgcttgaagtcgagtcacttgaaaaagatctctttgacgactcggaccgatg

SEQ ID NO: 3019 - DNA, 203 bp, Homo sapiens
ggcgcgccagtcctctcgacccgccgcagccccggccccgaccgtggacactgggggtccccgagggcgctgcgacctcctcccgggtgaaatgaaacccgagggcagtcccccttaccgaccccattagagacgtatctgccgtgccaggggtctaggctccagaaacagggagtttaccacctaggcgactcggaccgatg

SEQ ID NO: 3020 - DNA, 203 bp, Homo sapiens
ggcgcgccagtcctttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagacgactcggaccgatg

SEQ ID NO: 3021 - DNA, 203 bp, Homo sapiens
ggcgcgccagtcctggcgcttcgtgtgaggttccacgggggaaggcgagaggcgcaggctgccacacacgcactgtttggaagaggggaagggctgcacttcctgctttcatccagaccaagttcggatcaagtgggagttcttcaaagagagagtttgcattgccccccctgcaccacctcaccaagcgactcggaccgatg

SEQ ID NO: 3022 - DNA, 203 bp, Homo sapiens
ggcgcgccagtcctggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagccgactcggaccgatg

SEQ ID NO: 3023 - DNA, 203 bp, Homo sapiens
ggcgcgccagtcctggtaagcttaccgtgaaaggagggtttgggctgttgttgctacacgtggatgtgaaatgagtcaagcggaactttgattacaaggaatttcatatactccttcccaccatggattgccaagaaaatgagtactgggaccaatggggacggtgtgtcacctgccaacggtgtggtcgactcggaccgatg

SEQ ID NO: 3024 - DNA, 203 bp, Homo sapiens
ggcgcgccagtcctgtcctctggtgttgagtggtcggcttggtgtggtgtgcggaggagctccaggcccgtcggcgcggagggtcttgctgtgttgcccagcctggtcttgaattcctggactcaagtgatgctcctgccttggcttcccaaactcctggaattacaacttggtctcacgtgtgaaaccgactcggaccgatg

SEQ ID NO: 3025 - DNA, 203 bp, Homo sapiens
ggcgcgccagtcctcttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagccgactcggaccgatg

SEQ ID NO: 3026 - DNA, 203 bp, Homo sapiens
ggcgcgccagtcctggggggcttgtgggtcctcctccccctcccactgacaactgccccaactgctcttcccgccccggtcacagtgaaaatgtagacggggtcgttgtccactatgttaggtcttaatggtgggaggacgcccgagtgctcggcccgtttcaccccgaggaggaaggacactgggtccgactcggaccgatg

SEQ ID NO: 3027 - DNA, 203 bp, Homo sapiens
ggcgcgccagtcctagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttcgactcggaccgatg

SEQ ID NO: 3028 - DNA, 203 bp, Homo sapiens
ggcgcgccagtcctctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgcaacatccgactcggaccgatg

SEQ ID NO: 3029 - DNA, 203 bp, Homo sapiens
ggcgcgccagtcctagggaataaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgcccgactcggaccgatg

SEQ ID NO: 3030 - DNA, 203 bp, Homo sapiens
ggcgcgccagtcctttctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagacgactcggaccgatg

SEQ ID NO: 3031 - DNA, 203 bp, Homo sapiens
ggcgcgccagtcctcggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaaggcttctctgcagacgactcggaccgatg

SEQ ID NO: 3032 - DNA, 203 bp, Homo sapiens
ggcgcgccagtcctccccagcagccacagccaggggagcgctcaagacagaaagccggtggcttcctcacctccacctgtaatgcaggcatccagcccgcactgtggagcagggaggacgtgctgcactggctgcgctgggcagagcaggagtactctctgccatgcaccgcggagcacgggttcgagcgactcggaccgatg

SEQ ID NO: 3033 - DNA, 203 bp, Homo sapiens
ggcgcgccagtcctggcttcctcacctccacctgtaatgcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagcgactcggaccgatg

SEQ ID NO: 3034 - DNA, 203 bp, Homo sapiens
ggcgcgccagtcctgatctcggggctcagggcggaaacgcagcggatatgtattttcttccggggttggtggcgctcggctctcatgacctgcaggtgacagtgttggccggtggcgcggccctgcttgcctcgtgccccgcccttcgtgcttgaaaaaaaatcccgcgaagccttctccgaaagaaccgactcggaccgatg

SEQ ID NO: 3035 - DNA, 203 bp, Homo sapiens
ggcgcgccagtcctggacttcccggtggagtgaggaacccagcaacacgctcctgacttcccttcccaaggactcgacctgagaaggacacagcagtctctgaatttcatgctctcctctttgatgtgaagaaaatgaaaagctgaacagttgtggaactgtggatagagttagacaataaggccgcccgactcggaccgatg

SEQ ID NO: 3036 - DNA, 203 bp, Homo sapiens
ggcgcgccagtcctagcaagcatgttctgcctggatgacctagggccccacattgaactggggcctgggggatgcataagtttgtcacgtaaggggcatgtgcaagaatggaagatgtgcaaaaaagggaggaggaggcatttcacggagaaggaaacggagtggaagcagcctgaggccctcatccacgactcggaccgatg

SEQ ID NO: 3037 - DNA, 203 bp, Homo sapiens
ggcgcgccagtcctcctgtacgtagtcacggtcttgtgctctaaggtgagtggaggacgagcttgggcttagcggcagcccgtatcacatcctagactttttacttcgaggagaagagtctcacgagttgtcctggaagaaaacgacagcacgtgttctttttcactagtagaagtgacgttggtttccgactcggaccgatg

SEQ ID NO: 3038 - DNA, 203 bp, Homo sapiens
ggcgcgccagtcctttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgaccgactcggaccgatg

SEQ ID NO: 3039 - DNA, 203 bp, Homo sapiens
ggcgcgccagtcctgtggcagagctacgccttgcaccccgaccttccgttgctagctccagctgctttccaaaataccaccttgacttctcagtctccaggtttaaaggagagcaactagaagtcgtccaaacacctgcatctcataaggagaagaaaagtccacctggatcttgtttctggactgagcgactcggaccgatg

SEQ ID NO: 3040 - DNA, 203 bp, Homo sapiens
ggcgcgccagtcctactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggcgactcggaccgatg

SEQ ID NO: 3041 - DNA, 203 bp, Homo sapiens
ggcgcgccagtcctttagcggggagcagctagagggacaggagggagggaaggaaggaaggaggaaacctggaagatgaggtcagccacgagagataaggggtaagaatatccggcagacttagcgttccggaggtggccctggagaggacatcgtgacccagagtgaaggatctgtcgcaggaaagacgactcggaccgatg

SEQ ID NO: 3042 - DNA, 203 bp, Homo sapiens
ggcgcgccagtccttttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggcgactcggaccgatg

SEQ ID NO: 3043 - DNA, 203 bp, Homo sapiens
ggcgcgccagtcctcgccgcgcctcggcctcggtgcaggcagcggccgccgccgccgagacagctgcgcgggcgagcatccccacgcagcaccttggaagttgttttcaaccatatccagcctttgccgaatacatcctatctgccacacatccagcgtgaggtccctccagctacaaggtgggcacccgactcggaccgatg

SEQ ID NO: 3044 - DNA, 203 bp, Homo sapiens
ggcgcgccagtcctctcggctgcagacttggccaaatggacgggactattaaggaattctttctctgggtcatccactgctgagccccctccccaggaagtggaattgaggctctgtcggtggtgagcgacgaccagtccctctttgactcagcgtacggagcggcagcccatctccccaaggccgaccgactcggaccgatg

SEQ ID NO: 3045 - DNA, 203 bp, Homo sapiens
ggcgcgccagtcctagacatgagtctagcacctgggactcatgaagttctgaaaagaggggtgtcctgaaggtccaaggcgcctttgttgggggtcccggaatccgcggtgtgccaggtcggaaaaggcgtccgctttcctggagaggaggctaaggtgccgggcgcttcgattctctttgtggccagcgactcggaccgatg

SEQ ID NO: 3046 - DNA, 203 bp, Homo sapiens
ggcgcgccagtcctgtgaggcagacgaactcgcggctctccggcttccgaggcttccgagttgtcggaggaagggggcggcgagcaataagaacccgccgcacccggtcctcagcgactcttctgacctccgcgcgacgtacccgccgccgccgttggctggagcatttgacattgtgcagcaaagaacgactcggaccgatg

SEQ ID NO: 3047 - DNA, 203 bp, Homo sapiens
ggcgcgccagtcctctgcgcgcccccgggcacgaccccggagtctccgcgggcggccagggcgcgcgtgcgcggaggttctcctcgtccgcccgttgttcagcgagggaggctctgcgcgtgccgcagctgacggggaaactgaggcacggagcgggcctgtaggagctgtccaggccatctccaacccgactcggaccgatg

SEQ ID NO: 3048 - DNA, 203 bp, Homo sapiens
ggcgcgccagtcctcgcgggggccgtaggaagccaaccttccctgcttctccggggccctcgccccctcctccccacaaaatcagggatggaggcgcctccccggcaccctcttagcagccctccccaggaaaagtgtcccccctgagctcctaacgctccccaacagctacccctgccccccacgcccgactcggaccgatg

SEQ ID NO: 3049 - DNA, 203 bp, Homo sapiens
ggcgcgccagtcctggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgaccgactcggaccgatg

SEQ ID NO: 3050 - DNA, 203 bp, Homo sapiens
ggcgcgccagtcctttggggctgctgtttctcttcgccgacggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggcgactcggaccgatg

SEQ ID NO: 3051 - DNA, 203 bp, Homo sapiens
ggcgcgccagtcctcttctcttacactgcatacctgtgtctgagtactcttttcatcagtcactcagccagggtctgcagcatgaacccagcagctggtgtcccctatgaggaactcagcaacagattgcgacagaacccttgagaacaaaggagagaggaggtgctgcaagactctctggtagaaaacgactcggaccgatg

SEQ ID NO: 3052 - DNA, 203 bp, Homo sapiens
ggcgcgccagtcctaggaaaactaggcccctgcgcggccaacgcccaggatccgcaagctgcgcgcccacgagctccaccagcccattggagaaaagttactgttcagtccctgaaggcttgtgccataaaagagtgggagacattcccagggagtttcagcacccatttggactttcacaatcagagcgactcggaccgatg

SEQ ID NO: 3053 - DNA, 203 bp, Homo sapiens
ggcgcgccagtcctgcctgcagctcggtgcgctctgggcacccgggcgccttgcccggtgcacggcggctggcgcaccgcggctagattggctacaggagcggggtgcaggactggctagaggtgggtgtgtgcgcgcgttggactggagatccgagcagaagcagaaccaggcggctctgagcagcccgactcggaccgatg

SEQ ID NO: 3054 - DNA, 203 bp, Homo sapiens
ggcgcgccagtcctggcggtggctgctgccagacccggagtttcctctttcactggatggagctgaactttgggcggccagagcagcacagctgtccggggatcgctgcacgctgagctccctcggcaagacccagcggcggctcgggatttttttgggggggcggggaccagccccgcgccggcacccgactcggaccgatg

SEQ ID NO: 3055 - DNA, 203 bp, Homo sapiens
ggcgcgccagtcctagtaggacaatatgagactctggggcagtgaaagacttaccaggattccttctggaactgactcgtcagctcattcatgtcttacccagtctttaaacagtatttcatgataatggtctgcttttaattgctgggctttaccttaccctttttgtgattgcaggtcctacaggtcgactcggaccgatg

SEQ ID NO: 3056 - DNA, 203 bp, Homo sapiens
ggcgcgccagtcctaacctcagtgcgtgaactctgttatccagaaggcctcgccctgccgccgccgaagctggaattcgtcggctagtagttctcgccggcaactagaggaacctgttggcgtggcccagaaggcttagcgggattgcacgagccctcagattcatcgctaccccgaggctaagcgcccgactcggaccgatg

SEQ ID NO: 3057 - DNA, 203 bp, Homo sapiens
ggcgcgccagtcctagtcgtctacccgcgcgcccgagcgcggaaaccgaggggcaggctcgcgctctgcctgcttcgtggcgcttggttcgtccctcgcccgaggagcgcggtggcggcgtgggagggagcctctgacggcgtctggaactctattttaagaacctctcaaaacgaaacaagcaaatccgactcggaccgatg

SEQ ID NO: 3058 - DNA, 203 bp, Homo sapiens
ggcgcgccagtcctggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgccgactcggaccgatg

SEQ ID NO: 3059 - DNA, 203 bp, Homo sapiens
ggcgcgccagtcctggggacacctcccgcgccatctcgggggcactggagataaggaaaggaacctcctccctggctgggatggctgcccgggcgcgggaggagggccggggacccggtgagggaggaccgtagggcccgtgggggcttcacgcctggcaggcggccggccaggcctccctccctgaccgactcggaccgatg

SEQ ID NO: 3060 - DNA, 203 bp, Homo sapiens
ggcgcgccagtcctggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtacccgactcggaccgatg

SEQ ID NO: 3061 - DNA, 203 bp, Homo sapiens
ggcgcgccagtcctaaaaaaggtctttgccaatcctgattcccggaagagagtcggcagaattccttcctttaggcccctctggagccttggccgaccagccacttctgtggtctggggacagtcaccgagggtatcaaaaagccattcacagaggtcatccgagccaacatcggggacgcccaggctcgactcggaccgatg

SEQ ID NO: 3062 - DNA, 203 bp, Homo sapiens
ggcgcgccagtcctagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctcgactcggaccgatg

SEQ ID NO: 3063 - DNA, 203 bp, Homo sapiens
ggcgcgccagtcctgccctcccgaattctctgctcctctccccaccccactgttggtctgtgatttcgaggcaggcgtggccccctgcagcctggaatgaagtcactggggctgtttggagaccggggctgtttggaggacaagggcacacaactggttccgttaagcccctctctcgctcagacgcccgactcggaccgatg

SEQ ID NO: 3064 - DNA, 203 bp, Homo sapiens
ggcgcgccagtccttcggattccaagggaaacagacaaacctcacgaaaggaaggaagcaagcaagcaaggaaggaactgcaggaggaaaagaacaggcagaacagcgagaagaataaagggaaagggggggaaacaccaaatctatgattggacctgggcttctttttcgccaatgcaaaaaggaatcgactcggaccgatg

SEQ ID NO: 3065 - DNA, 203 bp, Homo sapiens
ggcgcgccagtcctgctccctcctttgtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccaccgactcggaccgatg

SEQ ID NO: 3066 - DNA, 203 bp, Homo sapiens
ggcgcgccagtcctccgccccgccgcccggaaccagctgagcgcagctggacccagcagccgctgtctccagtgccgcagcagcaggtagtgctcatagctctctttgtccagtgcttcggccttggtcccagcgccttcccacggagcagcactcttcaccctgcacagccttgttagcccaacagccgactcggaccgatg

SEQ ID NO: 3067 - DNA, 203 bp, Homo sapiens
ggcgcgccagtcctagtgttgcctgactcagtttccaagcttgactcttccctttggcatagtgagtttggagtcaagagatttttattttcccttcacaagctgaacaggagcctttggagagaacgctctggaccggaagcgcgcccccggggccggtcccggagggctcgatccgcatctacagccgactcggaccgatg

SEQ ID NO: 3068 - DNA, 203 bp, Homo sapiens
ggcgcgccagtcctccatctttactttctccacaaaagcccatcctctattcctatttccgaagctcctgctcatggagagttcgaattgctctggccttgaaaggcatcgactacgagacggtgcccatcaatctcataaaggatgggggccaacagttttctaaggacttccaggcactgaatcctcgactcggaccgatg

SEQ ID NO: 3069 - DNA, 203 bp, Homo sapiens
ggcgcgccagtcctactttactagtcaagccgcggagtgggcggggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcgactcggaccgatg

SEQ ID NO: 3070 - DNA, 203 bp, Homo sapiens
ggcgcgccagtcctggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacacccgactcggaccgatg

SEQ ID NO: 3071 - DNA, 203 bp, Homo sapiens
ggcgcgccagtcctgaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttacgactcggaccgatg

SEQ ID NO: 3072 - DNA, 203 bp, Homo sapiens
ggcgcgccagtcctcttgggaaagggacgctacaaaataaagctcaccccaacagctgagaagagggtgcagaaatccagggaggtcatagatagcatcataaaagagaaaacagggagcttcaggtcaacttagtacgctcacattcttcaggtgttgggaaaccactaagtcctgagaggtgtcggcgactcggaccgatg

SEQ ID NO: 3073 - DNA, 203 bp, Homo sapiens
ggcgcgccagtcctaagactgtcagctacgattttctctagcctcaagaagactgagaccgagccaaactcctggccaacgtgctttgtggattcacagtgtagcttgagaaaaatgtggatgtgaagtcagaagttcctgtgggcctggagcccatctcacctttagacctaaggacagacctcaggcgactcggaccgatg

SEQ ID NO: 3074 - DNA, 203 bp, Homo sapiens
ggcgcgccagtcctgttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggacgtgggttggcaataagagaagaaagcgactcggaccgatg

SEQ ID NO: 3075 - DNA, 203 bp, Homo sapiens
ggcgcgccagtcctcttggctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagcccgactcggaccgatg

SEQ ID NO: 3076 - DNA, 203 bp, Homo sapiens
ggcgcgccagtcctgagggtggcgtcccggggaagcccgcagccgccgccgatgtcgctgggactcggaagtgccgaaagaggggtgttgggaactcgcggcgcgcgtgaacgttgccgtcgccgccgcccgggacagcccggagaaactctcagcgtaggcatcgggaaccttcgtgccaaggagcccgactcggaccgatg

SEQ ID NO: 3077 - DNA, 203 bp, Homo sapiens
ggcgcgccagtcctacccaaggccggccctttcctgtggagtcatctcaccgccgtgcgcacccactcgtaactcgcacccgggtcctggctgcaccgcatcccctcctgcaccccctggatggcccttcagccaacgggggcctgggcgatggtcgaccacggagctgcgcaaggaaaagtcccgggcgactcggaccgatg

SEQ ID NO: 3078 - DNA, 203 bp, Homo sapiens
ggcgcgccagtcctgagggacatcttttcaagtagaggctgtgttggggcatggtgagagagggtcttagcaggtaaccttcctttcctctccagactgaggaatcagagttctgattgtggagtgcctctctctaggacggggctgcagcataggagtctcagctgcttacatccaggtccaggattcgactcggaccgatg

SEQ ID NO: 3079 - DNA, 203 bp, Homo sapiens
ggcgcgccagtcctccactcacagccagtgacacttgcaaaaaactcccaaagccgtcttgggtttggctcccacagctcttgaccaatgtggccaaagctggacacctccttgggacactgggattattcataaatgcagcccgccctgactctccctgaatagcatctgaagtctttgtgaaggtccgactcggaccgatg

SEQ ID NO: 3080 - DNA, 203 bp, Homo sapiens
ggcgcgccagtcctccggttgtagatgtatctctccaggaagcgctgtgtcccattaaacgcgtagcattcctgccgtccctggaaaagtgctagaggcccacagtttcagtctcatctgcctccactcggcctcagttcctcatcactgttcctgtgctcacagtcatcaattatagaccccacaaccgactcggaccgatg

SEQ ID NO: 3081 - DNA, 203 bp, Homo sapiens
ggcgcgccagtcctgcacccttgtggcccaggcactttatggatgatcccttttagtgctcccagtaaccttccaagattgtcaagtggtcagactgttgtttgccattagcttgcagacctggggatccttatcggctaattgctgaagcaagtgtggacaacttcagcaagctgggggtggcgttccgactcggaccgatg

SEQ ID NO: 3082 - DNA, 203 bp, Homo sapiens
ggcgcgccagtcctcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcacgactcggaccgatg

SEQ ID NO: 3083 - DNA, 203 bp, Homo sapiens
ggcgcgccagtcctggtttgaaaggaaggcagagagggcactgggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactgcgactcggaccgatg

SEQ ID NO: 3084 - DNA, 203 bp, Homo sapiens
ggcgcgccagtcctgcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcgggggaccgactcggaccgatg

SEQ ID NO: 3085 - DNA, 203 bp, Homo sapiens
ggcgcgccagtcctcctagaacgagctggtgcacgtggcttcccaaagatctctcagataatgagaggaaatgcagtcatcagtttgcagaaggctagggattctgggccatagctcagacctgcgcccaccatctccctccaggcagcccttggctggtccctgcgagcccgtggagactgccagagcgactcggaccgatg

SEQ ID NO: 3086 - DNA, 203 bp, Homo sapiens
ggcgcgccagtcctacagtaaacacaaacaaaagggtgatgggattattttactgcatgcactgctgagcccgacattgtcacctcctctttgaggggttagaagaagctgagatctcccgacagagctggaaatggtgatgaatcttttttaatcaaaggacaatttcttttcattgcactttgactcgactcggaccgatg

SEQ ID NO: 3087 - DNA, 203 bp, Homo sapiens
ggcgcgccagtcctcaagtggatccgagccgcagagagggctggagagagtctgctctccgatgactttgcccactctcttcgcagtggggacacgggaccgagtgcacactggaggtcccagagcacgacgagcgcggaggaccgggaggctcccgggcttgcgtgggcatcacgtgccctcccccccgactcggaccgatg

SEQ ID NO: 3088 - DNA, 203 bp, Homo sapiens
ggcgcgccagtcctcgagggctcctgctggtactgtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctcgactcggaccgatg

SEQ ID NO: 3089 - DNA, 203 bp, Homo sapiens
ggcgcgccagtcctgccagaggcgcggaaggaagcagtgcccggcgacactgcacccatcccggctgcttttgctgcgccctctcagcttcccaagaaaggcatcgtcatgtgatcatcacctaagaactagaacatcagcaggccctagaagcctcactcttgcccctccctttaatatctcaaaggcgactcggaccgatg

SEQ ID NO: 3090 - DNA, 203 bp, Homo sapiens
ggcgcgccagtccttggacctgtgggctgggcagcagctgctgtggaagggctccttcaagcccagcgagcatgtgaaacccagggccccaggaaacctgacagttcacaccaatgtctccgacactctgctgctgacctggagcaacccgtatccccctgacaattacctgtataatcatctcacctcgactcggaccgatg

SEQ ID NO: 3091 - DNA, 203 bp, Homo sapiens
ggcgcgccagtcctcccggaggcggcggacgggctcggcagatgtagccgccgggccgaagcaggagccggcgggggggcgccgggagagcgagggctttgcattttgcagtgctattttttgaggggggcggggggtggaggaagcggaaagccgcgccgagtcgccggggacctccggggtgaacccgactcggaccgatg

SEQ ID NO: 3092 - DNA, 203 bp, Homo sapiens
ggcgcgccagtcctctaggtgacagacaggtacactgtatgctagccctgtatctgtctgagcagtggaatgtgccaggaaagaaggagcaaccactgactgatgaacctttgccagtctcccttccaagagggatgccagagccttctgtaagctcctgagatgtcactggtatctaggcaacagggcgactcggaccgatg

SEQ ID NO: 3093 - DNA, 203 bp, Homo sapiens
ggcgcgccagtccttaattaggaagctgtcagattttattgatcctcaagaaggatggaagaagttagctgtagctattaaaaaaccatctggtgatgatagatacaatcagtttcacataagatgctgttcccaaaactgctaatacactaccttctaaagaagctataacagttcagcaaaaacagcgactcggaccgatg

SEQ ID NO: 3094 - DNA, 203 bp, Homo sapiens
ggcgcgccagtcctgcccggcaggttgggggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaacgactcggaccgatg

SEQ ID NO: 3095 - DNA, 203 bp, Homo sapiens
ggcgcgccagtcctggcggctctgggccgccgagtcccctcctcccgcccctgaggaggaggagccgccgccacccgccgcgcccgacacccgggaggccccgccagcccgcgggagaggcccagcgggagtcgcggaacagcaggcccgagcccaccgcgccgggccccggacgccgcgcggaaaagcgactcggaccgatg

SEQ ID NO: 3096 - DNA, 203 bp, Homo sapiens
ggcgcgccagtccttgctggcgtcctcccttctctttgctgggttgtcagctgttcctcaaagcttctcgccatctctgaggccatggtaagtgtgactgtggcaagtgcaagtgtgaccagggatggtatggggatgcttgccagtacccaactaactgtgacttgacaaagaagaaaagtaaccaacgactcggaccgatg

SEQ ID NO: 3097 - DNA, 203 bp, Homo sapiens
ggcgcgccagtcctcagcctgaggcttccttttggttcccgccccgggacgggaggctccgtccgctccctggacagccggggtgctccctccttctccctcccgcgctctcctcccccgtccgtttgcagggaggtgctctcctcgggcggcggggaaggcggggctggcctgccactcctcctgctcgactcggaccgatg

SEQ ID NO: 3098 - DNA, 203 bp, Homo sapiens
ggcgcgccagtcctgagggaattactaagacttcttgctcatttctgagtattgtctttatatcctgacactatgaatgctacttggatgcctcttaagtctgttctctggggaggcagtaaggggccgtggagctggcctcggcctcggcatcgggagaggctggacttcctgtctctctgtgctgacgactcggaccgatg

SEQ ID NO: 3099 - DNA, 203 bp, Homo sapiens
ggcgcgccagtcctcaccaacttcctgttgggtgctgtggtcccaaggcgcgtgctttgcagcagatgtgtgacctggcgttcccctgagtgctcggaaaatggccttgtctccggtcgttcccgttcaggagcagaattttcccactgtaaaaaaccgagcaagtctggataagtgaggctggctcccgactcggaccgatg

SEQ ID NO: 3100 - DNA, 203 bp, Homo sapiens
ggcgcgccagtcctgctcccagcgccacggacgcccccgggccgagcggcggtgcgctcccgtgcagacccgtggacagacgcccctggccggtggactctcgagtctcgcttctgcaccctgcgtccctagacatgaatgtgaggagggtggaaagcatttcggctcagctggaggaggccagctctcgactcggaccgatg

SEQ ID NO: 3101 - DNA, 203 bp, Homo sapiens
ggcgcgccagtcctgcatttcggctcagctggaggaggccagctctacaggcgaagcggttattgagcattcgctgtgtaccaagtgctgtccttgacaagaagacttacacccagtggtcccagagggagacttcggaagtgggagcacctgtcagatcatcatacagcgtggaagatgaactggagcgactcggaccgatg

SEQ ID NO: 3102 - DNA, 203 bp, Homo sapiens
ggcgcgccagtcctccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtcgactcggaccgatg

SEQ ID NO: 3103 - DNA, 203 bp, Homo sapiens
ggcgcgccagtcctgtctggagccggtgctctgcggcggggcgggagggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctcgactcggaccgatg

SEQ ID NO: 3104 - DNA, 203 bp, Homo sapiens
ggcgcgccagtcctacccttcaaggacctgctacaccctgaccaccccctgccgcccccacaggcagagctgacctgtccggtaatcaaggcaatgcagccggccgcctagctacagttcacgagccagttgtcacccagtgggcggtgcatcctccagcccccgctcaccccagtctcctggacaaacgactcggaccgatg

SEQ ID NO: 3105 - DNA, 203 bp, Homo sapiens
ggcgcgccagtcctgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgcagatcctggcccgactcggaccgatg

SEQ ID NO: 3106 - DNA, 203 bp, Homo sapiens
ggcgcgccagtcctccacctggccgtggacacctgtgtcagcatgtgggacctggttctctccatcgccttgtctgtggggtgcactggaatagccaggtctggctgggtcggcacaacctgtttgagcctgaagacacaggccagagggtccctgtcagccacagcttcccacacccgctctacaatcgactcggaccgatg

SEQ ID NO: 3107 - DNA, 203 bp, Homo sapiens
ggcgcgccagtcctgtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatccgactcggaccgatg

SEQ ID NO: 3108 - DNA, 203 bp, Homo sapiens
ggcgcgccagtcctcggaacttggatcacatcagatcctctcgagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagcgactcggaccgatg

SEQ ID NO: 3109 - DNA, 203 bp, Homo sapiens
ggcgcgccagtccttcctttcccggccgcacagggtagattttcgttccgtcacccaggctggagtgcagtggtgtgaccttggcttgctgcaaccctttgcctcctgggttcaagtgattctcattgcctcagcctcctaagtagctgggattacaggttttataggatcacattgacaaaagtacccgactcggaccgatg

SEQ ID NO: 3110 - DNA, 203 bp, Homo sapiens
ggcgcgccagtcctaactgggcggtaaaatagcccttctgttactgtccggggctgcggggtgagaggccagggccgagaagggcttcaggacgcgggaggcgcacttgcttcaagtcgcgggcgtgggaacggggttgcaaaacggggcctctttgtccgggcttgcttccggcgtcatggctcaaacgactcggaccgatg

SEQ ID NO: 3111 - DNA, 203 bp, Homo sapiens
ggcgcgccagtcctagactaagctgcaacactggcagagcctcccaaggaagggaggagggaggacagaggccaaggcggctcctggccaccctcgcagcttcctccctccctggccacaaggacccaaagctcagagggatggatgaacagacaggaaggctcaggctggacacgtattgtatgagtcgactcggaccgatg

SEQ ID NO: 3112 - DNA, 203 bp, Homo sapiens
ggcgcgccagtcctggccagaaaagccaaacttaagaaatctgcctatgtacagaacaagtcaactaaggggttctcattaatctaccgtctgtgaatatcgttatttttcaggagaagcgctacaaagcagccactgtgcttactgaacggcctccccctgtatcgcttaattgagaaggtatacaacgactcggaccgatg

SEQ ID NO: 3113 - DNA, 203 bp, Homo sapiens
ggcgcgccagtccttgggagcgatctggaaagctgcacttgtgctcccttcctcgtaggtttgctgtggaacgttgtggcttctgtggctcctcaggcccgggggcgccccttgaaccctccactcttggctccaagcaccttccctgggaagctgtatctgctgggttcgcagacaggaacagaaaccgactcggaccgatg

SEQ ID NO: 3114 - DNA, 203 bp, Homo sapiens
ggcgcgccagtcctcggggccagccatgcctgtcctaacagcagccacccagcagtggcccagcctgctgagaactagaaaatcagaagaaaaaggagaatccaccaggagacccaggtaactctgaagcgtgagctgccagaattcaaggccacctgcttaacagaagacaactagaaacctcatcccgactcggaccgatg

SEQ ID NO: 3115 - DNA, 203 bp, Homo sapiens
ggcgcgccagtcctaagcagtccttccacctcggcctcccaaagagctgggattacaggtgaaaattctggatctgttatctgtgaggaggccactccgttgacagttgtgtaaaactctgctgctttccccagctccaacctctctggtcttcaacaacactatcatcagggaaaacgtgggggaagcgactcggaccgatg

SEQ ID NO: 3116 - DNA, 203 bp, Homo sapiens
ggcgcgccagtcctaagcagctgaaagaagtctttaaggagcgaagcaccattcttcgtcagctgacaaagacatcaagagaacttgatggaattaaagtcaatcttcagtccttaaaaaacgatgagcagtctgccaaaactgatgttcagaaacttctggaattaggacagaaacaaagagaagaacgactcggaccgatg

SEQ ID NO: 3117 - DNA, 203 bp, Homo sapiens
ggcgcgccagtcctttgcgcatcccagtgattcttgggttccgcgtgtagtttcggaaggagacatcgaagcagggcgaggcgcagagggcgttgcggactcatgccccagtcggcagtgcggggtcccaagccctgcagtgctacagctttgagcacacctactttggcccctttgacctcagggcccgactcggaccgatg

SEQ ID NO: 3118 - DNA, 203 bp, Homo sapiens
ggcgcgccagtcctgagcagaaagggcccagacagtgccaggagtcaaggttctcaggggacagggagagcaagaggtcaagagctgtgggacaccacagagcagcactgaaggagaagacctgcctgtgggtccccatcgcccaagtcctgcccacactcccacctgctaccctgatcagagtcatccgactcggaccgatg

SEQ ID NO: 3119 - DNA, 203 bp, Homo sapiens
ggcgcgccagtcctggagttgaggaccttttcttcagagggtgactcaggtcaacacaggggcccccatgtagtcgacagacacagtggtcctaagatctaccaagcatccaggttctgaggagacaggccccggagcagcactagctcctgcccacactcctacctgctgccctgaccagagtcatccgactcggaccgatg

SEQ ID NO: 3120 - DNA, 203 bp, Homo sapiens
ggcgcgccagtcctaagtctgaggttgcaaaaggactgtgatcatatgaagatcatccaggagtacaactcgaaattctcagaaaacaggaccttgatgtgagaggagcaggttcaggtaaacaaagggtgccacatctcctgcctttctgctcactttcctgcctgttttgcctgaccacagccatccgactcggaccgatg

SEQ ID NO: 3121 - DNA, 203 bp, Homo sapiens
ggcgcgccagtcctttagaaagagaagagcgagccaggcagcactacgagaagcacctggaagagcggaagaagaggttggaggagcagaggcagaaggaggagcggaggagggctgctgtggaggagaagcggaggcagagacttgaggaggacaaagaacgccacgaagctgttgtacggcgcacacgactcggaccgatg

SEQ ID NO: 3122 - DNA, 203 bp, Homo sapiens
ggcgcgccagtccttagagatggggtcttgctgtgttgcccagactggtctcaaactcctggcctcaagtgatccttctgcctcagcttcccaaagtactgggattacagcttgaaatccatggcccaaaatgactctaccagtggagactctcttctgtgaagaagacgaccagataagaggttgggcgactcggaccgatg

SEQ ID NO: 3123 - DNA, 203 bp, Homo sapiens
ggcgcgccagtccttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttccgactcggaccgatg

SEQ ID NO: 3124 - DNA, 203 bp, Homo sapiens
ggcgcgccagtccttgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctcgactcggaccgatg

SEQ ID NO: 3125 - DNA, 203 bp, Homo sapiens
ggcgcgccagtcctcctggaggtccacgtcccgcaggtgcgtgcagcagcacccgccaggaggcgcctgagattggagctggagtgagccttccaggaattttggctgccaaatgtggtgcagaagtaatactgtcagacagctcagaactgcctcactgtctggaagtctgtcggcaaagctgccaacgactcggaccgatg

SEQ ID NO: 3126 - DNA, 203 bp, Homo sapiens
ggcgcgccagtcctggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagcgactcggaccgatg

SEQ ID NO: 3127 - DNA, 203 bp, Homo sapiens
ggcgcgccagtcctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggtgagcagggcagcatttccttctcccactgctgctgagcgactcggaccgatg

SEQ ID NO: 3128 - DNA, 203 bp, Homo sapiens
ggcgcgccagtcctcgtcctggcggtggggactccccgcggagcgcttgcgcgtgccaggccacccgggactacgtttcccagcgggccgagcggccggcgccgcggctgcggtcaggattgtcagtggcttcgccccgaggagagctgactgccctgggctgctgcctccggcagagctgagccaaacgactcggaccgatg

SEQ ID NO: 3129 - DNA, 203 bp, Homo sapiens
ggcgcgccagtccttggggatttgatgatctcctggagagcaactgagacaagagaagaaaggtgcatggctgcctcctaatcccatagtccagaggaggcatccctaggactgcgggcaagggagccgggcaagcccagggcagccttgaaccgtcccctggcctgccctccccggtgggggccaggcgactcggaccgatg

SEQ ID NO: 3130 - DNA, 203 bp, Homo sapiens
ggcgcgccagtcctgtgttgagagaaggtgcacgtaagcgtgtggcagaacgtctgcaatcgcatctttgtaataatctcctttctgagacggttcagtggactcaatgttccgccaaagggccaaggcagccctgcagttccgccgagcatcctggggcctccaagcctccgataagctcctccagtcgactcggaccgatg

SEQ ID NO: 3131 - DNA, 203 bp, Homo sapiens
ggcgcgccagtcctagcagttttgaggatgaccccttcttctcgtgagttacgggagccaggagtccggggtcgcgcgggaattaagacatacaggtggtcttactctgcagcagctgaaactgaagcacaagaagcccttggaactatcatcaggacattgagtccattcttgcacaccgagaaaatcgactcggaccgatg

SEQ ID NO: 3132 - DNA, 203 bp, Homo sapiens
ggcgcgccagtcctgacgtcctagccaatgacagaggccgtacggcggaagtatagaaaaggactctctggaacatggcaacattaatctgaccacaagctgactggcaggtgctttaaccacaagctctgactccaggccctgtcccctgagctctgccctcggatgtccgaccgcccagagcctgccgactcggaccgatg

SEQ ID NO: 3133 - DNA, 203 bp, Homo sapiens
ggcgcgccagtcctggcctgggtctgcgggagccccatctagcggggttccaaggcggcggcggcatcagtcgaggccctgctccgggagctcatcttgtcccctttcgcccctcacgccccccagctctgactccaggccctgtcccctgagctctgccctcggatgtccgaccgcccagagcctgccgactcggaccgatg

SEQ ID NO: 3134 - DNA, 203 bp, Homo sapiens
ggcgcgccagtcctgcctttcctcatctccgctggcggggatccccgttcgcctcaggaggcttccgaccccacagcatcccgccgctctgggcgcccgtcctctgtgaggtctctccggtgacaccagcccctcttcccgccctcactttgtgtgtttacgccgagcagctgccaagtcgtctctcccgactcggaccgatg

SEQ ID NO: 3135 - DNA, 203 bp, Homo sapiens
ggcgcgccagtcctaggagaataactcagttttagacagggtctcgcactgtcacccaggctggagtgcagtggtgcaaccccacctcccgggttcaagcaattctcatgcctcagcctcccaagtagctgggattacagggtcctcctgccgcaggagtatcttgcagtccaactcccacgattgtccgactcggaccgatg

SEQ ID NO: 3136 - DNA, 203 bp, Homo sapiens
ggcgcgccagtcctctacacatctcattatagtttagggagtctcgctctatcccctaggctggagtgcattggcgccatctcggctcatttgcaacctctgtctcccgggttcaagcgattctcctgcctcagcttcccgaggagctgggattacaggtcctgagggagtctaacaagttagcagaacgactcggaccgatg

SEQ ID NO: 3137 - DNA, 203 bp, Homo sapiens
ggcgcgccagtcctggagctttctattggtcctgggtaccgagcatgggcgctgcgtcagtgcgcgctggcgcaaggttggtggaagtcgcgttgtgcaggttcgtgcccggctggcgcggcgtggtttcactgttacatgccttgaagtgatgaggaggtttctgttactatatgctacacagcaggcgactcggaccgatg

SEQ ID NO: 3138 - DNA, 203 bp, Homo sapiens
ggcgcgccagtcctggagctggtggcggcgctccgcaggggctcggctgttttccgcgcggcaggcgcggccatggcgcagctgggaaagctgctcaaggagcagaagtacgaccggcagctgaggcgattcctccatacatttgacagctgtctgggcccttatggagcatacagtggagtggaaagcgactcggaccgatg

SEQ ID NO: 3139 - DNA, 203 bp, Homo sapiens
ggcgcgccagtcctgagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatccgactcggaccgatg

SEQ ID NO: 3140 - DNA, 203 bp, Homo sapiens
ggcgcgccagtccttggcctgggaagtgggaagccagattggaccctactgactggggaccctcagccttggggctcctctggagaagtgatcagttgccctgctggaaactcacatccagggggcagtggctggagagcaagagcgaacggtcaggaagaggaggcctcctgctccacgacgtgacccgactcggaccgatg

SEQ ID NO: 3141 - DNA, 203 bp, Homo sapiens
ggcgcgccagtcctccgacgctgagcgccggcctcgccctcggcggcccctccctcctccttaccccgcctcccccggcccgcccctccctccccggaggagcagtctctccgcgcgtctcccggagctttctccattgtctctgcctttacaacagagggagacgatggactgagctgatccgcacccgactcggaccgatg

SEQ ID NO: 3142 - DNA, 203 bp, Homo sapiens
ggcgcgccagtccttgctgcctgcggctctcagaagcctctgctccaccgcggcgagaggcatgggcacgtggctgccgagggtggccgagctctgggaagaaaagcccgtgtgcctctgcatagcgtcgctacagcgctgactcggtgtggattgattggaaaggtttgagggagtacttgggaagccgactcggaccgatg

SEQ ID NO: 3143 - DNA, 203 bp, Homo sapiens
ggcgcgccagtcctatctagagaaacatctgtagcatcaatgagtcagacaagcggtggtgaggcaggctcgcctcctccagctgttgttgctgctggatttgcctctgaagcagggagtgtctgcattaaaaatgacctgtagttctctgcttcatagatgcttcttcagctccctcctcttcctcccgactcggaccgatg

SEQ ID NO: 3144 - DNA, 203 bp, Homo sapiens
ggcgcgccagtcctccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaacctcgccaatacgactcggaccgatg

SEQ ID NO: 3145 - DNA, 203 bp, Homo sapiens
ggcgcgccagtccttggttttggctatatcttcatgtaggacctactccctatcccgtcggccgcggtgaatcccacctgcggctgggcttcatcaccaggcctcctcacagattcctgtcccttctgtgtcctggactccggatacctcaactctcagtactttgtgctcagcccaggcccagagcccgactcggaccgatg

SEQ ID NO: 3146 - DNA, 203 bp, Homo sapiens
ggcgcgccagtcctggcaggcggcgggggcggggcctggaggagcctacaccgactctggaggaagactggagcctttgcggcggcgctgcccctcccctggtccccgcgagctcggagggcccggctggtgctgcgggggccccgggaggttgaaaactaagcatggggaagagctgcaaggtggtccgactcggaccgatg

SEQ ID NO: 3147 - DNA, 203 bp, Homo sapiens
ggcgcgccagtcctaggacaaaagccagacacatttcaacatgagggacccactgacagattgtccgggcaaacctggaaattagctatgccaaaggacttcagaaactggcaagcaagctgagcaaagcattacagaacacgagaaaaagttgtgttagcagtgcctgggcctgggcctcagagggacgactcggaccgatg

SEQ ID NO: 3148 - DNA, 203 bp, Homo sapiens
ggcgcgccagtcctagagggaaagggagagagagagactcttagagaaagagagagacacacacactcttggagagagagcgcgaggtgtagagaggagagagagtgaacagggagcggggcttttgtctgttggtctccctggactgaagagagggagaatagaagcccaagactaagattctcaaacgactcggaccgatg

SEQ ID NO: 3149 - DNA, 203 bp, Homo sapiens
ggcgcgccagtcctgatccactcacttcccatcaggcctcacttccaacattgggaatcacatttcagcatgagatttggaggggagaaacatccacaccataccacaaataaaaagtcccagagttgtctactttcagactttttaaaaaagtagattggggtcaactggactacttagttgtagaccgactcggaccgatg

SEQ ID NO: 3150 - DNA, 203 bp, Homo sapiens
ggcgcgccagtcctggagcctgagggacccggcggctggtgagcgcccgctggaggctggagcttccgggccctggaaaggggtccccgcgcgccccgggtcggaggcagacccctgggtttgggggacatgggcatttggggcgcctgaacccaagacctctggatgagctgccccgttcagaccatcgactcggaccgatg

SEQ ID NO: 3151 - DNA, 203 bp, Homo sapiens
ggcgcgccagtccttaaggcggcgtttctgggcgcagccgtgtcgctcctggtttccatcgtgtgggaagaacggagtaacgagtctcacgcagaaaaaggtcttgagagcaccttgtggcgcacccagtgtaactgtgacgatcaaccatttttgtgttgtcctcccccacctgccagaagccaacccgactcggaccgatg

SEQ ID NO: 3152 - DNA, 203 bp, Homo sapiens
ggcgcgccagtcctgcctcccaagttttcatccaactgccaaccccaaagcttccacccttctcccctcagagaggacgtttgatgccgggccccttgagaggctcattgacaagcctgcccctctgggtccccctgagcagagcctgctgacccaattgcccacctttgcggctttgatgcctagcccgactcggaccgatg

SEQ ID NO: 3153 - DNA, 203 bp, Homo sapiens
ggcgcgccagtcctaggtaactgtgatgcgggggtcagcgggagaggcacccggaagctcccggcgtctgcaccccggcagcgcgaggaaatgcccaaagaaactatagtgacactgaaactgaaggagagatttttaattccttagtgcaatactttggtgacaacttggggcgaaaagttaaagcgcgactcggaccgatg

SEQ ID NO: 3154 - DNA, 203 bp, Homo sapiens
ggcgcgccagtcctatgggccgcggagcccgagcggcggctgcgcagtcccgctgggggagggcgtcgcgggcatcggtctcacctggacggacgatccgctcagcgcccgcagtcggtggttagcccacggcgatgcctctcccggcctcagcccctgctgaggctacacccatgccttcttcagaacgactcggaccgatg

SEQ ID NO: 3155 - DNA, 203 bp, Homo sapiens
ggcgcgccagtcctcgctctctgccaagccggcttgcttcctgatctgttgctagggccgctggaccccgttgctaaggacccttgagatcgtgagcgcttggagtgtacccctcctttcctggggtagagggtcagtcgagagtagccttcgttaaccttaattgaaactggagtgaaagggaagcacgactcggaccgatg

SEQ ID NO: 3156 - DNA, 203 bp, Homo sapiens
ggcgcgccagtcctgcttaggagcacccaccaagctctggcagggtctccagcacccatctcgggcagaggctgggggagtgactgctggtgcaagccccaaagtgcatgcggcaaaaacatggatgcagagctggtggcaagaagaggggctaagttatagagtcaacgtggaggtaccaggccacccgactcggaccgatg

SEQ ID NO: 3157 - DNA, 203 bp, Homo sapiens
ggcgcgccagtcctctcagcctctacagtctggtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagcccgactcggaccgatg

SEQ ID NO: 3158 - DNA, 203 bp, Homo sapiens
ggcgcgccagtcctgctgaatagaacgggcgtggaggcaggaggaggagcaggacgccgggcactgctgatgctgctttcgctggggtgagtgacctgcaggaagaaggcaagaatgccatcaactcaccgatgtcccccgccctggtggatgttcaccctgaagacacccagcttgaggagaacgagcgactcggaccgatg

SEQ ID NO: 3159 - DNA, 203 bp, Homo sapiens
ggcgcgccagtcctaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagccgactcggaccgatg

SEQ ID NO: 3160 - DNA, 203 bp, Homo sapiens
ggcgcgccagtcctagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtcgactcggaccgatg

SEQ ID NO: 3161 - DNA, 203 bp, Homo sapiens
ggcgcgccagtcctacactggccctcggccgggagctccgagtctcaggcggtcccggttgtcttcctgtcggtgccgcttccgcctgcccttcttgaaaacccacccccagctttgacctggaaaatgggctctcgtgtgggaggagggccctggaccctcagtccagccctggcctgggccggattcgactcggaccgatg

SEQ ID NO: 3162 - DNA, 203 bp, Homo sapiens
ggcgcgccagtcctcccgttgcactgccgggctgggcaatatgaaggagcagccctcatgtgccggcaccgggcatccgagcatggcgggaggaggcctaccagaaactggccagcgagaccctggaggagctggactggtgtctggaccagctagagaccctacagaccaggcactccgtcagtgagcgactcggaccgatg

SEQ ID NO: 3163 - DNA, 203 bp, Homo sapiens
ggcgcgccagtcctagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatcgactcggaccgatg

SEQ ID NO: 3164 - DNA, 203 bp, Homo sapiens
ggcgcgccagtcctcggctcctccagctaccggcccaaggccatctacctggacatcgatggacgcattcagaagcactccgtacaaagtgagacctgtggccatcaagcaactctccgagcattcaaaatcaatgaactgaaagctgaagttgcaaatcacttggctgtcctagagaaacgcgtggacgactcggaccgatg

SEQ ID NO: 3165 - DNA, 203 bp, Homo sapiens
ggcgcgccagtcctgcccagagagccccagggctgctaccaggaaggccagcgcatccctccagagcattcaaaatcaatgaactgaaagctgaagttgcaaatcacttggctgtcctagagaaacgcgtggaattggaaggactaaaagtggtggagattgagaaatgcaagagtgacattaagaagcgactcggaccgatg

SEQ ID NO: 3166 - DNA, 203 bp, Homo sapiens
ggcgcgccagtccttggagaggacatggcactgcttcagagacacgaaccaccttgagtggatgtgattggcgatccccgtagagcaggaaagctcgtctgctgtgcagccggcgcagaggattctgtggcaggaaattagacactaggaaattcagtagcgatttgaaggaaacctcgaccttgaagcgactcggaccgatg

SEQ ID NO: 3167 - DNA, 203 bp, Homo sapiens
ggcgcgccagtcctttccggcctggcagcctctccccagctgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatccgactcggaccgatg

SEQ ID NO: 3168 - DNA, 203 bp, Homo sapiens
ggcgcgccagtcctgtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgcccgactcggaccgatg

SEQ ID NO: 3169 - DNA, 203 bp, Homo sapiens
ggcgcgccagtcctcaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaaccgactcggaccgatg

SEQ ID NO: 3170 - DNA, 203 bp, Homo sapiens
ggcgcgccagtcctggctcaggtgtgggaccccatccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcacccgactcggaccgatg

SEQ ID NO: 3171 - DNA, 203 bp, Homo sapiens
ggcgcgccagtcctacagagcgctgctcccgagaaccctgcacccctcaatggagtaaattaccataaagcctcttccttacccatgctttggggtgttaacagctgaggctattcgtcggtgacctgtgggactcgagctattcctgcagctcagcagacctcctggccgtggcagacttctgcgttcgactcggaccgatg

SEQ ID NO: 3172 - DNA, 203 bp, Homo sapiens
ggcgcgccagtcctttagccaacctgaaccgtgtgatttatttcatctgtgacaccatcctctgggtgaggagcgtaggtctcacctctggcatcaacaaagagaaatggcgaacgagggctgctcaccactactactattctcttctgctgagcctggtcagggatctgtatgaaatctccctgcagcgactcggaccgatg

SEQ ID NO: 3173 - DNA, 203 bp, Homo sapiens
ggcgcgccagtccttcatccctcaagaaaaaggccgatggatctgacctcatcagcacggatgctgagcagagaggccagcctctcagagtcccggagacttcatccttagatctagacattcaaacacaactggaaaaatgggacgatgttaagtttcatggagatcgaaataccaagggacatccacgactcggaccgatg

SEQ ID NO: 3174 - DNA, 203 bp, Homo sapiens
ggcgcgccagtcctgtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataacgactcggaccgatg

SEQ ID NO: 3175 - DNA, 203 bp, Homo sapiens
ggcgcgccagtccttgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaacccgactcggaccgatg

SEQ ID NO: 3176 - DNA, 203 bp, Homo sapiens
ggcgcgccagtcctgaggtggaggaggacttggaaactgacgggcactgtgccgagagagattccctgctctccaccagctctttggcgtcccatgactccaccttgtcccttgcatcctcccaggcctcggggccggccctctcgcgccatctgctgacttcctttgtctcaggcctctctgatggccgactcggaccgatg

SEQ ID NO: 3177 - DNA, 203 bp, Homo sapiens
ggcgcgccagtcctcctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagcgactcggaccgatg

SEQ ID NO: 3178 - DNA, 203 bp, Homo sapiens
ggcgcgccagtcctactttaaccagtctgcagaactgatccccagcccagctgggcctcatgcctctgacaacccaacagtgtggagcagacccacagagagggagacccagagaggtgtgcagtggcatggaagggccagcggggtatctgcggcgggccagtgtggcccaactgacccaggagctgcgactcggaccgatg

SEQ ID NO: 3179 - DNA, 203 bp, Homo sapiens
ggcgcgccagtcctagatgtgtcgggcctggtgagagggtgaggcgagacggcccgatcgcccagggccccggaagctgcggaggtcacccccgcctggccttagctcagggacaccctggattcacgtgggagcccctgctcctgcctcccccgtcccaccactgaggctgttgggccaggccagtccgactcggaccgatg

SEQ ID NO: 3180 - DNA, 203 bp, Homo sapiens
ggcgcgccagtcctcagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagcgactcggaccgatg

SEQ ID NO: 3181 - DNA, 203 bp, Homo sapiens
ggcgcgccagtcctagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagccccgactcggaccgatg

SEQ ID NO: 3182 - DNA, 203 bp, Homo sapiens
ggcgcgccagtcctccgaggccgcctggcccttgtttactaaccctccctcaaacgtttcctgggtggctccccagggacggcagggctgggggcttctctccagggagctgctgctgaggcctgtgtctcccgtggctcctctgacaggtcccgcctgactccgctctggaaagtccttttgaagaacgactcggaccgatg

SEQ ID NO: 3183 - DNA, 203 bp, Homo sapiens
ggcgcgccagtcctagacacaaaatcagccagggggagcccacattggagggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagcgactcggaccgatg

SEQ ID NO: 3184 - DNA, 203 bp, Homo sapiens
ggcgcgccagtcctggtaccaacccctgccgcaggactttcctgggccggctcgcggagagcgtagcgcggccttggtggcggaatggcgttgagtgacggcccggccccgccatctggttaaagggactcgttcaacacggaagtgtcccggggctgcattgtgctacagctagaatgaagcacatccgactcggaccgatg

SEQ ID NO: 3185 - DNA, 203 bp, Homo sapiens
ggcgcgccagtcctcacatcagtctacaaagaggttttcatacaaacataataagatgtaaatggaccaaaagtgaagcacattcttgcagtaagcactgttactctccaagcaaccatggtttacatattgggattttgaaacttagcacttctgctcccaagggacttacaaaagtgaacatttgtcgactcggaccgatg

SEQ ID NO: 3186 - DNA, 203 bp, Homo sapiens
ggcgcgccagtcctctgcgcggaagagtgctggccctggggaagccccttcctcacccaggcttcacacatttgaccctggctctctctcaggaggacccctcgctggaaaggcattttaagggccaccgagatgcagttacctgtgtggacttcagtatcaacacaaagcagctggccagtggctcccgactcggaccgatg

SEQ ID NO: 3187 - DNA, 203 bp, Homo sapiens
ggcgcgccagtcctatcccagccgccagaattcgaggtctgcggcggctttcaaaacttgacaactttcctttccaggaggaccccgttctggagcgttatttcaaaggccacaaagctgcgatcacctccttggacctcagccccaacggcaagcaacttgctactgcttcttgggatacctttctccgactcggaccgatg

SEQ ID NO: 3188 - DNA, 203 bp, Homo sapiens
ggcgcgccagtcctggacgcgacgggacgcgctgggaccggcgtcgggggtcgcggggaccatgcagcggagcctccctgcccttcgctatcctgacgctggtgaacgccccgtacaagcgaggattttactgcggggatgactccatccggtacccctaccgtccagataccatcacccacgggctccgactcggaccgatg

SEQ ID NO: 3189 - DNA, 203 bp, Homo sapiens
ggcgcgccagtcctgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagcccgactcggaccgatg

SEQ ID NO: 3190 - DNA, 203 bp, Homo sapiens
ggcgcgccagtcctgcacgttccgggagggcgccggggcacgcgtgtgtctgagctgcctttctcctcccgttgctagggaaatggtccaggagtgctgggtgtgagcctcccttctcctcaagccggagactgcggttgtcattgatcaattgaagaagcaaggacccgaaatcacagacattagcacgactcggaccgatg

SEQ ID NO: 3191 - DNA, 203 bp, Homo sapiens
ggcgcgccagtccttttcaaatgtagaagaacaattcaaaatgctatcactgtgtatgtaagaaggatggggcagatttcattttaccctctagtctccctcaatgcatgcacggatttatctgtacgctaagctctctgctctgcatctgtagctccttgtggattatattgtctcagtgatcagaacgactcggaccgatg

SEQ ID NO: 3192 - DNA, 203 bp, Homo sapiens
ggcgcgccagtcctaaaatagagtggctagtgtgagcctcgaaggcctgaatttggcaagggtccacccagccaagtgatctgaggaaacatcggagaaagattgcagttgtggaagaagatggtcgagaggacaaagcaacaattaaatgtgaaacttctcctcctcctacccctagagccctcagacgactcggaccgatg

SEQ ID NO: 3193 - DNA, 203 bp, Homo sapiens
ggcgcgccagtcctgtaaccactccaggacgctgccagggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagcgactcggaccgatg

SEQ ID NO: 3194 - DNA, 203 bp, Homo sapiens
ggcgcgccagtcctgtgccagctcaatggggccgccgacctcgaagtttccgaagaagtaaaatagaaagaagaccttttttgaaatgacctgtgttagtcacctctctcaggatgcgtgaggcggacacgttgaggccacctcagctgatggaagtttccgctgacatcatctctaccgttgagttccgactcggaccgatg

SEQ ID NO: 3195 - DNA, 203 bp, Homo sapiens
ggcgcgccagtccttcaggcacatcgaggagaaccagctgcccaagctcttggctgctgcccttctgaggcctgcctgatttgggccacatagatctggttttggccattgactggcaacatggcagtagccaactgcagagccaccagggagcagcctcattctgattgagtataacgaagacgctgcgactcggaccgatg

SEQ ID NO: 3196 - DNA, 203 bp, Homo sapiens
ggcgcgccagtcctctcgctcaccccgcctgctcctgcggagtgactgccgcagcggggccggaagacaggtgcgccccagcctcgccagctctggccctggcctccggggaactcggcgcctccctcgtcaccgtcggtggcggttaaaactggcctctacgcttctgcttcaatctccaatttggccgactcggaccgatg

SEQ ID NO: 3197 - DNA, 203 bp, Homo sapiens
ggcgcgccagtcctgtcggcggccgctgcgcgcgctcgttgcccaacccggtccccgcccccagacacgccgggctctcggggcaccacagccatgtgctcgttagcgtcaggcgctaccggttattcacatctgctgaagaaacattttcacactgtaagtctgagcatcagtttaatattgacagccgactcggaccgatg

SEQ ID NO: 3198 - DNA, 203 bp, Homo sapiens
ggcgcgccagtccttatcaaggaatcccggcgtggacagcgcgaggagaaagatggcggcgatggcggtcgggggtgctggtgggagccgcgtgtccagcgggagggacctgaattgcgtccccgaaatagctgacacactaggggctgtggccaagcaggggtgagggccggacctccacgagcggacgactcggaccgatg

SEQ ID NO: 3199 - DNA, 203 bp, Homo sapiens
ggcgcgccagtcctgagtcctctcggcacccagcaagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggccgactcggaccgatg

SEQ ID NO: 3200 - DNA, 203 bp, Homo sapiens
ggcgcgccagtcctgctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcagaccctctggagactttggggaccagtttgaccgactcggaccgatg

SEQ ID NO: 3201 - DNA, 203 bp, Homo sapiens
ggcgcgccagtccttggcctgccggaagttcccagggagaaggcagcgcgttgtacccgagttacctgtagtcaaccacagtctgaaaatattaaggtattttaagacagaaagagagagaggagagaaaccgcattcacaaaaaagaaatcctctttttagaacatctcttggtggtaccatcagaacgactcggaccgatg

SEQ ID NO: 3202 - DNA, 203 bp, Homo sapiens
ggcgcgccagtcctgttttcctcctgtgaccctttcggggccgggctctcaccctaaagaagcagccccgccctggggtggccccaccctctcttgggacctgtcataagtcggaccccgggcgcccggctgcgcagtcccagccgccttccccaggcagtggaaccttcgggctcctgagcttcaggcgactcggaccgatg

SEQ ID NO: 3203 - DNA, 203 bp, Homo sapiens
ggcgcgccagtcctgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagcgactcggaccgatg

SEQ ID NO: 3204 - DNA, 203 bp, Homo sapiens
ggcgcgccagtcctcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggcgactcggaccgatg

SEQ ID NO: 3205 - DNA, 203 bp, Homo sapiens
ggcgcgccagtcctgcactccagcctgggcgacagagtgagaccctatctctaaacaaaagaaagaacgtcttcaagcatggagccatgaagctggatttggctttctgtcgctctctctacagggtacagacagtgacaataccctcccctcccttgggctggacccctctctacagctaggagccacgactcggaccgatg

SEQ ID NO: 3206 - DNA, 203 bp, Homo sapiens
ggcgcgccagtcctctgctgacaccttgatcttggacttcccatcttccaggaaggcctgacctcagttgttccagggtaaagaatttgggcagtgcccacacccacgctgttggataacatttcttcaccataccagtgagggtgaatgtgtacacgcccagcttcctgcctgttactctccacagtcgactcggaccgatg

SEQ ID NO: 3207 - DNA, 203 bp, Homo sapiens
ggcgcgccagtcctggaggaggaggtggaggaggtggaggaggtggaggaggcgcgggaccgggggggatagattcccagaagtgggataactggatcagagggtgattaccctgtgtataagagtatgtgtctcactgcaccttcaatggcattgagtagatcgtcagtatttaaacagatcacatccgactcggaccgatg

SEQ ID NO: 3208 - DNA, 203 bp, Homo sapiens
ggcgcgccagtcctaggacgcccccggcccaggcccttggggtggacaagtccttcacttctcgccggagtgtgtggaggagcgatgggcagaaccagcacttccctcaggcactagacctgtcacgagtgaacttagttccctcctatactccttcactctaccctaagaacacagatctatttgagcgactcggaccgatg

SEQ ID NO: 3209 - DNA, 203 bp, Homo sapiens
ggcgcgccagtcctctttcccctccccctcctgtaacttcctcttcttccccggttgggccctctgctcctctgcactctcctccccagttcgcagatttccgcccaccttccgcctcgtctagccgcgccacagctagcggggtgatctttccccccctctggtaggagttggtgaaggtgagactccgactcggaccgatg

SEQ ID NO: 3210 - DNA, 203 bp, Homo sapiens
ggcgcgccagtcctcggacttagacgcggggacttcagggcagggggcgccccctgcccgggtcaccagtcggggcgaggggacgtctcctctcccccagctgctctgctcggatggcgccgccggctgagtgacgggggcggcgcgcaggacttcccagctcggacctcttgccttcgaggggaaagcgactcggaccgatg

SEQ ID NO: 3211 - DNA, 203 bp, Homo sapiens
ggcgcgccagtcctcgcgcgctcgtctgcctggactgttgcgggccccgggacctgggctgggaacccgcggtggagcgggacacgaacgtggacgagcctgtggagtgggagacacctgacctttctcaagctgagattgagcagaagatcaaggagtacaatgcccagatcaacagcaacctcttccgactcggaccgatg

SEQ ID NO: 3212 - DNA, 203 bp, Homo sapiens
ggcgcgccagtccttgtgtggtgctgtccttcctcaagactacctcattctcactggctcggagactcctgcctgctgagctgactacacagacttagtcttctccactccgtgttcctgcagctagagacatgacctaacaccctgatgaccactctcagggaccttgagtgactggccggtgcacccgactcggaccgatg

SEQ ID NO: 3213 - DNA, 203 bp, Homo sapiens
ggcgcgccagtccttgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtccccgactcggaccgatg

SEQ ID NO: 3214 - DNA, 203 bp, Homo sapiens
ggcgcgccagtcctcacctgcagtgtagtggtttatactaaggaatacacacaaattacaggcctttgagcccagaatgcaacttgggaggtatttgacctgtccaaagacgacttgatacctctataatgtaacagaaaaggtcagaaaatattaagcaagtagaagtgtggagcatattaagcaagcgactcggaccgatg

SEQ ID NO: 3215 - DNA, 203 bp, Homo sapiens
ggcgcgccagtcctacaattgcattcccgggctggatgccggttgttaagcgcgctgttgctttgtaaaaatgcgtgtgttctggtgttttggctggggcagggaggggacaccccacgaggtctggggctgttgcccttgtgtcatccccccgccttttaactgcaaaggtcaccatggctgaccggcgactcggaccgatg

SEQ ID NO: 3216 - DNA, 203 bp, Homo sapiens
ggcgcgccagtcctcgcctgctcctacgtgggcagcctctacgtctggaagagcgaactgcccagggaccatcccgcggtcatcaagcgacgcttcaccagcgtcctggtggtgtccagtctctcacccctgtgcgtgctgctctggagggaactcacaggcatccaggcacatccctgctcaccctgcgactcggaccgatg

SEQ ID NO: 3217 - DNA, 203 bp, Homo sapiens
ggcgcgccagtcctgcggacaatgaattttactttcgctacccaaatggagtttcgctcttgttgcccaggctggagtgcaatggcacaatctcggctcaccacaacctctgcctcccgggttcaagcgattctcctgcctcagtctcctgagtagctgggattacaggcttccaggacgtgcatgcccgactcggaccgatg

SEQ ID NO: 3218 - DNA, 203 bp, Homo sapiens
ggcgcgccagtcctcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacacgactcggaccgatg

SEQ ID NO: 3219 - DNA, 203 bp, Homo sapiens
ggcgcgccagtcctacccaggatgcggaggcccttgtggggctgtggccactagggagtttcttggtcacaggacgtgaccccagccaggccctggtgttgaggtcaggacctttaccaggagaagtcaatacctaccagatccagaagattcccagaggtgtgtccctggaatcctccaacctctgccgactcggaccgatg

SEQ ID NO: 3220 - DNA, 203 bp, Homo sapiens
ggcgcgccagtcctgtatttacgatggagatgaatttagaaaagcagagtctgtccaaggtggagaaaccaggatctatttggatttgccacagaatttcaagatatttgtgagcgctatctgctctatgcaagcacttagacaacctatgggaagaacaccgtggcagcgtggtcctgtttgcctggcgactcggaccgatg

SEQ ID NO: 3221 - DNA, 203 bp, Homo sapiens
ggcgcgccagtcctcgggaactggcgaggtagttccttcgcggtggagagacctggaatggccaaatatcaagaaatgtacatcaaaacattcacccagaaaaccaggagctagtaagggtacttcgagaacagcttcaaacagaacaggatgcacctgctgccactcgacagcagttctacactgaccgactcggaccgatg

SEQ ID NO: 3222 - DNA, 203 bp, Homo sapiens
ggcgcgccagtcctagagttatatgcagaagttgaaaatgcctggaagatttctggtttctttcactacttatcctgcctttttgcatcgctgccagatttggatgatatgatattcagaggggcaccttaatcaaagccattcttcaacaagacccacctggcataagattgcacacataattcaagcgactcggaccgatg

SEQ ID NO: 3223 - DNA, 203 bp, Homo sapiens
ggcgcgccagtcctcacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatcccgactcggaccgatg

SEQ ID NO: 3224 - DNA, 203 bp, Homo sapiens
ggcgcgccagtcctgtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccacgactcggaccgatg

SEQ ID NO: 3225 - DNA, 203 bp, Homo sapiens
ggcgcgccagtccttcggcagaactccgccaccaggcgcgatgccggaactacatgtcccatgacgctctgggaggccgcagctttccaccggaaagagggtggctgaggtgggggaggagcccaaaaggcattgtgggagtacagctctttcctttccgtctggcggcagccatcaggtaagccaagcgactcggaccgatg

SEQ ID NO: 3226 - DNA, 203 bp, Homo sapiens
ggcgcgccagtcctgtctgcaggtatggatgttgttctcttttccctgtctttatttccttaccaatcggctgccatccgaggagctgaggaagcctagagctctcagaagcagtcctttgagctggtgtaggggcactcagaatggtccagcgtttgacataccgacgtaggctttcctacaatacacgactcggaccgatg

SEQ ID NO: 3227 - DNA, 203 bp, Homo sapiens
ggcgcgccagtcctgactacttacctgcgaatcccggttgcccgcccgccagcacgtccgttccctaagcagaccgcctggcctcctgcctgacccgtcttctcaccgttgcccggagtctgacctccccacgctcagtccactaacgaagctatccctgctcctgccccacagcttctaagtgccagcgactcggaccgatg

SEQ ID NO: 3228 - DNA, 203 bp, Homo sapiens
ggcgcgccagtcctctcaggtgagaacttctcaggtggaaagcaggaagagggtggctagtgcaaggatcagatagcacctgcttggaagttcactgattaatgatttaacaagggcggtcacatgggacaactgctgcttttctctgccctcatttttcttactaacaggtctgaaaattgaacaagcgactcggaccgatg

SEQ ID NO: 3229 - DNA, 203 bp, Homo sapiens
ggcgcgccagtcctgaagtggagcctgggagccttgacgttaggaacgaagtctaacctggatctggagccgggagataatctgaatgctggctggggcagaaaattactaagatcctgtggaagtgtgaggattattaaactgatcactgtctgataaggtgagatcaaattgggaatgctttcatacgactcggaccgatg

SEQ ID NO: 3230 - DNA, 203 bp, Homo sapiens
ggcgcgccagtcctcagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctccgactcggaccgatg

SEQ ID NO: 3231 - DNA, 203 bp, Homo sapiens
ggcgcgccagtcctctcccgcagcttgtccacactctgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgcgactcggaccgatg

SEQ ID NO: 3232 - DNA, 203 bp, Homo sapiens
ggcgcgccagtcctgacttggaggcagagacccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgcgactcggaccgatg

SEQ ID NO: 3233 - DNA, 203 bp, Homo sapiens
ggcgcgccagtccttggaccaccgggcccggagggtccgagccgagagcggagcctgcaccctccacctcccgcccttcgggaaatatcagaactgagccaggagctgctgccgcccacccctcgtcttctggctgcctccctctttgtgccccacaggctccccctctccacctcctggggcccatccgactcggaccgatg

SEQ ID NO: 3234 - DNA, 203 bp, Homo sapiens
ggcgcgccagtcctatgttgagtgacagctgtccaatggaggccctccgtgctagtacggcttgcggcttaagcgccgccgcggtctgcggaatgtcaactattcaacatggaggcggaggtcgataagctggaactgatggtgagtgcaaagtgaaggagatctactgggtagtttatttttccccccgactcggaccgatg

SEQ ID NO: 3235 - DNA, 203 bp, Homo sapiens
ggcgcgccagtcctagtcaagttgacctacatagaagagaaggaactggaagtgcatgtctgtgttctggctccgattgggaaaagctgcttaaccactgttacacttccaggggctccccactcagtccccagtcatctatcgacagtgagctgagtacttcagaattggaggatgattctatctcccgactcggaccgatg

SEQ ID NO: 3236 - DNA, 203 bp, Homo sapiens
ggcgcgccagtcctcacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcctcgactcggaccgatg

SEQ ID NO: 3237 - DNA, 203 bp, Homo sapiens
ggcgcgccagtcctgcagtcccgggccggcccgtaccgccaggcgatcgcgctgatggcggcgctggcagcagcggccaagaaggtgtggagcgcgcggcggctgctggtgctgctgttcacgccgctcgcgctgctgccggtggtcttcgccctcccgcccaagtgggctgatcatggccagcgccacgactcggaccgatg

SEQ ID NO: 3238 - DNA, 203 bp, Homo sapiens
ggcgcgccagtcctcctccttcttcattagcggtctcccatgtggggccacatcttccctcaccaggaacccagtgggcgcgctccagcccccctcagcttgccttttgcgtggtcattagagctagggcacacgtcatgctgattcacatatttttgccctttgtcatgtattgagaaaaagtaaggcgactcggaccgatg

SEQ ID NO: 3239 - DNA, 203 bp, Homo sapiens
ggcgcgccagtcctaacaaatctcctaaccttcagaggctcggatttcttgtctatgagatgaagtgagtttccttcgtctgggcagactccctcccctcttccataaaggctgcaggagacctgtagctgtcacaggaccttccctaagagcccgcaggggaagactgccccagtccggccatcacccgactcggaccgatg

SEQ ID NO: 3240 - DNA, 203 bp, Homo sapiens
ggcgcgccagtcctacacggagccgtgtgtggatggctgggtctatgaccgcagcatcttcacctccacaatcgtggccaagtggaacctcgtgtgtgactctcatgctctgaagcccatggcccagtccatctacctggctgggattctggtgggagctgctgcgtgcggccctgcctcagacagtgcgactcggaccgatg

SEQ ID NO: 3241 - DNA, 203 bp, Homo sapiens
ggcgcgccagtcctaggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgccgactcggaccgatg

SEQ ID NO: 3242 - DNA, 203 bp, Homo sapiens
ggcgcgccagtcctgatgcagcacggggtcgcggggcgggcgcccagtgcaccggaggaggtgagcgccaggtcgccttcgcggcccggggacacaggcagggacgcgggagctgatgcggctggaccggccggggaaacagtattttctggaagggggcccctctgaagcggtccaggatcctgcaccgactcggaccgatg

SEQ ID NO: 3243 - DNA, 203 bp, Homo sapiens
ggcgcgccagtcctttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggaccgactcggaccgatg

SEQ ID NO: 3244 - DNA, 203 bp, Homo sapiens
ggcgcgccagtcctgctgaccacaggagccggtgctggggactgagggaaacttagagttcagagagggggtgtgatttgcctgaggtcacacagcaagttagagacccagctccacgactcattgtcttggctttggccctcgtcatcctgcccacccagcggggcttcccaacccaccacacagcccgactcggaccgatg

SEQ ID NO: 3245 - DNA, 203 bp, Homo sapiens
ggcgcgccagtcctcctcagtttcctctttcagtctgtggtgtgtggtccatcctcttgctgagcacattgaaaggaactggctatctttgatctcttcctccagggaatctcttagttataacatttgttagctactttggagccaaacttcacaggccaaaaataattggagcagggtgtgtaatccgactcggaccgatg

SEQ ID NO: 3246 - DNA, 203 bp, Homo sapiens
ggcgcgccagtccttgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgcccgactcggaccgatg

SEQ ID NO: 3247 - DNA, 203 bp, Homo sapiens
ggcgcgccagtcctagagatagcaggtggtgctaattcactgtgttggtgggaactctggctacactgaaaggctggagtgcagtggcacgatcttggttcaccacaatctcgtctcgaaggctcaggtgattctctcacctcagccgcctgagtagctgggaccacagtttcagctgtgagttcaaccgactcggaccgatg

SEQ ID NO: 3248 - DNA, 203 bp, Homo sapiens
ggcgcgccagtccttacaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaacgactcggaccgatg

SEQ ID NO: 3249 - DNA, 203 bp, Homo sapiens
ggcgcgccagtcctaatcagagaatggagggatataatgagtggaactgagggccgcgatgggcctcttggaacattggtgtgttcatctgcattcgatgtgctggaatccacaggaatctgggggtgcacatatccagggtaaagtcagttaacctcgaccagtggactcaagaacagattcagtgccgactcggaccgatg

SEQ ID NO: 3250 - DNA, 203 bp, Homo sapiens
ggcgcgccagtcctcccgcagggtggccttagcggccggtcgtaccacggcagccccgccgatcaggttcctttgggagacttcgacttgttggcgaaatgaaccggagaagaatcccaattgggaattgcggaaaacaggactctagggtagagaaaggttgtagaaccaatagggtttgagacctgcgactcggaccgatg

SEQ ID NO: 3251 - DNA, 203 bp, Homo sapiens
ggcgcgccagtcctcgcggtgccgcggggccgctccgaggagcctgagagacccacggaggcttcgcgggaagacgcggcggcggcggcggaggatgagcctgcagagcgcgcagtacctccgattctaagctgggtccagctgaagtctggacatccaggcaggctctgcaggacctgtaccagaaacgactcggaccgatg

SEQ ID NO: 3252 - DNA, 203 bp, Homo sapiens
ggcgcgccagtccttccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctccgactcggaccgatg

SEQ ID NO: 3253 - DNA, 203 bp, Homo sapiens
ggcgcgccagtcctagaggaggagggcacttttgtgtgatggcaacttcacttctagggcgtggtgcttgctcccgaatcagacgccggcagccaaacttgtcccctcctgtagagtaggaagcggccgggcgccggggctgttgggggtgccaggaagaaccgaggttgggatcgactcctctggcccgactcggaccgatg

SEQ ID NO: 3254 - DNA, 203 bp, Homo sapiens
ggcgcgccagtcctaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacacgactcggaccgatg

SEQ ID NO: 3255 - DNA, 203 bp, Homo sapiens
ggcgcgccagtccttcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgccccgactcggaccgatg

SEQ ID NO: 3256 - DNA, 203 bp, Homo sapiens
ggcgcgccagtcctaagagtcggagttttggcgttagacctaggttcagagctcagatccacttcttcctagccttacgacttaggagcactccgctggtccaggcggcaacatgtccatgcttttagtgatgtccctgcctctaatccagaagccatggaggagataaggtagcccccctcgatcggcgactcggaccgatg

SEQ ID NO: 3257 - DNA, 203 bp, Homo sapiens
ggcgcgccagtcctaccgtctgaggccaggagcgctgcgacggagccttgaccgccgttgcccggccctctcccgcgcagccccgggcttccgcagtccttccttcagaagggaaatttctgagggtcaggaaggggaatctgtacctcactccttgaacaccaaggaaggaatattgggaaaccaaacgactcggaccgatg

SEQ ID NO: 3258 - DNA, 203 bp, Homo sapiens
ggcgcgccagtcctacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatccgactcggaccgatg

SEQ ID NO: 3259 - DNA, 203 bp, Homo sapiens
ggcgcgccagtccttgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggacccgactcggaccgatg

SEQ ID NO: 3260 - DNA, 203 bp, Homo sapiens
ggcgcgccagtcctcgtgcgagtcggcctcagtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacacgactcggaccgatg

SEQ ID NO: 3261 - DNA, 203 bp, Homo sapiens
ggcgcgccagtcctcctctctgctgagtcagagctctgcatatattttaagaaaaggcattgaggaactcaatcaaaccagtattcttttcacacaggtttcatcagtttcacccttttctgtgtgcggctgattttagaaagattgcttccttgtatggtagcgataagtttgatttgccctatgggcgactcggaccgatg

SEQ ID NO: 3262 - DNA, 203 bp, Homo sapiens
ggcgcgccagtcctaacaaaccagggcgggatgggagtgtcttcttggctgtggaaatcgatcctcctaccttgtcctgaagccacccgccgcctttcctcgtccctcccttcgcggtgattttccggtcccggcgcccggcgagggcgcgcggctggtgtccgccccgcccgaaaggtgagccagcccgactcggaccgatg

SEQ ID NO: 3263 - DNA, 203 bp, Homo sapiens
ggcgcgccagtcctctccccacgcgccaccatgcctctgctggacgttttctggtcttgcttcaggaaggtgaagtgcttcccattgctgcaggtgaagaagaacgctgaagccgaggccaaaagagcatgtgagtggcttcaagcaacaggattccctcagtatgtgcagctttttgaaggaggctgcgactcggaccgatg

SEQ ID NO: 3264 - DNA, 203 bp, Homo sapiens
ggcgcgccagtcctagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaaccgactcggaccgatg

SEQ ID NO: 3265 - DNA, 203 bp, Homo sapiens
ggcgcgccagtcctattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgccgactcggaccgatg

SEQ ID NO: 3266 - DNA, 203 bp, Homo sapiens
ggcgcgccagtcctactgaagtaggcctacacagtaggaactcatgtcatttcttgtaagtaaaccagagcgaatcaggcggtgggtctcggaaaagttcattgttgagggcttaagagatttggaactatttggagaccaatgatgcgagctcagagtcaatagcatccttctctaaacaggaggtccgactcggaccgatg

SEQ ID NO: 3267 - DNA, 203 bp, Homo sapiens
ggcgcgccagtcctaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccatacgactcggaccgatg

SEQ ID NO: 3268 - DNA, 203 bp, Homo sapiens
ggcgcgccagtcctgcaagctgctgaagtttctcagctgcggggagcaagggtaatcactcctgaagatcttctgtttttgatgcgcaaagataagacaaattgagtggcagcaataatgcgaacaaaagacaaaagattgctcaggacttcctcaactctattgaccagacaggagaacttttagcacgactcggaccgatg

SEQ ID NO: 3269 - DNA, 203 bp, Homo sapiens
ggcgcgccagtccttggctgctgaagatcatctgcggggtggtcaccatccgcaccgtgtatgcctcccacaagcaggccaaggcctgcctcgtctctcgcgttagctgtgagcgcacaggcactcgcttccacacccgtggcgtgaacgacgacggccatgtgtccaacttcgtggagacagagcagcgactcggaccgatg

SEQ ID NO: 3270 - DNA, 203 bp, Homo sapiens
ggcgcgccagtcctgagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagccgactcggaccgatg

SEQ ID NO: 3271 - DNA, 203 bp, Homo sapiens
ggcgcgccagtcctcgaatctccatccctaatccatctgcccctaatctctgtcccctttgcccatccttccttttctcggtgtctctttccacccttatctccacacctgcccaccctgcactcccattctgtttcccatctgcacccttgccccatccctcccacacacaggaccagacggccacccgactcggaccgatg

SEQ ID NO: 3272 - DNA, 203 bp, Homo sapiens
ggcgcgccagtcctgaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgcgactcggaccgatg

SEQ ID NO: 3273 - DNA, 203 bp, Homo sapiens
ggcgcgccagtcctccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacacgactcggaccgatg

SEQ ID NO: 3274 - DNA, 203 bp, Homo sapiens
ggcgcgccagtcctggcctcttttgtaggagcacctgaaatgcagcgtctggtgcactaagccgtagcggcagcagcagccacagcgacagcgctggggccctgtgtagaagctccatcccccttgtctttgtgcttgcctgcgtccccagactcagagattatcttagaagacctaggactccaaaacgactcggaccgatg

SEQ ID NO: 3275 - DNA, 203 bp, Homo sapiens
ggcgcgccagtccttgcttagaacagagcttggtgagcatccggtcaacagctggtccctgcagacggcttcccatttttatgaccggatgctgggaagcctgctggtccacaggtccatacatgaagtcaccataagagggtggttcccacttcatcaacacctcatcgccgcgaggtgaggctaagcgactcggaccgatg

SEQ ID NO: 3276 - DNA, 203 bp, Homo sapiens
ggcgcgccagtcctctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaacgactcggaccgatg

SEQ ID NO: 3277 - DNA, 203 bp, Homo sapiens
ggcgcgccagtcctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgacgactcggaccgatg

SEQ ID NO: 3278 - DNA, 203 bp, Homo sapiens
ggcgcgccagtcctggacgggcgggctgggactggtgctggccattggctgcctcaaggctcccaccccgcctgcctccctagcctgcggctggcggcccctgcctctccagctgcctctgaactccctggagcaagcacctcctgctgggctgtgtgagctgcgactggttctcagtggcccctgcccgactcggaccgatg

SEQ ID NO: 3279 - DNA, 203 bp, Homo sapiens
ggcgcgccagtcctccctggaaagcggcctacagttccttggacacctccaagttcaagaaccagggtctgtcatccccacagcccctgcccctgggagccagcgctcaaggcagctccctagggcagtgccacttgaaggagattccccctccacccccgactgctgccagcagggattctctgggccgactcggaccgatg

SEQ ID NO: 3280 - DNA, 203 bp, Homo sapiens
ggcgcgccagtcctggttcttcagctttggaacttgactggctctccttgctcctcagcctgcagacagcctattgtgggaccttttgatcgtgaccaccaaggatccagatataattctttcctcagtaatagaaaaaagaatctgggatctaagaagatacctactcattttctaagtgactggcccgactcggaccgatg

SEQ ID NO: 3281 - DNA, 203 bp, Homo sapiens
ggcgcgccagtcctgcgggggtcgcgctgcacagcctgcggcgcagcggagggggaccgcagtcgagtctgcagagtgttgggtctgtagccagcaaattacttcatcatctagattatccattcagttgatcctaattagcaaggataacaagaatcgtccgcactaaagtcccctgcagcgtgacccgactcggaccgatg

SEQ ID NO: 3282 - DNA, 203 bp, Homo sapiens
ggcgcgccagtcctcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatccgactcggaccgatg

SEQ ID NO: 3283 - DNA, 203 bp, Homo sapiens
ggcgcgccagtccttgtgcactttctccctccacctggagcatgggctaacaccggaggaaaggaaaagacagagtcagacaggggcctgccccatcacctgaattccagagatgccagtgtgcactgaagccccaggcagggcgtgcccaggaccggatcctggatggtggagcctggggaggggcccgactcggaccgatg

SEQ ID NO: 3284 - DNA, 203 bp, Homo sapiens
ggcgcgccagtcctcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaagcgactcggaccgatg

SEQ ID NO: 3285 - DNA, 203 bp, Homo sapiens
ggcgcgccagtcctgacaactgccgctcaggccatctctggcttcttcgtgtggacggccctgctcatcacatgccaccagcccagggctcggctgggccaagtgtgatgtcatgagagctgggacgagacacccaggggctgcctggactgaggactgtggtagagcagctcttggcatttatctaccgactcggaccgatg

SEQ ID NO: 3286 - DNA, 203 bp, Homo sapiens
ggcgcgccagtcctcgtctaaattcgcgtcggttcttatttctctccctggcaaggtctgaagacggatggagtctagttctgtcgcccaggctggagcccagtggtgtgatctcagctcactgcaatctccacctcctggcttcaagcgattcttctgcttcagcctcccgactgtgtcagcgtgttcgactcggaccgatg

SEQ ID NO: 3287 - DNA, 203 bp, Homo sapiens
ggcgcgccagtcctcacttcgactgctcagggaagtacagatgtcgctcatcctttaagtgtatcgagctgatagctcgatgtgacggagtctcggattgcaaagacggggaggacgagtaccgctgtgtccgggtgggtggtcagaatgccgtgctccaggtgttcacagctgcttcgtggaagacccgactcggaccgatg

SEQ ID NO: 3288 - DNA, 203 bp, Homo sapiens
ggcgcgccagtcctgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggctaaacatatttttgactggtcgactcggaccgatg

SEQ ID NO: 3289 - DNA, 203 bp, Homo sapiens
ggcgcgccagtcctcctcgtcctcggcccgggtgccctgcccccgtccaggagccctaggagtgctacggggggccggagccttgcccgggccgctgccccgtccctggattcggggctggacgcagcaagcggggcgctgtgtccccaagctccccgtcctcgggggagcttttggaagagtcccagcgactcggaccgatg

SEQ ID NO: 3290 - DNA, 203 bp, Homo sapiens
ggcgcgccagtcctcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgacccgactcggaccgatg

SEQ ID NO: 3291 - DNA, 203 bp, Homo sapiens
ggcgcgccagtcctggctgctcgggctggtctcggccgcggccgccgcctgggacctggcttccctgcgctgcaccttgggcgccttttgcgaatgcgacttccggcccgacttgccggaaggatctgaagagctgggtccaagggaacctcactgcctgtggccgctccctcttcctcttcgatgagcgactcggaccgatg

SEQ ID NO: 3292 - DNA, 203 bp, Homo sapiens
ggcgcgccagtcctatacacacagtgacttggaggaatctcaaaggcattctgctcaatgacaggagccagcctcaaaagatttggctgactgaggacgcgacaggtactcagcttctttctgcatctcagttgcccagcacaggggctggcacgcacccttctgcagaggccgggctggaggagaagcgactcggaccgatg

SEQ ID NO: 3293 - DNA, 203 bp, Homo sapiens
ggcgcgccagtcctccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctacccgactcggaccgatg

SEQ ID NO: 3294 - DNA, 203 bp, Homo sapiens
ggcgcgccagtcctcctggtctcccgcgtccatcggtccattcctgcgtcgttctgtccttccgaacgcacacttcaggagcagccgcgaggagtgagcactgcacgcaggatccgcccagtgcttgggccaagcaccctgtggcatccaagctcccctggacgttacccttggtgaaccaaggtggccgactcggaccgatg

SEQ ID NO: 3295 - DNA, 203 bp, Homo sapiens
ggcgcgccagtcctgtcactctaagttggtggtatccaatcccttaggaacgaacctctgaggttttccatttatgagactctcctactactagagtgggccaaagggagagagaatcctatttggagcaatgaggaggtaacagtccacccacaaatgaattatcaggagtgaacccagaggcacgtcgactcggaccgatg

SEQ ID NO: 3296 - DNA, 203 bp, Homo sapiens
ggcgcgccagtcctgaggggctttcagctggtcgcctgcttgtcacctctcgctgcctgaaaggcagctctcagagccctttcctgtccttctaattacagcggcgggggcagtgcgcgcttcgggacgcaattggaaaccagcgtgcagggtcaaagacagccggccccccatgtcagtggtctaggcgactcggaccgatg

SEQ ID NO: 3297 - DNA, 203 bp, Homo sapiens
ggcgcgccagtcctcgagaccttcagagtcacctcgcagtgtaacctgtagcctgtagagatgacttctacccggcctccccctcagagctcttggagtccaggctgagggtcttgaagaaggaactggaggactgtgaggtgttccggtccacggaaaagaaggagagcaaggagctgctgaaacagcgactcggaccgatg

SEQ ID NO: 3298 - DNA, 203 bp, Homo sapiens
ggcgcgccagtcctagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggcgactcggaccgatg

SEQ ID NO: 3299 - DNA, 203 bp, Homo sapiens
ggcgcgccagtcctagggaccctgagcaccgcctggtctctttcctgtggccagcccagctgggaggctgtggcgtgctgggtgtcggcatctggctggccgccacacaggggagcttcgccacgctgtcctcttccttcccgtccctgtcggctgccaacttgctcatcatcaccggcgcctttgtccgactcggaccgatg

SEQ ID NO: 3300 - DNA, 203 bp, Homo sapiens
ggcgcgccagtccttttgaaagcgtgggctgaatgctgacctcccggacatcatgagtgttgttctacctgcgccccctggacatcctggcggaagtggtcccttctgatggcgccacaagcgggatcaggatagttcaggttcacggtgcacggggactccagctctcagtagccgccccccgcacccgactcggaccgatg

SEQ ID NO: 3301 - DNA, 203 bp, Homo sapiens
ggcgcgccagtcctattggcagttgtgattcagagacctagaaagctgaacccacggctggcaagaagaggatggtttgtgggacctgggctgatgtctgatgaaattttaagccccagctatagctactacaaagaaaagtggctgatgataagcatgtaactcaaaaagacaatgtatataaaaatcgactcggaccgatg

SEQ ID NO: 3302 - DNA, 203 bp, Homo sapiens
ggcgcgccagtcctgtgggccaagcgggagttcagattggcaatgcctgctgggagctcttctgcctggaacacggcatccaggcagacggcacttttgatgctcaagctagcaagatcaacgatgatgactccttcaccacctttttcagcgagactggcaatgggaagcatgtgccccgggccgtccgactcggaccgatg

SEQ ID NO: 3303 - DNA, 203 bp, Homo sapiens
ggcgcgccagtcctcacaggcgtccacagttctgggaagtcatcagtgatgagcatggcatcgaccccagcggcaactacgtgggcgactcggacttgcagctggagcggatcagcgtctactacaacgaggcctcttctcacaagtacgtgcctcgagccattctggtggacctggaacccggaacccgactcggaccgatg

SEQ ID NO: 3304 - DNA, 203 bp, Homo sapiens
ggcgcgccagtcctcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaacgactcggaccgatg

SEQ ID NO: 3305 - DNA, 203 bp, Homo sapiens
ggcgcgccagtcctcctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaactcgactcggaccgatg

SEQ ID NO: 3306 - DNA, 203 bp, Homo sapiens
ggcgcgccagtcctgcgggggcggggcacctctgtgcagggttcccagtcaccgcgacgctcctcgggaagccatagggcgcctcccagcccgtctccccgctccagtttagaacctaattcccaattccgggaccgggcccagccctgggctcttactgtccgcttttgctgggacctgttccacaacgactcggaccgatg

SEQ ID NO: 3307 - DNA, 203 bp, Homo sapiens
ggcgcgccagtcctttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtgcgactcggaccgatg

SEQ ID NO: 3308 - DNA, 203 bp, Homo sapiens
ggcgcgccagtcctagtgggaatccttaaccccgccccctgctcaggtcaatcccccacccaccgcccccactgtccctcccagtcttccttcccagaggagaaggctgggtatgaggaaactgctgtcttttcactggatcagacgtaaatattaactggacctctctttagattctttgctcaatacgactcggaccgatg

SEQ ID NO: 3309 - DNA, 203 bp, Homo sapiens
ggcgcgccagtcctgactggaggagcacaggccttggaaaggaaagcagctgagatccagaggagtggaaggctcccccttgactaaagctaaacaccagtttctcaggaggatgccttgaatctcatgaacgagaatatagacattctggagacagcgatcaagcaggcagctgagcagggtgctcgcgactcggaccgatg

SEQ ID NO: 3310 - DNA, 203 bp, Homo sapiens
ggcgcgccagtcctaggagtcaaacttgcgggaattttgcagtttatctgcagggctgttgtttccagcaagacccaaagctagaaaaggaggaggaagaaactgacccgatcagtgccagtcattgtattcaaagaagaataagcaagaaagaaaagaaggaaggaagagaggtagacagatacaagcgactcggaccgatg

SEQ ID NO: 3311 - DNA, 203 bp, Homo sapiens
ggcgcgccagtcctaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgcgactcggaccgatg

SEQ ID NO: 3312 - DNA, 203 bp, Homo sapiens
ggcgcgccagtccttcctctttcctctgcccagtcctggggtcccgcggccgcctaggagggagcccgccggggcggggcggggccgggtgcccatgaacagcggggtcccggccacgctggccgtgcggagagtgaaattcttcggccagcacggcggggaggtcaactcttctgccttctcccctgcgactcggaccgatg

SEQ ID NO: 3313 - DNA, 203 bp, Homo sapiens
ggcgcgccagtccttgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggacgactcggaccgatg

SEQ ID NO: 3314 - DNA, 203 bp, Homo sapiens
ggcgcgccagtcctttcttcttgttgggggactcccagccttccgcgcgtccggaggaggagaagcggcggcgccgggaagcagtgtctgttgacttcacttggcactgtttaacattccacctctggaaattgtaaagatggagagatgaggggaagggacaaggggatgaagaaagaggaaagggccgactcggaccgatg

SEQ ID NO: 3315 - DNA, 203 bp, Homo sapiens
ggcgcgccagtcctcgaacaaccaaacagaaaagtttaataaacagcggacggaggggccggcggtggcggagccggagcaagcaggggttcggcggcattacctgtacccattcaccggcggctaccggcggcggcgcgcagcgtgtcaggcggagagacccgccgccaggtgtgcaactgaggaaccgactcggaccgatg

SEQ ID NO: 3316 - DNA, 203 bp, Homo sapiens
ggcgcgccagtcctatctgaagtctgctgcagtaaaacacagaaggctttaaaatgttttcttgcataaaattcaaaacttttaagtagctgcttatgagaatagggaaggcagaaagctaatgtctgtctcaagatacaggacagctgtttgctcatcaacctcaactgtgtgtgcaactgaggaaccgactcggaccgatg

SEQ ID NO: 3317 - DNA, 203 bp, Homo sapiens
ggcgcgccagtcctccagttgccttcttcctcatctctgcagtaactgtcttcatggtttcatagccttctccctgatacccctccccagtgtcacatttgaagacgagcactgaggatgaggaaccaactgaagaatatgaaaatgttggaaatgcagcatctaagtggccaaaagtggaggatcctcgactcggaccgatg

SEQ ID NO: 3318 - DNA, 203 bp, Homo sapiens
ggcgcgccagtccttggaggtcggatccgcagctgcttgcccggttctactatgccgacgaggagctgaaccaggtggccgcggagctggacagcctggatgggcggaaggacccccagcggtgcacgctgctggtcagccagttccgctcctgtcaggacaatgtgttgaacatcattaaccagatccgactcggaccgatg

SEQ ID NO: 3319 - DNA, 203 bp, Homo sapiens
ggcgcgccagtcctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagacgactcggaccgatg

SEQ ID NO: 3320 - DNA, 203 bp, Homo sapiens
ggcgcgccagtcctaacctctgcctcgattggttgcagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagcgactcggaccgatg

SEQ ID NO: 3321 - DNA, 203 bp, Homo sapiens
ggcgcgccagtcctgcggcgggaaggaggcggcaccggaggggagggccgggcgcggcggcggcggcggtggaggagccggagcataatgctaaagaagtaaacaggtcatggcacgtttaacaaaaagacgacaggcggatacaaaagctatccagcatctttgggcagccattgagattatacggacgactcggaccgatg

SEQ ID NO: 3322 - DNA, 203 bp, Homo sapiens
ggcgcgccagtcctcctcgcgccccggcctcggcgcccgctcccggctccagcgcgcctgcacgtacgtagccttcacgtgtgtgtggatacggagtgcatgtgtggagacagaggaatatgctccaacaaatttcggatagaggcgccgaagacaggacgtggggaagctaaagaagtaaacaggtccgactcggaccgatg

SEQ ID NO: 3323 - DNA, 203 bp, Homo sapiens
ggcgcgccagtcctggtttgagccaagtatgtgtcttgcgggtctttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaacgactcggaccgatg

SEQ ID NO: 3324 - DNA, 203 bp, Homo sapiens
ggcgcgccagtcctctgtgtcccctgctagccgtaggtcgtgtgacccgcaggcaccgggagatccagaagtgaaacgccaggctctctggaggccaggagatggcatattctcacgatgcaggtgtgatttgtccagagaatctttcctaagaggaaatcccagagaagcaggagaaagagaaagaacgactcggaccgatg

SEQ ID NO: 3325 - DNA, 203 bp, Homo sapiens
ggcgcgccagtcctagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattccgactcggaccgatg

SEQ ID NO: 3326 - DNA, 203 bp, Homo sapiens
ggcgcgccagtcctatggctgttgaacatccacaaggcacctgcaagggaggaaatttggacacacagagagatgccaaggatacacacagaggaaagaccatgtgagtgcatagcaagaaagtgaccatctgcaagccaagactatgaatcaaagttgagaccaagaaattatttctgaaaaaggatcgactcggaccgatg

SEQ ID NO: 3327 - DNA, 203 bp, Homo sapiens
ggcgcgccagtcctatgtgcactgagggtgacacttctgagtgtgggggccctggctagggagtgggactggcaggcttgggtggggttcccaagctttaatcttcctaccccacagaatgttttctctgcccttcaggcagcctgagccgggcagggcccctgcctctgctacggcagcccccgatccgactcggaccgatg

SEQ ID NO: 3328 - DNA, 203 bp, Homo sapiens
ggcgcgccagtccttctctcaaacctgaaggcatccagaactgggatgacttatgggtccagagagagggtctaggaaagcctcagcctcgggacagaggcccccggctcctgggtgaaccacgctggggccaggctagtagtgatcgggccgctgtgtgtggtgagtgtggcaaaagcttcaggcagcgactcggaccgatg

SEQ ID NO: 3329 - DNA, 203 bp, Homo sapiens
ggcgcgccagtcctagtccgtggatctcacaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggcgactcggaccgatg

SEQ ID NO: 3330 - DNA, 203 bp, Homo sapiens
ggcgcgccagtcctgagtgatgtcttccagactcggtgctgtacccgcccaggacccagtgctccataaaggataatagtttccagtacactatccctcatgatgactccttaagtggttcatcgtctgcatcttcgtgtgaaccagtgagtgattttccagcatctttccgaaaatctacctactggcgactcggaccgatg

SEQ ID NO: 3331 - DNA, 203 bp, Homo sapiens
ggcgcgccagtcctggaccccggctcccttttccgttgacctggtgttcgttttccatgtgttgctgagagatggatgttaaaaatcaacaccaggactacagtaaggctgaaatcattgaagtgcttggagtgcagaactgaaagagtttcattggggatcatgtccatggagctcctcatgctgtccgactcggaccgatg

SEQ ID NO: 3332 - DNA, 203 bp, Homo sapiens
ggcgcgccagtcctctcactgcaagctctgcctcccggttgctgaacctgtttgcatgagttgctcctgacggccctttaggatacttccatgtctgtagggtctagagtgacatctcctcccctcccctgacgagatctgccctccttggcactgtgcttccccagaggggtggcctcgctgttccccgactcggaccgatg

SEQ ID NO: 3333 - DNA, 203 bp, Homo sapiens
ggcgcgccagtccttacatttcccagagggcctggtggcctgccacttttctcgcaggaattcgaacgtttcgtcactcctggcgggacccttagatctgggaggaaacctctctgaggtctggtcagattccaaccctggacagcagtgaacacaacctttcccctgagccactggaattggacagacgactcggaccgatg

SEQ ID NO: 3334 - DNA, 203 bp, Homo sapiens
ggcgcgccagtcctgaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagaccgactcggaccgatg

SEQ ID NO: 3335 - DNA, 203 bp, Homo sapiens
ggcgcgccagtcctgatacaagccatctctaaactgtgggccattcagtggacaagagaaaatttatgacattgtgtcagaaacgattgagaaagactttcctgtgtggtttggctccgtggttggacacatcagtagccccgtggtcatcctgcccgcagtactcctgcttttcatgctcatctattcgactcggaccgatg

SEQ ID NO: 3336 - DNA, 203 bp, Homo sapiens
ggcgcgccagtcctcagccgcctctgcagcccgagatgcctgacctcagccacctcacggaggaggagaggaaaatcatcctggccgtcatggataggcagaagaaagaagaggagaaggagcagtccgtgctcaaaaaactgcatcagcagtttgaaatgtataaagagcaggtaaagaagatgggacgactcggaccgatg

SEQ ID NO: 3337 - DNA, 203 bp, Homo sapiens
ggcgcgccagtcctgcctgcacctgcagcacagagactttcctctggagacccttctacaagtccatctttgtcccagactacaccaagtaaagatactgatgatcagtccaggaaaaacatgactagcaagaaccggggcaagaggaaagctgatgccacttcttcccaagacagtgaattagaacgcgactcggaccgatg

SEQ ID NO: 3338 - DNA, 203 bp, Homo sapiens
ggcgcgccagtcctcagattttcctcagtgtcatagtaggagctttaaatcttggcaatgcctctccttgtttggaagcctttgcaactggacgtgcagcagccaccagcatttttgagacaatagacaggaaacccatcattgactgcatgtcagaagatggttacaagttggatcgaatcaagggtcgactcggaccgatg

SEQ ID NO: 3339 - DNA, 203 bp, Homo sapiens
ggcgcgccagtcctaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagcgactcggaccgatg

SEQ ID NO: 3340 - DNA, 203 bp, Homo sapiens
ggcgcgccagtcctagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccaccgactcggaccgatg

SEQ ID NO: 3341 - DNA, 203 bp, Homo sapiens
ggcgcgccagtcctaagacagaactcaactcatcagctgaaagtgaacaacctttggacaaaacaggacatgttaaggatacaaatcaagaagatggagttatcatcagtgaacatggtgaagatgaaatggatatggaaagtgaaaaagaggaagaaaagccaaagactggtggagctttttcaaatcgactcggaccgatg

SEQ ID NO: 3342 - DNA, 203 bp, Homo sapiens
ggcgcgccagtcctccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaacgactcggaccgatg

SEQ ID NO: 3343 - DNA, 203 bp, Homo sapiens
ggcgcgccagtccttcagccttctgaagtgaatcagaacacagcagagaatattgagaaagaaagatctatgcttccttcagaaaataacattgaaaacagcttactagcagatagaagtgatgcttgggataaaagcaaagcagaatcagctgtgaccaaacaagaccagatttctgcctctgagctcgactcggaccgatg

SEQ ID NO: 3344 - DNA, 203 bp, Homo sapiens
ggcgcgccagtcctgtgtgctcttctacacagcttgtctcgatcccaattttccagccacgctattcaaagacaagatgaaatgcactgtgaataaccagcaatcaaagaaaatcatggtggcagcagatattgtgacgatattcaacctgatccaaatgaatggcggggctgccaaggagaagctgccgactcggaccgatg

SEQ ID NO: 3345 - DNA, 203 bp, Homo sapiens
ggcgcgccagtcctacaccagtgacaatctcgttgggaacggccccatccttgcagaacaatcaacctgtggagtttaatcatgccatcaactatgttaataagatcaagaacagatttcagggccaaccagacatctacaaagcattcctggagattttgcacacatatcagaaagagcagagaaatcgactcggaccgatg

SEQ ID NO: 3346 - DNA, 203 bp, Homo sapiens
ggcgcgccagtcctagcagacagagctaaatccgagatggccaccatgaaagtgagatctggacgatatgattgtaagacaactatgaccaaggttaaatttaaagctgcgaagaaaaattgctctgtgggtcgtcaccacactgttctcaatcattccatcaaggttatgagcaatgtgtttgagaacgactcggaccgatg

SEQ ID NO: 3347 - DNA, 203 bp, Homo sapiens
ggcgcgccagtcctgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgcgactcggaccgatg

SEQ ID NO: 3348 - DNA, 203 bp, Homo sapiens
ggcgcgccagtcctgtaaaacagaagataatggcccaaaggaggatagcagcctgcctacatttaaaactgcaaaagaacaattatgggtagatcagcaaaaaaagtaccaccaacctcagcgtgcatcagggtcttcatatggtggtgtaaaaaagtctctaggagctagtagatcccgagggataccgactcggaccgatg

SEQ ID NO: 3349 - DNA, 203 bp, Homo sapiens
ggcgcgccagtccttcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgccgactcggaccgatg

SEQ ID NO: 3350 - DNA, 203 bp, Homo sapiens
ggcgcgccagtcctgattacactactagacgttgtgtttgtgctggatcattcaggtagcataaaaaaacaatatcaagatcacatgattaacctaactatccatttggtgaagaaagcagatgttggcagggaccgagttcagtttggagccctcaaatactctgaccaacctaacatccttttctacgactcggaccgatg

SEQ ID NO: 3351 - DNA, 203 bp, Homo sapiens
ggcgcgccagtccttgaagatgatgtagatcaggaacttgcgaacatagaccctacgtggatagaatcacctaaaaccaatggccatattgagaatggcccattctcactggagcagcaactggacgatgaagatgatgatgaagaagactgcccaaatcctgaggaatataatcttgatgagccaaacgactcggaccgatg

SEQ ID NO: 3352 - DNA, 203 bp, Homo sapiens
ggcgcgccagtcctgaacgggggtttgcctccccgtcatgcaagaccccgcttgcaaattcctccggaaacagggacgagccccttttttgcttttcccagatgcatccggtgctgcggcagatgcgcccccctcctcagcagcggcaagagcaagagcagcggcagacatgcagggcaccctcccctcgactcggaccgatg

SEQ ID NO: 3353 - DNA, 203 bp, Homo sapiens
ggcgcgccagtcctcgctgacctgcgctgggccccaagccgacgcgccctggaggcagctggggccggacctgggctggcggtggcacccgcgcgcgctggcaacgtcggcggcgtggaggaatatgacgaggacgatgagtacgagccagaggacggcgagtactaagcggtgatgtttctgatcagcgactcggaccgatg

SEQ ID NO: 3354 - DNA, 203 bp, Homo sapiens
ggcgcgccagtcctagtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaaccgactcggaccgatg

SEQ ID NO: 3355 - DNA, 203 bp, Homo sapiens
ggcgcgccagtcctgccattagtgctatgactcagggtcgcaggggcaacgtgtactgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctcgactcggaccgatg

SEQ ID NO: 3356 - DNA, 203 bp, Homo sapiens
ggcgcgccagtccttaaatagctaacgtgtcgtatgtgtcatgtatgcgtccatgtcgccgccagaggagctgctgagccgccgtgcgcccgctttccaagatggctaccccttcgatgatgccgcagtggtcttacatgcacatctcgggccaggacgcctcggagtacctgagccccgggctggtgcgactcggaccgatg

SEQ ID NO: 3357 - DNA, 203 bp, Homo sapiens
ggcgcgccagtcctggaggattacaagtgggaatttgaagagcttttgaaatcctgtggtgagctgtttgattctttgaatctgggtcaccaggcgcttttccaagagaaggtcatcaagactttggatttttccacaccggggcgcgctgcggctgctgttgcttttttgagttttataaaggataacgactcggaccgatg

SEQ ID NO: 3358 - DNA, 203 bp, Homo sapiens
ggcgcgccagtcctcgcctcagccgcttttttgggggcgcgcggggaggcggcggcgacggcgacggggacgacacgtcctccatggttggtggacgtcgcgccgcaccgcgtccgcgctcgggggtggtttcgcgctgctcctcttcccgactggccatttccttctcctataggcagaaaaagatccgactcggaccgatg

SEQ ID NO: 3359 - DNA, 203 bp, Homo sapiens
ggcgcgccagtcctgccgcaccgcgtccgcgctcgggggtggtttcgcgctgctcctcttcccgactggccatttccttctcctataggcagaaaaagatcatggagtcagtcgagaaggaggacagcctaaccgccccctttgagttcgccaccaccgcctccaccgatgccgccaacgcgcctacccgactcggaccgatg

SEQ ID NO: 3360 - DNA, 203 bp, Homo sapiens
ggcgcgccagtccttcattacccagggccacatccttggccaattgcaagccatcaacaaagcccgccaagagtttctgctacgaaagggacggggggtttacctggacccccagtccggcgaggagctcaacccaatccccccgccgccgcagccctatcagcagccgcgggcccttgcttcccaggcgactcggaccgatg

SEQ ID NO: 3361 - DNA, 203 bp, Homo sapiens
ggcgcgccagtcctcccttttctggacctcccggccactacccggaccagtttattcccaactttgacgcggtgaaagactcggcggacggctacgactgaatgaccagtggagaggcagagcgactgcgcctgacacacctcgaccactgccgccgccacaagtgctttgcccgcggctccggtgagcgactcggaccgatg

SEQ ID NO: 3362 - DNA, 203 bp, Homo sapiens
ggcgcgccagtcctagcacttctgtgccttagggttgccgcctgctgcacgcacgtttgtacctattgtcagctttttaaacgctgggggcaacatccaagatgaggtacatgattttaggcttgctcgcccttgcggcagtctgcagcgctgccaaaaaggttgagtttaaggaaccagcttgcaatcgactcggaccgatg

SEQ ID NO: 3363 - DNA, 203 bp, Homo sapiens
ggcgcgccagtcctttccgcttgcttgtattcccctggacaatttactctatgtgggatatgctccaggcgggcaagattatacccacaaccttcaaatcaaactttcctggacgttagcgcctgatttctgccagcgcctgcactgcaaatttgatcaaacccagcttcagcttgcctgctccagagcgactcggaccgatg

SEQ ID NO: 3364 - DNA, 203 bp, Homo sapiens
ggcgcgccagtcctcacagtttacctgctttacggatttgtcacccttatcctcatctgcagcctcgtcactgtagtcatcgccttcattcagttcattgactgggtttgtgtgcgcattgcgtacctcaggcaccatccgcaatacagagacaggactatagctgatcttctcagaattctttaattcgactcggaccgatg

SEQ ID NO: 3365 - DNA, 203 bp, Homo sapiens
ggcgcgccagtccttagccatatatccataccttgacattggctggaatgccatagatgccatgaaccaccctactttcccagtgcccgctgtcataccactgcaacaggttattgccccaatcaatcagcctcgccccccttctcccacccccactgagattagctactttaatttgacaggtggagcgactcggaccgatg

SEQ ID NO: 3366 - DNA, 203 bp, Homo sapiens
ggcgcgccagtccttgtgggttcttttgtcatggttcctggcggggaagtggccgcgctggtccgtgcagacctgcacgattatgttcagctggccctgcgaagggacctacgggatcgcggtatttttgttaatgttccgcttttgaatcttatacaggtctgtgaggaacctgaatttttgcaatccgactcggaccgatg

SEQ ID NO: 3367 - DNA, 203 bp, Homo sapiens
ggcgcgccagtcctactgtcggtggtgctttttaatcacggtgaccagtttttttacggtcacgccggcatggccgtagtccgtcttatgcttataagggttgtttttcctgttgtaagacaggcttctaatgtttaaatgtttttttttgttattttattttgtgtttaatgcaggaacccgcagaccgactcggaccgatg

SEQ ID NO: 3368 - DNA, 203 bp, Homo sapiens
ggcgcgccagtcctggccctttttacactgtgactgattgagctggtgccgtgtcgagtggtgttttttaataggtttttttactggtaaggctgactgttatggctgccgctgtggaagcgctgtatgttgttctggagcgggagggtgctattttgcctaggcaggagggtttttcaggtgtttatcgactcggaccgatg

SEQ ID NO: 3369 - DNA, 203 bp, Homo sapiens
ggcgcgccagtcctcgctacccctcccacttagcctccttcgtgctggcctggacgcgagccttcgtctcagagtggtccgagtttctatacgaggaggaccgcggaacaccgctcgaggacaggcctctcaagtctgtatacggggacacggacagccttttcgtcaccgagcgtggacaccggctccgactcggaccgatg

SEQ ID NO: 3370 - DNA, 203 bp, Homo sapiens
ggcgcgccagtcctcgcggaacaccgctcgaggacaggcctctcaagtctgtatacggggacacggacagccttttcgtcaccgagcgtggacaccggctcatggaaaccagaggtaagaaacgcatcaaaaagcatgggggaaacctggtttttgaccccgaacggccagagctcacctggctcgtgcgactcggaccgatg

SEQ ID NO: 3371 - DNA, 203 bp, Homo sapiens
ggcgcgccagtcctatacccggtgagttcctcaagaggccactcttgagtgccagcgagtagagttttctcctccgagccgctccgacaccgggactgaaaatgagacatattatctgccacggaggtgttattaccgaagaaatggccgccagtcttttggaccagctgatcgaagaggtactggctcgactcggaccgatg

SEQ ID NO: 3372 - DNA, 203 bp, Homo sapiens
ggcgcgccagtcctaatagctaacgtgtcgtatgtgtgtcatgtatgcgtccatgtcgccgccagaggagctgctgagccgccgcgcgcccgctttccaagatggctaccccttcgatgatgccgcagtggtcttacatgcacatctcgggccaggacgcctcggagtacctgagccccgggctggtgcgactcggaccgatg

SEQ ID NO: 3373 - DNA, 203 bp, Homo sapiens
ggcgcgccagtcctcatcgaaaccgtgtacctgcgcacgcccttctcggccggcaacgccacaacataaagaagcaagcaacatcaacaacagctgccgccatgggctccagtgagcaggaactgaaagccattgtcaaagatcttggttgtgggccatattttttgggcacctatgacaagcgctttcgactcggaccgatg

SEQ ID NO: 3374 - DNA, 203 bp, Homo sapiens
ggcgcgccagtcctcaactctacgggctattctaattcaggtttctctagaatcggggttggggttattctctgtcttgtgattctctttattcttatactaacgcttctctgcctaaggctcgccgcctgctgtgtgcacatttgcatttattgtcagctttttaaacgctggggtcgccacccaagcgactcggaccgatg

SEQ ID NO: 3375 - DNA, 203 bp, Homo sapiens
ggcgcgccagtcctaacgcttctctgcctaaggctcgccgcctgctgtgtgcacatttgcatttattgtcagctttttaaacgctggggtcgccacccaagatgattaggtacataatcctaggtttactcacccttgcgtcagcccacggtaccacccaaaaggtggattttaaggagccagcctgtcgactcggaccgatg

SEQ ID NO: 3376 - DNA, 203 bp, Homo sapiens
ggcgcgccagtcctcctaccttgacattggctggaaacgaatagatgccatgaaccacccaactttccccgcgcccgctatgcttccactgcaacaagttgttgccggcggctttgtcccagccaatcagcctcgccccacttctcccacccccactgaaatcagctactttaatctaacaggaggagcgactcggaccgatg

SEQ ID NO: 3377 - DNA, 203 bp, Homo sapiens
ggcgcgccagtcctgctgcaaactttctccacaatctaaatggaatgtcagtttcctcctgttcctgtccatccgcacccactatcttcatgttgttgcagatgaagcgcgcaagaccgtctgaagataccttcaaccccgtgtatccatatgacacggaaaccggtcctccaactgtgccttttcttcgactcggaccgatg

SEQ ID NO: 3378 - DNA, 203 bp, Homo sapiens
ggcgcgccagtccttccacttggacgtgagggccgtttgccttttggaagccattgtgcaacatcttacaaatgccattatctgttctttggctgtagagtttgaccacgccaccggaggggagcgcgttcacttaatagatcttcattttgaggttttggataatcttttggaataaaaaaaaaaaccgactcggaccgatg

SEQ ID NO: 3379 - DNA, 203 bp, Homo sapiens
ggcgcgccagtcctttgaccacgccaccggaggggagcgcgttcacttaatagatcttcattttgaggttttggataatcttttggaataaaaaaaaaaacatggttcttccagctcttcccgctcctcccgtgtgtgactcgcagaacgaatgtgtaggttggctgggtgtggcttattctgcggtgcgactcggaccgatg

SEQ ID NO: 3380 - DNA, 203 bp, Homo sapiens
ggcgcgccagtcctcgcgtgcggttttctgggtgttttttgtggactttaaccgttacgtcattttttagtcctatatatactcgctctgcacttggcccttttttacactgtgactgattgagctggtgccgtgtcgagtggtgtttttttaataggttttcttttttactggtaaggctgactgttcgactcggaccgatg

SEQ ID NO: 3381 - DNA, 203 bp, Homo sapiens
ggcgcgccagtccttgtgggcgtggcttaagggtgggaaagaatatataaggtgggggtcttatgtagttttgtatctgttttgcagcagccgccgccgccatgagcaccaactcgtttgatggaagcattgtgagctcatatttgacaacgcgcatgcccccatgggccggggtgcgtcagaatgtgcgactcggaccgatg

SEQ ID NO: 3382 - DNA, 203 bp, Homo sapiens
ggcgcgccagtccttactgcggctgcagccgtcagcggcgcgggacagcccgcctatgatctggaattggaagagggcgagggactcgcgcgcctgggcgcaccatcgcccgagcggcacccgcccagccgacttctccagtttacgggagcgagccctcttttttttttttgttttttgttgcccagcgactcggaccgatg

SEQ ID NO: 3383 - DNA, 203 bp, Homo sapiens
ggcgcgccagtcctgatgatagcagcgtgttggacttgggtggaagaggagggggcaacccgttcgctcatctgcgtcccagattcgggcgcatgttgtaaaagtgaaagtaaaataaaaatgcaactcaccaaggccatggcgaccgagcgtgcgttcgttcttttttgttatctgtgtctagtacgcgactcggaccgatg

SEQ ID NO: 3384 - DNA, 203 bp, Homo sapiens
ggcgcgccagtcctaagtgaaagtaaaataaaaatgcaactcaccaaggccatggcgaccgagcgtgcgttcgttcttttttgttatctgtgtctagtacgatgaggagacgagccgtgctaggcggagcggtggtgtatccggagggtcctcctccttcttacgagagcgtgatgcagcaacaggcgcgactcggaccgatg

SEQ ID NO: 3385 - DNA, 203 bp, Homo sapiens
ggcgcgccagtcctagacgccgcacctgtccctacgtttacaaggccctgggcatagtcgcgccgcgcgttctttcaagccgcactttctaaaaaaaaaaaatgtccattctcatctcgcccagtaataataccggttggggactgtatgcgcccaccaagatgtatggaggcgcccgcaaacgctctcgactcggaccgatg

SEQ ID NO: 3386 - DNA, 203 bp, Homo sapiens
ggcgcgccagtcctagtacccggaaactgccaaggcaataagtgccctgcagctgtgtttatttaatgtgacgtcatgtaataaaattatgtcagctgctgagtgttttattacttcttgggtggggacttggatatataagtaggagcagatctgtgtggttagctcacagcaacctgctgccatcccgactcggaccgatg

SEQ ID NO: 3387 - DNA, 203 bp, Homo sapiens
ggcgcgccagtcctctgcaagtcgcactcgccgtcgccgccgccgcaacactgccagcaaattgactcccgccgccctggtgcggagagtgtaccgcgatggtcgcgctgaacctctgacgctgccgcgcgcgcgctaccatccaagcatcaccacttaatgactgttgacgctgcctccttgcagatcgactcggaccgatg

SEQ ID NO: 3388 - DNA, 203 bp, Homo sapiens
ggcgcgccagtcctgcagcgccactaacattggaaaaacttataaataaaaaatagaatggactctgacgctcctggtcctgtgactatgtttttgtagagatggaagacatcaatttttcatccctggctccgcgacacggcacgaggccgtacatgggcacctggagcgacatcggcacgagccaacgactcggaccgatg

SEQ ID NO: 3389 - DNA, 203 bp, Homo sapiens
ggcgcgccagtcctgcttgtctgtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctgagtccgggtctggtgcgactcggaccgatg

SEQ ID NO: 3390 - DNA, 203 bp, Homo sapiens
ggcgcgccagtcctgttcctcttcgggggcagaggtggaggcgactgagatgggctgcggtctggccttggaagcggatggctggcagagcccattccgcgttcgggggtgtgctcccgttggcggtcgcttgactgatttcctccgcggctggccattgtgttctcctaggcagagaaacaacagaccgactcggaccgatg

SEQ ID NO: 3391 - DNA, 203 bp, Homo sapiens
ggcgcgccagtccttttggagagttcgtcctcgcagccccgctcgggcggcatcggaactctccagttcgtggaggagtttactccctctgtctacttcaaccccttctccggctctcctggccagtacccagacgagttcataccgaacttcgacgcaatcagcgagtcagtggatggctatgattgcgactcggaccgatg

SEQ ID NO: 3392 - DNA, 203 bp, Homo sapiens
ggcgcgccagtccttcgaactccccgaggagcaccctcagggtccggcccacggagtgcggattaccatcgaagggggaatagactctcgcctgcatcgaatcttctcccagcgacccgtgctgattgagcgcgaccagggaaatacaaccatctccatttactgcatctgtaaccaccccggattgccgactcggaccgatg

SEQ ID NO: 3393 - DNA, 203 bp, Homo sapiens
ggcgcgccagtcctcttgcttatagttattcgccctagacaaagcaataaggaaaaagagaaaatgccttaacctttttactcataccttttctttacagcatggcttttgttacagctctaattattgccaacattgtcactgtcgctcacgggcaaacaattatccatattaccttaggacataatcgactcggaccgatg

SEQ ID NO: 3394 - DNA, 203 bp, Homo sapiens
ggcgcgccagtccttctcctatgattagtcgtccccatatggctttgaatgaaatctaagatcttttttttttttctcttacagtatggtgaacaccaatcatgatccctagaaatttcttcttcaccatactcatctgtgctttcaatgtctgtgctactttcacagcagtagccactgcaagcccacgactcggaccgatg

SEQ ID NO: 3395 - DNA, 203 bp, Homo sapiens
ggcgcgccagtcctcttcctatgcactttttgccttcgttacttgcatctgcgtgtgtagcatagtctgcctggttattaattttttccaactggtagactggatctttgtacgaattgcctacctacgtcaccatcccgaataccgcaatcaaaatgttgcggcacttcttaggcttatttaaaacccgactcggaccgatg

SEQ ID NO: 3396 - DNA, 203 bp, Homo sapiens
ggcgcgccagtcctggatctttgtacgaattgcctacctacgtcaccatcccgaataccgcaatcaaaatgttgcggcacttcttaggcttatttaaaaccatgcaggctatgctaccagtcattttaattctgctactaccctgcattgccctagcttccaccgccactcgcgctacacctgaacaacgactcggaccgatg

SEQ ID NO: 3397 - DNA, 203 bp, Homo sapiens
ggcgcgccagtccttgaaatcagcaataaggtctctgttgaaattttctcccagcagcacctcacttccctcttcccaactctggtattctaaaccccgttcagcggcatactttctccatactttaaaggggatgtcaaattttaactcctgtcctgtacccacaatcttcatgtctttcttcccagcgactcggaccgatg

SEQ ID NO: 3398 - DNA, 203 bp, Homo sapiens
ggcgcgccagtccttgtagcgtcccctgctattgttcccggggggcttctggctaagcagtttggtgataatatgaaagagtatttacaactagaacttagagaagaacttagagccaagggcatgtcaattgatgatgccattcttaatttgctacaggtgacacaggagcaagatattttgacattcgactcggaccgatg

SEQ ID NO: 3399 - DNA, 203 bp, Homo sapiens
ggcgcgccagtcctccgcgaggaactttcggtgctgttgtttaatcacgatgacaggttttacgagggtcgagctggagaccctgtggcttgtcttgtaatggaaagactgatttatccacctgttcgacaggctactatgatatgacgcttgtttcttttattttacagactaattcaaaactaatacgactcggaccgatg

SEQ ID NO: 3400 - DNA, 203 bp, Homo sapiens
ggcgcgccagtcctctgaagacctgagacccgatcatttggtgcttgcctgcactggagcggagttcggttccagtggtgaagaaactgactaaagtgagtagtgggggcaagatgtggatggggactttcaggttggtaaggtggacagattgggtaaattttgttaatttctgtcttgcagctgcccgactcggaccgatg

SEQ ID NO: 3401 - DNA, 203 bp, Homo sapiens
ggcgcgccagtcctgggtacgaagggaacctccagtgggggctgtatcatcgccgcctgttgctgcatcacgctctcgtaagaaggaggaggaccctccggatacaccaccgctccgcctagcacggctcgtctcctcatcgtactagacacagataacaaaaaagaacgaacgcacgctcggtcgcccgactcggaccgatg

SEQ ID NO: 3402 - DNA, 203 bp, Homo sapiens
ggcgcgccagtcctatacaccaccgctccgcctagcacggctcgtctcctcatcgtactagacacagataacaaaaaagaacgaacgcacgctcggtcgccatggccttggtgagttgcatttttattttactttcacttttacaacatgcgcccgaatctgggacgcagatgagcgaacgggttgcccgactcggaccgatg

SEQ ID NO: 3403 - DNA, 203 bp, Homo sapiens
ggcgcgccagtcctaccgtgtttttcacctaaatttccgcgtacggtgtcaaagtcctgtgtttttacgtaggtgtcagctgatcgctagggtatttaaacctgacgagttccgtcaagaggccactcttgagtgccagcgagaagagttttctccttcgcgccgcaagtcagttctgcgctttgaaacgactcggaccgatg

SEQ ID NO: 3404 - DNA, 203 bp, Homo sapiens
ggcgcgccagtcctctgacgagttccgtcaagaggccactcttgagtgccagcgagaagagttttctccttcgcgccgcaagtcagttctgcgctttgaaaatgagacacctgcgtttcctgccacaggagattatcttcagtgagaccgggatcgaaatactggagtttgtggtaaataccctaatgcgactcggaccgatg

SEQ ID NO: 3405 - DNA, 203 bp, Homo sapiens
ggcgcgccagtcctcttctataaaagcgctcggtttaaaaagcttctatgcctgaataggtgaccggaggtcggcacctttcctttacaattaatgaccctatgaatacaactgactgttttatcgctgtggtaaacgccatcaaagaggtaagagcacttttcctaccacggactgcaggaaaaatgcgactcggaccgatg

SEQ ID NO: 3406 - DNA, 203 bp, Homo sapiens
ggcgcgccagtcctgttgggatggttggggttagccatccataccgtactgcctgatagggtccttgcgaggggatctgggagtctcgtagaccgtagcacatgcctgttatttctactcaaacaagtcctgtacctgcgcccagaacgcgcaagaacaagcagacgcaggcttcatatcctgtgtcccgactcggaccgatg

SEQ ID NO: 3407 - DNA, 203 bp, Homo sapiens
ggcgcgccagtccttattatatatctctttgttgggtttataccacttagcttgaaagaggttaaaacattacaattcattgttaagttgaatacagcaaaatgggagctcaagtatcaacgcaaaagactggggcacatgagaccaggctgaatgctagcggcaattccatcattcactacacaaatcgactcggaccgatg

SEQ ID NO: 3408 - DNA, 203 bp, Homo sapiens
ggcgcgccagtcctctcgcccaggagagtagagcggagagaggaagtaagaagacgcctccgggtaagggacgcccgcctttggggaaaaaccaatgcgcgtactgtaaggaggagggacattggaagaagaactgtccaaaactcgtaagcggggcaaccccagtgttggtagaagaattacaatagcgactcggaccgatg

SEQ ID NO: 3409 - DNA, 203 bp, Homo sapiens
ggcgcgccagtccttactgtaaggaggagggacattggaagaagaactgtccaaaactcgtaagcggggcaaccccagtgttggtagaagaattacaatagggccgtcagggttcttccgccctccgtgaacccaggctaaaagttaaagtaggggggcaaataatagattttctagtagatacgggacgactcggaccgatg

SEQ ID NO: 3410 - DNA, 203 bp, Homo sapiens
ggcgcgccagtcctcagcacccccaccgcggtaaaggtcgctgggaagaccccgtggatccaccactctcgactcaagaaagctcctgacaaccaagaagaatggactgtctcaccaacctccgatccgctgagggtaaagttgaccaggcgggcaaaaccctaattcttcttgtggtttggtgggggcgactcggaccgatg

SEQ ID NO: 3411 - DNA, 203 bp, Homo sapiens
ggcgcgccagtcctcgcgcggcttgcgaataatactttggagagtcttttgcctccagtgtcttccgtttgtactcgtcctcctctccctctccggccgggatgggacaggcaggatcgaaggggcttttaacccctctagagtgcattctgaagaacttctctgactttaagaagagggcgggagaccgactcggaccgatg

SEQ ID NO: 3412 - DNA, 203 bp, Homo sapiens
ggcgcgccagtccttaataataataatcttagtataaaaaagtagggagtgaccgaaagtggtgaaccgaaaacggttggtatataaagcacatagtattttgtgcaaacctacagacgccatgttcaaaaatcctgcagaaagacctcggaaattgcatgaactaagctcggcattggaaataccctcgactcggaccgatg

SEQ ID NO: 3413 - DNA, 203 bp, Homo sapiens
ggcgcgccagtcctaatttatatacctatgtatagatggccaatgtactgttgtggaagggcaagttaattgtaagggcatttattatgtacatgaaggacatataacatattttgtaaattttacagaagaggcaaaaaaatatgggactggtaaaaaatgggaagtgcatgcgggtggtcaggtaacgactcggaccgatg

SEQ ID NO: 3414 - DNA, 203 bp, Homo sapiens
ggcgcgccagtccttattttctgggcctgatgtacctatagagcatgcacctacacaggttttcccatttcctttggcccctacaacgccacaagtgtctatttttgttgatgggggtgatttttatttgcaccctagttattatatgttaaaacgtcgacgtaaacgtgtatcatatttttttacagcgactcggaccgatg

SEQ ID NO: 3415 - DNA, 203 bp, Homo sapiens
ggcgcgccagtcctacaagcagaaccggacacatccaattacaatatcgttaccttttgttgtcagtgtaagtctacacttcgtttgtgtgtacagagcacacaagtagatattcgcatattgcaagagctgttaatgggctcatttggaatcgtgtgccccaactgttctactagactgtaactacacgactcggaccgatg

SEQ ID NO: 3416 - DNA, 203 bp, Homo sapiens
ggcgcgccagtcctttactcccttgtttgttggatccactcccgaaacgttttactccttaacttattgaaattgtttgaagacaggatttcagtgtcacaatgggagctcaagtatcatcccaaaaagtaggcgctcacgagaattctaaccgagcctacggtggttctacgatcaactacaccacacgactcggaccgatg

SEQ ID NO: 3417 - DNA, 203 bp, Homo sapiens
ggcgcgccagtcctccaatttggtctgttctgaactacaccatttactgctgtgaagaatgccctggaggcaagctggttacagccctgaccaggccctgcccgtgactctcgaccggcgcagggtcaaaaattgtctaagcagcagcaggaacgcgggagcgtttcttttccttttgtactgacatgcgactcggaccgatg

SEQ ID NO: 3418 - DNA, 203 bp, Homo sapiens
ggcgcgccagtcctccgtgactctcgaccggcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattcttgcaaaagagacgactcggaccgatg

SEQ ID NO: 3419 - DNA, 203 bp, Homo sapiens
ggcgcgccagtcctaagaggagaaatacaaatatttacatagtagagttaccacatttacatttccaaatccattcccctttgacagaaatgggaatgcagtatatgaactatcagatgcaaactggaaatgtttctttgaaagactgtcgtccagcctagacattgaggattcagaggacgaggaagcgactcggaccgatg

SEQ ID NO: 3420 - DNA, 203 bp, Homo sapiens
ggcgcgccagtcctccctttgcaattctttttactaacactgtgtgtgtgctattttcctgccttttatatacacatatacattgtgcaaacgcaacaataatggtgatgttaacctgtcacttaaatgatggtgatacatggttgtttctgtggttgtttactgcatttgttgtagctgtacttggacgactcggaccgatg

SEQ ID NO: 3421 - DNA, 203 bp, Homo sapiens
ggcgcgccagtccttgcagtctgggcctgacataacttttcctactgcatctatgggaacaccctttagtcctgtaactcctgctttacctacaggccctgtttttattacaggttctgacttctatttgcatcctacatggtactttgcacgcagacgccgtaaacgtattcccttattttttacagcgactcggaccgatg

SEQ ID NO: 3422 - DNA, 203 bp, Homo sapiens
ggcgcgccagtcctagacgcacaacctttaacacaacattaccaaatactgacctgttgctgtggatgtgacagcaacgtccgactggttgtggagtgcacagacggagacatcagacaactacaagaccttttgctgggcacactaaatattgtgtgtcccatctgcgcaccaaaaccataacaaggcgactcggaccgatg

SEQ ID NO: 3423 - DNA, 203 bp, Homo sapiens
ggcgcgccagtcctcagctggactgttctttggggccttatgtggtgtttgcctctgaggtactcaggggcatttaggtttttcctcattcttaaataataatgaacatgtctagacaaggtattttccagactgttgggagtggtcttgaccacatcctgtctttggcagacattgaggaagagcaacgactcggaccgatg

SEQ ID NO: 3424 - DNA, 203 bp, Homo sapiens
ggcgcgccagtcctgactgttctttggggccttatgtggtgtttgcctctgaggtactcaggggcatttaggtttttcctcattcttaaataataatgaacatgtctagacaaggtattttccagactgttgggagtggtcttgaccacatcctgtctttggcagacattgaggaagagcaaatgattcgactcggaccgatg

SEQ ID NO: 3425 - DNA, 203 bp, Homo sapiens
ggcgcgccagtcctcggcaggaacaaaccacgacggagtgctcctagaaaggcgcgggccgaggtaccaaaggcagcgtgtggagcgggaggagaagaggcctccgggtgaaggtaagtacctacaccaaaaactgtagccgaaagggcttgctatcctacctttagacaggtagaagattgtgggagcgactcggaccgatg

SEQ ID NO: 3426 - DNA, 203 bp, Homo sapiens
ggcgcgccagtcctccttttcacgcacttcagagcaggatgtggccactcaagaattggccagacaaggggaggaaatcctctctcagctataccgacccctagaaacatgcaataactcatgctattgtaagcgatgctgctaccattgtcagatgtgttttctaaacaaggggctcgggatatgttcgactcggaccgatg

SEQ ID NO: 3427 - DNA, 203 bp, Homo sapiens
ggcgcgccagtcctgatactggccctggccgatagcatatatacatttcctgatccgccagctgattcgcctcttgaccagactatacagcatctgcagggacttactatccaggagcttcctgaccctccaactcatctaccagaatctcagagactggctgagacttagaacagccttcttgcaatcgactcggaccgatg

SEQ ID NO: 3428 - DNA, 203 bp, Homo sapiens
ggcgcgccagtcctccacaacagtgtaattacggccccggcactagatacgcctggaaagtactaccccaagggtttaaaaacagtcccaccctgttcgagatgcagctggcccatatcctgcagcccattcggcaagctttttcccaatgcactattcttcagtacatggatgacatcctcctagcacgactcggaccgatg

SEQ ID NO: 3429 - DNA, 203 bp, Homo sapiens
ggcgcgccagtcctacccagagaacctctaagaccctcaaggtccttaccccgccgaccactcatacaacccccaacattccaccctccttcctccaggccatgcgcaagtactcccccttccgaaacggatacatggaacccacccttgggcaacacctcccaaccctgtcttttccagaccccggccgactcggaccgatg

SEQ ID NO: 3430 - DNA, 203 bp, Homo sapiens
ggcgcgccagtcctccacccctttccctttcattcacgactgactgccggcttggcccacggcaagtaccgcggactctactggctcggagccagcagcagcctattctataacactctccaggagagaaatttagtacacaggtgggggctcgtccgggatacgagcgcccctttattccctaggcacgactcggaccgatg

SEQ ID NO: 3431 - DNA, 203 bp, Homo sapiens
ggcgcgccagtcctaacagtggcttacatggtgtaatgcacaaagctgggaccactatgaaaactgggcaataaactacacttttgatttccctggaattaatgcagatgccctccacccagacctccaaaccaccccaattgtcacagacaccagtatcagcagcagtggtggtgaaagctctgaagcgactcggaccgatg

SEQ ID NO: 3432 - DNA, 203 bp, Homo sapiens
ggcgcgccagtccttgggactttgtccccattgcattaatgtaggggcttggtataatggatggaaatttcgagaatttaccccagatttggtgcgatgtagctgccatgtgggagcttctaatcccttttctgtgctaacctgcaaaaaatgtgcttacctgtctggattgcaaagctttgtagattcgactcggaccgatg

SEQ ID NO: 3433 - DNA, 203 bp, Homo sapiens
ggcgcgccagtcctacccatcctctctgtttgacttagttgctcgcattaaaaataaccttaaaaattctccagacttatatagtcatcattttcaaagtcatggacagttatctgaccacccccatgccttatcatccagtagcagtcatgcagaacctagaggagaagatgcagtattatctagtgcgactcggaccgatg

SEQ ID NO: 3434 - DNA, 203 bp, Homo sapiens
ggcgcgccagtcctaatcaatgggaattactaccttagttcagtatgccgtgggaattatgacagtaaccatgacatttaaattggggccccgtaaagctacgggacggtggaatcctcaacctggagtatatcccccgcacgcagcaggtcatttaccatatgtactatatgaccctacagctacagcgactcggaccgatg

SEQ ID NO: 3435 - DNA, 203 bp, Homo sapiens
ggcgcgccagtcctatgcggtttttacgaactcaactttcaataagattcctttgacgacgataagtcggctttttgttcagttgattataggaggacacgctaaaggaacgatttatgacagcaatgtaattcgcgtcagtcgtcggaaacgagaagacagtttactaaaaaagatgagattggagtcgactcggaccgatg

SEQ ID NO: 3436 - DNA, 203 bp, Homo sapiens
ggcgcgccagtccttcacagaatgtatatagaggttttacctgttggttatatgaatgggcaaacccgagttctggcgtgagcattataaaacgcttcttatagaagatggcactgttggggtatttggtagatatcgtagagcagtttctttcgcctttccatatgatcgcttcatagttgttttttcgactcggaccgatg

SEQ ID NO: 3437 - DNA, 203 bp, Homo sapiens
ggcgcgccagtccttagaagatggcactgttggggtatttggtagatatcgtagagcagtttctttcgcctttccatatgatcgcttcatagttgttttttatgtgggttatgtcgcaggtacgtagcatggagcccgaccttacgttggcggcggtctatcaggcggcggcgaatctcacagagcagcgactcggaccgatg

SEQ ID NO: 3438 - DNA, 203 bp, Homo sapiens
ggcgcgccagtcctgagctcagcgatatttccggtatatgaccttcgtaagctgctcagtgcacttgtcatttcggaaggtagcgtcagattcgatatataatgtctttgaaggactatctgagacagtcaatttctaaagatttggaggtgagacatcgagattctttaaagattagattaggggagcgactcggaccgatg

SEQ ID NO: 3439 - DNA, 203 bp, Homo sapiens
ggcgcgccagtcctggaagaaaggagtttgcatttggtgattgatgagacggaatatatagaagaagaaatacctttggccttgattgtgactccggtggcaccgaatccggaatttacttgtcgtgttataacagacatatgcaatctgtgggaaaataatatttgcaagcagaccagtttacaagtcgactcggaccgatg

SEQ ID NO: 3440 - DNA, 203 bp, Homo sapiens
ggcgcgccagtcctcatcgctgcgcgaaccagttttatcggctgcctgacgttttcaaaactcaccgccgagtcggcttgagaataaacggtgacattgtccggaaatcttacatcggacaaactctggccgaaccactctgagaacagagtatcgttctgaaacctgttctccatcacagagctggtcgactcggaccgatg

SEQ ID NO: 3441 - DNA, 203 bp, Homo sapiens
ggcgcgccagtcctaaaaaaaacgatattattgttgccgttgtcgtgtgatcatccatatcgttctttttgggtgtacattgtgacaagtttcttttgtgactatattatctttcattttttttttgcgagttgcaacttttgcttactaagttttgagtgctatttctctgtcgctgtgagcccgtacgactcggaccgatg

SEQ ID NO: 3442 - DNA, 203 bp, Homo sapiens
ggcgcgccagtcctgcgttgtggattgtttgacctttgaaaaaatttttgtgtccgtgtagcatttcaataaaagtcattatctgctcagagggataaatcatgtctatctcttcgttgttcggaggtagatacgataataagtttttgcttaacatgtcttcggctcccaaaatagagttgattgtacgactcggaccgatg

SEQ ID NO: 3443 - DNA, 203 bp, Homo sapiens
ggcgcgccagtcctaagctacaacaggtcaacgttcgagtagacgtaaattccatatgtcgaatgcgctgtaaactttttcacggaacatcaaaaacaccgaatttattcacgtttacataagcatgaatctgcaattttaatagtcccataaagctttcatttcgatctaactacattttagtatttcgactcggaccgatg

SEQ ID NO: 3444 - DNA, 203 bp, Homo sapiens
ggcgcgccagtcctccgtctcctgcaatttgaattctgctcgtttgtttttttctgcgacaaaaaaataaacgctgtctcagatatatacttacttgagtgatggagttattggaccacgacatttataagggacccgttcgagaacgggtcacgtataccattcccaaccatccctatctctcgctgcgactcggaccgatg

SEQ ID NO: 3445 - DNA, 203 bp, Homo sapiens
ggcgcgccagtcctatctattaagcttgaattttataaacatgttttccagaacaaaaatccaaacaagcaaatgctcataacgacgttgtccaccaagccatgaaattatccggactataccatgatgcggacgtcacacatagacaaccattgagtgagaatacgcatcaagatcccatatcttctcgactcggaccgatg

SEQ ID NO: 3446 - DNA, 203 bp, Homo sapiens
ggcgcgccagtcctgtgctggtgaagctgggcgattgtctactgacttttttgcgtgtgggatttgccagactttttgcggactgcggttatgagaagattggaaaaatatccatgcgcttcggacggatgtcgacgttgggcatgtcggagacttatcaatcgtgcatgagcctcagtaagtagttccgactcggaccgatg

SEQ ID NO: 3447 - DNA, 203 bp, Homo sapiens
ggcgcgccagtccttcgttattcgtaagtgggtacaatgaaaaaaaatcaacactgccttaatgtatgcaccctcaagagtgctgattggatagagatataatgatatataaaaaagtgcatgatgaacaaaaaagtttgtttttccataaatttaaatgtcagtgggtgccgcggttagggtctttccgactcggaccgatg

SEQ ID NO: 3448 - DNA, 203 bp, Homo sapiens
ggcgcgccagtcctagacggtgaaatgtaagtgtcgttctatctactcggggaaaatgtcaccacgggtaaacttgaatgattaatacaccattttctcgtgtgtgcgtgtatgtggatgtatacgcgtatagtatgcgtaataacacaggacatcgccggttaatctataacttgatatttgttcagcgactcggaccgatg

SEQ ID NO: 3449 - DNA, 203 bp, Homo sapiens
ggcgcgccagtcctgtgtgcgtgtatgtggatgtatacgcgtatagtatgcgtaataacacaggacatcgccggttaatctataacttgatatttgttcagtctgtttcaaaatgcaggccagaaattttgtcgacctttcacggacaatagaacaattgtatatactatgcaagaccaagttcaaagcgactcggaccgatg

SEQ ID NO: 3450 - DNA, 203 bp, Homo sapiens
ggcgcgccagtccttggccctaccgctacccctctttcaacccctcaccatcacccaacccgctgccccacccacatcccccccaccgccaccgctaccgtcacctctgaacttcacctttttcctccatctcgccccacttctctctacatttctccgcccctctattcttactcctgttttctaggcgactcggaccgatg

SEQ ID NO: 3451 - DNA, 203 bp, Homo sapiens
ggcgcgccagtcctcacctctgaacttcacctttttcctccatctcgccccacttctctctacatttctccgcccctctattcttactcctgttttctaggatgccgctgacggcgcgtgccggccacaccctgcatcgtcttccgctctcccactattggtggcttctgttgggtcgacactcccttcgactcggaccgatg

SEQ ID NO: 3452 - DNA, 203 bp, Homo sapiens
ggcgcgccagtcctagtttagtgatgcactgccacttctcatcaaaattgtccataaatttcaagtttttcaccatgtcagcaatctgatcggctctgacgtaggtggaaggatacttgtaagtttcatactcataatctatcagtctgttccacactacgcagtccgaagagggatgtagtcctttacgactcggaccgatg

SEQ ID NO: 3453 - DNA, 203 bp, Homo sapiens
ggcgcgccagtccttaggtggaaggatacttgtaagtttcatactcataatctatcagtctgttccacactacgcagtccgaagagggatgtagtcctttaatgccaaatctagctgctgcggttccctgcagaccgttcgtcaacctagcgcaggagacgggaacgacaaacctgctggtagcgggccgactcggaccgatg

SEQ ID NO: 3454 - DNA, 203 bp, Homo sapiens
ggcgcgccagtcctcggatagcaggagtcggtcgatcgtctcgctccgcttggttttccgtgtcacggcgcgcgcatagactccgttaatctcggcggccgatgtctcgcgtgttctcgtgcgtgctccgcgcgtgtgtatgtgccggcctctgctgctgggtgtgtatgggggtgatatgcggtgaccgactcggaccgatg

SEQ ID NO: 3455 - DNA, 203 bp, Homo sapiens
ggcgcgccagtccttcatgacaaggatctcgaaatataaaaccaaaaaaaaagtgaggagtgcgtaatcgcaagaaaagaaaaaacagagccgcggtggaaatgtctatccgcctgcgtgtatgtgtggggtgtgtatatgtgcgcgtgaccgtatccctccctgcctttaacccgatgagaaataaacgactcggaccgatg

SEQ ID NO: 3456 - DNA, 203 bp, Homo sapiens
ggcgcgccagtcctaggaagattttcataattccgaggaaatgaaggtgtttgttgtccaacattcgcaggaaatcgttggtggaacggatttttctgtacatgcggaggaaagcgtgtgagtcaaaacgggggttgaaatttaataaagtttgtcacaccactctcttttttccaatttcctgtcatcgactcggaccgatg

SEQ ID NO: 3457 - DNA, 203 bp, Homo sapiens
ggcgcgccagtcctgatctcgctgaagccgtcttgtatgtgactatttccatctgtttttagtggcgcttcgagttcgttttttctgaagtggatctgccgatggctgttagaaagttatggaagacagtcgtacagctgttttctaaatcgaaatccgaggagtgcaatacagaagccggaacgatgcgactcggaccgatg

SEQ ID NO: 3458 - DNA, 203 bp, Homo sapiens
ggcgcgccagtcctgaaaatttgtaagacgctgaactttgtctcgatctagccacgcaaacgggatcgactgcgctttcaaatccatcttttagaaaacaaactcaaaaacaaaactgctcgtcttcgccaagactcaatgtttaatagtcctttttttacccacacagaaagctgacaagcgacgagcgactcggaccgatg

SEQ ID NO: 3459 - DNA, 203 bp, Homo sapiens
ggcgcgccagtcctactcaaaaacaaaactgctcgtcttcgccaagactcaatgtttaatagtcctttttttacccacacagaaagctgacaagcgacgagatggacactgtcattgagctgtccaaactcctggtaagtctccagagatcattgttaccgaatattttattgtagcgtaccatgacacgactcggaccgatg

SEQ ID NO: 3460 - DNA, 203 bp, Homo sapiens
ggcgcgccagtcctaattcttaaagcgtgtgattcagtatctgtttttataatacggagagctgccgagctgagcggaacagagctttggctgtgacgaggatggatgtgtggaagcgtcaacggcttcaagaatgccgtgaactgtgtcctttgcctgcattaatgtcactgtcgaatatcttgtcacgactcggaccgatg

SEQ ID NO: 3461 - DNA, 203 bp, Homo sapiens
ggcgcgccagtcctagtttcaaatttgtttctattgtattccacagagatgcggcagattttttggaagaaattgcaaacgatctgtgaattctaaatatcatgaagaagttaactatggagtccttgttagtttatacctttgtaatgggagtctgctttacatcgaatctcacatgcgagcaaaaacgactcggaccgatg

SEQ ID NO: 3462 - DNA, 203 bp, Homo sapiens
ggcgcgccagtcctgtaatgtttcctttccgagcggtgtgcagttacaattactaaatcaatcggtgatggagtcaattagaactaaaacgtatgtagtggattacgctaggaaaactacagagagaggtgattgcttcatttctgtagcattctgccgaaaagaaagaagacgctttttaccccgctcgactcggaccgatg

SEQ ID NO: 3463 - DNA, 203 bp, Homo sapiens
ggcgcgccagtccttgggatgaagagaataaaccggatgtgcaaatcaggagggatgcaaagacttgcagatgaggctcccatagattgttactagtgattatggtgcctcagggttggagtttagcatgggtgagtgtattatacgtgtcggtgataccgtctttgcatattattaacaatgaaaatcgactcggaccgatg

SEQ ID NO: 3464 - DNA, 203 bp, Homo sapiens
ggcgcgccagtcctactctattccccattcctagaagtgccgaggaactctgggaaggaacatacactctcgtagtcgcatttgtgctcgcatttctcgtctactccgattatcttagtaatttaagtccgtttggagaaattttgtcctcgccgtgtatttcaacgtgaatcttcgtcgggaagaggcgactcggaccgatg

SEQ ID NO: 3465 - DNA, 203 bp, Homo sapiens
ggcgcgccagtcctgaacgaagacggaagtgcgttggcatcaaaacaggaaacgcaatataaaataaccaactacatggttcccactaaaaacgggactgcgggctctagcttatttaatgagaaagaagatagcgagagcgacgattccatgcattttgaatacagctccaatcctaagagacagagcgactcggaccgatg

SEQ ID NO: 3466 - DNA, 203 bp, Homo sapiens
ggcgcgccagtcctctatcggctgccagggataaaatctcgatttttgccgtagcggctagtaatgattctggggacgtgctgtttttgagtgaactaagaatgaactctaaatcgagtgcacgagctgccattgtggatactgtggaagctgtgaagaagagaaaatatatatctatcgaggcgggacgactcggaccgatg

SEQ ID NO: 3467 - DNA, 203 bp, Homo sapiens
ggcgcgccagtcctggttcccagtctggctctaggaaaatctcttttaataccgtaagcccgtgaatgttttctttgttagcgtcatagacatttccttgcatgacgcatgacaacagacaactgctgccgcaagaaactaagctcgtcacaccaaacaaagacactttgtcttccaggtacttacaccgactcggaccgatg

SEQ ID NO: 3468 - DNA, 203 bp, Homo sapiens
ggcgcgccagtcctctgtgcatctctacaacgtgaccgtcaagaagttgttacggcttgtttcacacggttctgattttcagtgtcagcattgtcagcattcgtttagagagacttgcttagatctggaagactgtgttaatatctgtcaaggttgtcagatttcccaaaacgtgaggtgtatttgaacgactcggaccgatg

SEQ ID NO: 3469 - DNA, 203 bp, Homo sapiens
ggcgcgccagtcctcgtttagagagacttgcttagatctggaagactgtgttaatatctgtcaaggttgtcagatttcccaaaacgtgaggtgtatttgaaatgacgaccatacgtggtgatgatttgtcgaatcagatcactcagatttcaggaagttcttcaaaaaaagaggaggaaaagaagaagcgactcggaccgatg

SEQ ID NO: 3470 - DNA, 203 bp, Homo sapiens
ggcgcgccagtcctccggtgtgaagttttcgagactaagtgaaaggcattgtcgggttgcgattgtcagcatctgctttcttttagccttgtatttttgttatgttctacttaaaaaaactcctacgccagcttctggccccgttgtgtaaacatgggccgtacactcatttgcaattgtttgtgatgcgactcggaccgatg

SEQ ID NO: 3471 - DNA, 203 bp, Homo sapiens
ggcgcgccagtccttaaaacacgacctcaaactcccttccctgctcacagacttgctcatacaaaagttcaagattcgtcttttcaggtgaggagtccatcatgtacaaaggatgggactcagaagcgttgtctatacaatctgagatagtaaacgagattctgttatattgctacctcactccccaacgactcggaccgatg

SEQ ID NO: 3472 - DNA, 203 bp, Homo sapiens
ggcgcgccagtcctgtcttctgagtctcatgcctcaaaacctagtttgatagacaggatcaggtatagaggttataagagtgtaaatgtagaagaagcgtgatggattcggtgtcattttttaatccatatttggaagcgaatcgcttaaagaaaaaaagcagatcgagttacattcgtatacttcctcgactcggaccgatg

SEQ ID NO: 3473 - DNA, 203 bp, Homo sapiens
ggcgcgccagtcctatcaagcaagcggtgtattaaaatgtgatgaaacggaaaccgaaacggatgagccgatgactaagaaaaaccgattataatcagagtatgaattcgttacaatctctgtgtgtgttgtgcgctaggcttaatgaatgtgctttggaccttgaatgtttaaagttttgtgatcctcgactcggaccgatg

SEQ ID NO: 3474 - DNA, 203 bp, Homo sapiens
ggcgcgccagtcctaatcgtcgaaaacaatttcccataacaccccaataccctaagggcatttaaagccaaattcatctgtaatcaacagagctctacacaatgaccatcgtagtgtttgcgactgaatacgatgccgcaaacgtcatttttagtatcctatgtagaagtcccagtgaacatttaatccgactcggaccgatg

SEQ ID NO: 3475 - DNA, 203 bp, Homo sapiens
ggcgcgccagtcctgatgtccacgtttcgaaagacgaaaaattcaatgtatcttgagctcgtttgtctctgtagggtaatcgtttcagagatcttttctgaaattacgctgtacatttttccaggtgacagagggctgtctgctgttaatcacgtcgacgcgaagactagttcaaaataacacttaagcgactcggaccgatg

SEQ ID NO: 3476 - DNA, 203 bp, Homo sapiens
ggcgcgccagtcctccgattagcgcccgataaattactagtaagaacattaagatagccagggcattcacaatcgcagtccagcacagcatgcatttggaggtcatcgtccaaccctataaaaaaagcaaatactattttagttacacattctccttgtaaaaattcactgtggtcaactcacccgaccgactcggaccgatg

SEQ ID NO: 3477 - DNA, 203 bp, Homo sapiens
ggcgcgccagtccttaatctatttaatatggaaagatcaaaaagtgttcaactttcaaagaatagcagaaccctttcacatttcatcgatgaagaacaactatgctcttccgactctgggtctttgttctgttgactccctgttacagttggagaccgtggaccatatcggacgagagccattgtaaacgactcggaccgatg

SEQ ID NO: 3478 - DNA, 203 bp, Homo sapiens
ggcgcgccagtcctctatttcgttcttggatcaatatttaattgcagacgaggttttgtggaacgttgttcccgtaatttgttttttcaggcagtggggactcaagttagatttttttaaaaagttttcggggaagaccaagcggttgtcattttcgtttatatgtgatttgttcgctaggtctcaggcgactcggaccgatg

SEQ ID NO: 3479 - DNA, 203 bp, Homo sapiens
ggcgcgccagtcctggacacgttgcgcgacggagatgcgggagttgacacttcgtgatcccgccctcgtctgttgctgtagttgatgctgttgctgttgttgtagtggtcgttttcgtggttgtctttgtcctatgttaacattgtgagaacagcgcataaataaaatggtttttttgtgtgtattttcgactcggaccgatg

SEQ ID NO: 3480 - DNA, 203 bp, Homo sapiens
ggcgcgccagtcctgtagtggtcgttttcgtggttgtctttgtcctatgttaacattgtgagaacagcgcataaataaaatggtttttttgtgtgtattttatgtgtgtatttttttgtgtgtgtatttttttgtgtgtgtatttttttgtgtgtatttttttgtgtgtatttttttgtgtgtgtattcgactcggaccgatg

SEQ ID NO: 3481 - DNA, 203 bp, Homo sapiens
ggcgcgccagtcctatgttttaatgtcattgaaaatatttagaggtgcttcgattttaggtaaaatttcggtcgcctgccaattttccatgtttcggcgttatgcagcacaccggtaattgtgaaactttaatagttaattcatgttttggttccacttgtgcacggtcgattccagtttttatagatcgactcggaccgatg

SEQ ID NO: 3482 - DNA, 203 bp, Homo sapiens
ggcgcgccagtcctaaatacacacaaaaaaatacacacacaaaaaaatacacacacaaaaaaatacacacataaaatacacacaaaaaaaccattttatttatgcgctgttctcacaatgttaacataggacaaagacaaccacgaaaacgaccactacaacaacagcaacagcatcaactacagcaacgactcggaccgatg

SEQ ID NO: 3483 - DNA, 203 bp, Homo sapiens
ggcgcgccagtccttatacccacgttttagtgggtgggacttaaaagaaatgggtggagggatataggggtgtgtcttcgttggtaccaattataaaaatgtactcgccacaactcacaatttagaacgcatggcagttctgctacgtgtttggatgcccggacattagaatacagccagttgttacccgactcggaccgatg

SEQ ID NO: 3484 - DNA, 203 bp, Homo sapiens
ggcgcgccagtcctttatcattaagaatatttacacggtgacgacacggggaggaaatatgcggtcgaggggggggcacaacacgttttaagtactgttggaactccctcaccaaccgcaatcgcaatcctttgaaggctgcgagagcgtttggaaaactcgggtacgtctaaattcaccccagtgcgcgactcggaccgatg

SEQ ID NO: 3485 - DNA, 203 bp, Homo sapiens
ggcgcgccagtcctaactccctcaccaaccgcaatcgcaatcctttgaaggctgcgagagcgtttggaaaactcgggtacgtctaaattcaccccagtgcgatggatacgccgccgatgcagcgctctacaccccaacgcgcggggtcgcctgatactttggagttaatggacctgttggacgcggcccgactcggaccgatg

SEQ ID NO: 3486 - DNA, 203 bp, Homo sapiens
ggcgcgccagtcctaaggggcaggcgtgtataagagggcccctgtttaatacgcggtctgccgtgtttggatatttcacgaccctatcgtttatttacgtaatggcatcttccgacggtgacagactttgtcgctctaatgcagtgcgtcgtaaaacaacgcctagttattccggacaatatcgaacccgactcggaccgatg

SEQ ID NO: 3487 - DNA, 203 bp, Homo sapiens
ggcgcgccagtcctcaacccaatcgaaggtctcccgccccggaatcccccattgccattttacccaagtagccttattcatagatgtaaacgtttgggtgtgtgttttgttgtgcagggttcgtccgattcataacgcgacagcgtcgagtcggttttaagggaaaaggttactacggccccaaggaccgactcggaccgatg

SEQ ID NO: 3488 - DNA, 203 bp, Homo sapiens
ggcgcgccagtcctgtgttttgttgtgcagggttcgtccgattcataacgcgacagcgtcgagtcggttttaagggaaaaggttactacggccccaaggacatgttttgcacctcaccggctacgcggggcgactcgtccgagtcaaaacccggggcatcggttgatgttaacggaaagatggaatatcgactcggaccgatg

SEQ ID NO: 3489 - DNA, 203 bp, Homo sapiens
ggcgcgccagtcctgatataccgcccccccatggcgtgtagtctttataaataaatacaatggtttggctcgtgtctttttttgatgtctgtctgtgggggagtggggtgttgtggatattagagggtagagggtgctggtttgaacgtctccattaacccacggggtccccacacgggccgtgtggtcgactcggaccgatg

SEQ ID NO: 3490 - DNA, 203 bp, Homo sapiens
ggcgcgccagtcctataaataacataaccaatagaaacttaatacagagtcacgccccattacaacaaggataaaacacgggatcattttcttaacattgtagtagcgctgaaaagcgtcccctcccccggctcacagagctgctcttcggtgtagttgggtatactggtgcgcctcatttaatcgcgcgactcggaccgatg

SEQ ID NO: 3491 - DNA, 203 bp, Homo sapiens
ggcgcgccagtcctctggtatacacgagagcagtccatggttttagacctcgggcgaattgcgtggttttaagtgactatattccgagggtcgcctgtaatatggggacagttaataaacctgtggtgggggtattgatggggttcggaattatcacgggaacgttgcgtataacgaatccggtcagacgactcggaccgatg

SEQ ID NO: 3492 - DNA, 203 bp, Homo sapiens
ggcgcgccagtcctaaaatattaagggttgtgatttttttcattaggatgaaaagaacgtttcctagccacacccacaaaggagtttgtaaaataaaatctctgtttagaccttaaaatttgttgtgtgtgttgtgtggggggtccgtgaggatcgacctttacaagatataatttgtccatatcgcacgactcggaccgatg

SEQ ID NO: 3493 - DNA, 203 bp, Homo sapiens
ggcgcgccagtcctggatgggattttttgccgggaaacccccccccgccagcctttaacaaaacccgcgccttttgcgtccacccctcgtttactgctcggatggcgaccgtgcactactcccgccgacctgggaccccgccggtcaccctcacgtcgtcccccagcatggatgacgttgcgaccccccgactcggaccgatg

SEQ ID NO: 3494 - DNA, 203 bp, Homo sapiens
ggcgcgccagtcctcggatcgggttaaacaaacatattaacgaaactcgtgtgtttacatatgattactttttctatagtaaacattttaagtagtaaattatggatttgaggtcgcgtacagacgatgctttggacatggaattgcatgcgggttttgacgccccagaaatcgccagagctgttttacgactcggaccgatg

SEQ ID NO: 3495 - DNA, 203 bp, Homo sapiens
ggcgcgccagtccttgtaattaacacaagatcacatcgaagaattactgaagccgctgtgaaacctttcacaagacgatataaacttggttaagtgtattgatggggctctttggactgacacgctttatccatgaacataaactggttaaacccagcatcatttcaacgccacccggagttttaacccgactcggaccgatg

SEQ ID NO: 3496 - DNA, 203 bp, Homo sapiens
ggcgcgccagtcctgcggggttgggtgagcctataaattctacaacattggcggaagatacaggcaactgcaaacacgcaattgtcagatattttgcagccatggcctctgcttcaattccaaccgacccagacgtgtctactatttgtgaagactttatgaatttgctaccagacgaaccttcggatcgactcggaccgatg

SEQ ID NO: 3497 - DNA, 203 bp, Homo sapiens
ggcgcgccagtccttttgtggtttttattgactgggcgtttcgtttgtataacgctgttgttgctagtattttcataacctcctaggtttttggagctacacgtgcttattcaacgctctttgggatttgaatcatcgtaaacgtagcgtccctaccagttgagcgcgtaattttcgtaagcaataaacgactcggaccgatg

SEQ ID NO: 3498 - DNA, 203 bp, Homo sapiens
ggcgcgccagtcctgaagtacctaattatccaaatttaacttcgagttaacaccaaccgtgtgatactacatcgtgcttgaattgccatcttccacgggtcatgcaggctttaggaatcaagacagaacattttataattatgtgtctacttagcggacatgctgtttttaccctatggtataccgctcgactcggaccgatg

SEQ ID NO: 3499 - DNA, 203 bp, Homo sapiens
ggcgcgccagtcctgtcatggccaaatttctagatttgcatgaaatattgaaggatgcttaatacatggggaaaataaacgcattaataagtcgtcagggggtggatcactccaaactcctcctatatcccacgataaatggtctaaatacttcacgcgtgtgccttggtttgcaaccttagatcaatcgactcggaccgatg

SEQ ID NO: 3500 - DNA, 203 bp, Homo sapiens
ggcgcgccagtcctataatccattcacagcggttaaagcctcttggaggcggagcagggcggctccttgggggtgcgtgtttacacgcacctcttcataagatggctcttcagttggtattcgagcatatccacataagctggcacacaccgtctgcatgattgactggctttccaacgtattgaactcgactcggaccgatg

SEQ ID NO: 3501 - DNA, 203 bp, Homo sapiens
ggcgcgccagtcctccgagaatgtaacgggggtgtaaatagccagggggtttgttttaatttattaataaaaatgtgtattacgttactcatgtgtctccattacgcatcacagggggtatttatacccgataatatacaaaacgcgttttgtacctctaccgcacccgatatcttaacggggttattcgactcggaccgatg

SEQ ID NO: 3502 - DNA, 203 bp, Homo sapiens
ggcgcgccagtcctgcgttgggtgttggggaatcaaatgaagattgtgaaaagactgttccgcatttaaaggttacgcagttgtgtaggaacgacagcgatatggcttctgtagcaggtaacgctagtaatatctcaccacagcccccgtcgggcgttccaaccggaggggaatttgtactgatacctcgactcggaccgatg

SEQ ID NO: 3503 - DNA, 203 bp, Homo sapiens
ggcgcgccagtccttcttctatattttgtctgtttgggtgtcattcctcagtttgcctccacaccgtgagtattcactatcgggtccgtggggtgtttataatggctgctgaagctgacgaagagaactgtgaagcgttatacgtggctgggtatttagccttatattcaaaggacgaaggggaattacgactcggaccgatg

SEQ ID NO: 3504 - DNA, 203 bp, Homo sapiens
ggcgcgccagtcctgggatgttttcccatgggtaagaaaacagcttttaaagcagtaccggtttatattcacgccagttgactttgtttgctgcagacaccatgacggcgagatatgggttcggatctatctcgtttccgaataaatgtgggatatttttgtctaccactaagaactttatagccccccgactcggaccgatg

SEQ ID NO: 3505 - DNA, 203 bp, Homo sapiens
ggcgcgccagtcctttggtgttattgcaaagtggtgtaaaaattcttcggcggcggttgtttttccaattccatacgccccgtccaaataaatacgcaaaacgcccatttttacatcggttttatccgttgacatgtttattgtagacaaacgcgtcttaggttatcttctgggacggaacttcaaatcgactcggaccgatg

SEQ ID NO: 3506 - DNA, 203 bp, Homo sapiens
ggcgcgccagtccttgaacgcgtccgcgaaacctcgacgtacgttatcaatatcctttttgagtacatcgtaaaaacgagtgtggcaacgttgtcccaaacgaaaacacttggcccgaattcgactagcggacatatttgaagttccgtcccagaagataacctaagacgcgtttgtctacaataaaccgactcggaccgatg

SEQ ID NO: 3507 - DNA, 203 bp, Homo sapiens
ggcgcgccagtcctgaaaacacttggcccgaattcgactagcggacatatttgaagttccgtcccagaagataacctaagacgcgtttgtctacaataaacatgtcaacggataaaaccgatgtaaaaatgggcgttttgcgtatttatttggacggggcgtatggaattggaaaaacaaccgccgcccgactcggaccgatg

SEQ ID NO: 3508 - DNA, 203 bp, Homo sapiens
ggcgcgccagtccttctcatattcggtgtggacctaaggttggcgatcacacgatcacgggacggcaagttcgaggttaatgttccgataaacgctttaatatggaatttccatatcattcaaccgtatcttataacggcgtaacgttttattttaacgagcgtgctaccagggcgtattttatatgccgactcggaccgatg

SEQ ID NO: 3509 - DNA, 203 bp, Homo sapiens
ggcgcgccagtccttttactttggactataaactgcgactgaacgttatgaacccaccccaagcccgcgtctcggaacagacaaaggacttgcttagcgttatggttaaccagcaccccgaagaggacgcaaaagtgtgtaaatccagtgataattcaccgctttataacaccatggttatgttatcgcgactcggaccgatg

SEQ ID NO: 3510 - DNA, 203 bp, Homo sapiens
ggcgcgccagtccttaaatgtactataattgttcagtctaaaaataatgttgggtatttataattaccgcccccgtgttacttggaaacacccatacatatgttccactctacatcaaacttctcgcagttttcttgttcccgcacacgtttacacgtccggattcaagtcgcaacgctgctgacaaacgactcggaccgatg

SEQ ID NO: 3511 - DNA, 203 bp, Homo sapiens
ggcgcgccagtcctccaatatctgattcgagacgcgtcgccccttaggggatgtcttcctcttccgcgataatttcaccacgcccacatacccactcccaataaaagccctgtagagcgcattggcatcttacttgagatttggatacgctcggccgacttggtctgtttcacgcttccttaaacaaccgactcggaccgatg

SEQ ID NO: 3512 - DNA, 203 bp, Homo sapiens
ggcgcgccagtccttgacacggttacgcctatgagaagcgtaggttggagtgtggcctgacatgaccaaagtgaatgaatgcggccctgaaaatgtttatgatatatacgtaacgagtacgtaagatgacgcggcttcctgttttactgcttacaagagatgaggcggattccgtgaattgatgttaacgactcggaccgatg

SEQ ID NO: 3513 - DNA, 203 bp, Homo sapiens
ggcgcgccagtccttgtatccttaaataccacgtacgtaaaaaatgtttgaatacgtacatatttcttttttttttccagtacaaccatatccggtgtataatggaagcccatttggcaaatgaaaccaaacatgcactttggcataatgatcacacaaaaggattactacacgttgtgatacctaaccgactcggaccgatg

SEQ ID NO: 3514 - DNA, 203 bp, Homo sapiens
ggcgcgccagtcctaacccccataaataaattagtgtcactataaaaacataacaccagaatctcttcatatgtaattttacgtcatttctcccgtttccaccccctcttaaaatataaaataaccgggtgggtggcattaaacccacaagtacccgggcggcaatccgctagactgtttttctgctccgactcggaccgatg

SEQ ID NO: 3515 - DNA, 203 bp, Homo sapiens
ggcgcgccagtcctatcttacagattcttcaccaagcgtacgaccaaacattatcaatgacatttaacatcaattcacggaatccgcctcatctcttgtaagcagtaaaacaggaagccgcgtcatcttacgtactcgttacgtatatatcataaacattttcagggccgcattcattcactttggtccgactcggaccgatg

SEQ ID NO: 3516 - DNA, 203 bp, Homo sapiens
ggcgcgccagtcctgcctatcgaagttgatgtgcctagagtgacacaaatacttaaagacacaggaaacaacgcgattacatcagcattgcggtcattgcgatgggacaatcttcatccagcggtcgaggaggaatctgtggattgtgcaaacggtacaacgagcttgttacgtgcaacggagaaacccgactcggaccgatg

SEQ ID NO: 3517 - DNA, 203 bp, Homo sapiens
ggcgcgccagtcctgtttgtgacataccaggttttattagttttactggaacatccaattgcagttccaggctaattcccgggtgggtgtgtttaatccacgaaaccagatcccctccatataacgcccgcgcgagctgtgtactggacgcatagacggcggcgttgctctccccggtgttgggagaccgactcggaccgatg

SEQ ID NO: 3518 - DNA, 203 bp, Homo sapiens
ggcgcgccagtcctgaaaccagatcccctccatataacgcccgcgcgagctgtgtactggacgcatagacggcggcgttgctctccccggtgttgggagacatgggaactcaaaagaaggggccgcgttctgaaaaagtctcgccgtacgacaccacgacacccgaggtggaagcgttagatcatcaacgactcggaccgatg

SEQ ID NO: 3519 - DNA, 203 bp, Homo sapiens
ggcgcgccagtcctatttgatgatctaacgcttccacctcgggtgtcgtggtgtcgtacggcgagactttttcagaacgcggccccttcttttgagttcccatgtctcccaacaccggggagagcaacgccgccgtctatgcgtccagtacacagctcgcgcgggcgttatatggaggggatctggttcgactcggaccgatg

SEQ ID NO: 3520 - DNA, 203 bp, Homo sapiens
ggcgcgccagtcctagcgctatcggaactgtccccgggatcgtggccgcggataaacggggcggtaaattttgaaagtttataacccgttaataccatatatggacatccatagggggggttacataaatactaagcctctgtacaacacaaagggcctctaacaatgcactgaaccacaaccaagctcgactcggaccgatg

SEQ ID NO: 3521 - DNA, 203 bp, Homo sapiens
ggcgcgccagtcctaaatgaatctaaaccctctacgggaacgatatgaaaaatccgcagaaattagcgatcacattcttgccgctctacgtgatcccaacgtacacgttgtgtattaaagcattgtataaaaacacgcatgcgggcttgctgttctcatttctaggttttgtcttaaatacacccgcccgactcggaccgatg

SEQ ID NO: 3522 - DNA, 203 bp, Homo sapiens
ggcgcgccagtcctgaattcaagatgtcatctggtgctaacacacgcgcatccgtcgccattgtcccgtgttccatttcggaattgtcgacatttcgttcaagccaatgagtattttacgcgtaaaggcgaacccgagatcgattggagtgttatataacactccaatcgaccctcttgcgtaccatacgactcggaccgatg

SEQ ID NO: 3523 - DNA, 203 bp, Homo sapiens
ggcgcgccagtcctcagggcaggtggacgaactgggattatattatgtgcacgatggtgtacgtgttaactatgtggactttggaacagagtccttgacctatggggtcaccgggacgtgggaggtgcacgtggctgggactgttattcaccatacatccgcatctgtgtctagcacccaggccagcgcgactcggaccgatg

SEQ ID NO: 3524 - DNA, 203 bp, Homo sapiens
ggcgcgccagtcctataaccatcaactgacagaaccagatgtgcaggcctacggggtggtaactacctgctgtaagtgtggcagaaccgtccggctggtggttgagtgcggacaagcagacctaagagagctggaacagctgttcttgaagacgctgactctagtgtgccctcactgcgcctagcgttcgactcggaccgatg

SEQ ID NO: 3525 - DNA, 203 bp, Homo sapiens
ggcgcgccagtcctcgccctttcgtgttatttcttgtaacgaattcgttacaaaacacacacacagtatataagatagaggaacggattggtacaccacagatggcatcaacaagcggtgtgggatccgtcgggcctgcaagctgttgcgagacgcagaagccacataccatacgggagttgtgtttgcgactcggaccgatg

SEQ ID NO: 3526 - DNA, 203 bp, Homo sapiens
ggcgcgccagtcctattgatggttatacatggaactctttttttaggaaattttggcgtcacctaaatctaaaagaccctgaggatgagtcagatggagagactcctggaacgattagactatatacaagagcagatactgacactatatgagaaagatagtgttgacctagaggatcatataaggctcgactcggaccgatg

SEQ ID NO: 3527 - DNA, 203 bp, Homo sapiens
ggcgcgccagtcctactttcacatggacggagtctgacgggacagaacggtgtgggtcggggcgctttttttgtgctttctctaatgaaacaaaaagagaaaagttcctcaaatctgtcaagattcctaaaaacattgggctgtttcgcgcacacgcagaaaagctgtgacctgtgtatcattaaacacgactcggaccgatg

SEQ ID NO: 3528 - DNA, 203 bp, Homo sapiens
ggcgcgccagtcctaagttcctcaaatctgtcaagattcctaaaaacattgggctgtttcgcgcacacgcagaaaagctgtgacctgtgtatcattaaacaatgcttgctaggcaaagggttaaacgcgctaatcctgaacaactgtataagacatgcaaagcaacggggggcgattgtccacccgatcgactcggaccgatg

SEQ ID NO: 3529 - DNA, 203 bp, Homo sapiens
ggcgcgccagtcctaagacataggactaaccgctttgggggacaacattgaaaatgaattgcaggaaatagatttattaactgcggatggtgaagaagaccaggagggcagagacctgcagttggtattttccactggcaatgatgaggtggttgatattatgactatacctatacgtgcaggcggggcgactcggaccgatg

SEQ ID NO: 3530 - DNA, 203 bp, Homo sapiens
ggcgcgccagtcctggattatgatatacatcctagcctgttgcgcaggaaacgtaaaaaacgcaaacgtgtttatttttcagatggccgtgtggcttccaggcccaaatagattttacttaccccctcaacctatacaacggacattgaacacagaggaatacgtgagacgcaccagtactttcctcccgactcggaccgatg

SEQ ID NO: 3531 - DNA, 203 bp, Homo sapiens
ggcgcgccagtcctatctgtggaaaaggattacatattgcgggaagacttgtctgtgcatagaattggcgggatctggaggggaacttgtgttcgatgtatggtaggactgtattagctgtgagactaatatactgtttgctgtattgtattgctgtaatcgtgcgtaaattgctataccctgtaatacgactcggaccgatg

SEQ ID NO: 3532 - DNA, 203 bp, Homo sapiens
ggcgcgccagtccttgcagcaagtccccacacccaggagaacattatacctggtagagagtcagtgtccattttgccaggctatcatacgatttgtatgcgtagcaagcaacactgggatacggaatctacaggcactcctggtcaacagtcaccttgacctcgcttgtcacgcctgtgtcgagcagacgactcggaccgatg

SEQ ID NO: 3533 - DNA, 203 bp, Homo sapiens
ggcgcgccagtccttagcaagcaacactgggatacggaatctacaggcactcctggtcaacagtcaccttgacctcgcttgtcacgcctgtgtcgagcagaatggcgtccagggtctcagacaccggcaatggcaatgaaaacaaagagaatgaaggtacagtggcatctgatcattctgaggcgcgtcgactcggaccgatg

SEQ ID NO: 3534 - DNA, 203 bp, Homo sapiens
ggcgcgccagtcctattatacctggtagagagtcagtgtccattttgccaggctatcatacgatttgtatgcgtagcaagcaacactgggatacggaatctacaggcactcctggtcaacagtcaccttgacctcgcttgtcacgcctgtgtcgagcagaatggcgtccagggtctcagacaccggcacgactcggaccgatg

SEQ ID NO: 3535 - DNA, 203 bp, Homo sapiens
ggcgcgccagtcctacaggcactcctggtcaacagtcaccttgacctcgcttgtcacgcctgtgtcgagcagaatggcgtccagggtctcagacaccggcaatggcaatgaaaacaaagagaatgaaggtacagtggcatctgatcattctgaggcgcgttgtagctatatattatttgaggctgaatcgactcggaccgatg

SEQ ID NO: 3536 - DNA, 203 bp, Homo sapiens
ggcgcgccagtcctgttaataacaatcttggtttaaaaaataggagggaccgaaaacggttcaaccgaaaacggttgtatataaaccagccctaaaatttagcaaacgaggcattatggaaagtgcaaatgcctccacgtctgcaacgaccatagaccagttgtgcaagacgtttaatctatctatgccgactcggaccgatg

SEQ ID NO: 3537 - DNA, 203 bp, Homo sapiens
ggcgcgccagtcctgccattgtaactgtaacatatgatagtgaggaacaaaggcaacagtttttagatgttgtaaaaataccccctaccattagccacaaactgggatttatgtcactgcacctattgtaatttgtatatatgtaaatgtgtaaatatatggtattggtgtaatacaactgtacatgtcgactcggaccgatg

SEQ ID NO: 3538 - DNA, 203 bp, Homo sapiens
ggcgcgccagtcctaacccccttgcaatttttcctactaactctacttgtgtgttactgtcccgcattgtatatacactactatattgttaccacacagcaatgatgctaacatgtcaatttaatgatggagatacctggctgggtttgtggttgttatgtgcctttattgtagggatgttggggttacgactcggaccgatg

SEQ ID NO: 3539 - DNA, 203 bp, Homo sapiens
ggcgcgccagtcctatgcattatactactgatggtgattatatatatatgaattagagtaaaccgttttttatatttgtaacagtgtatgctttgtataccatggcacatagtagggcccgacgacgcaagcgtgcgtcagctacacagctatatcaaacatgtaaactcactggaacatgccccccacgactcggaccgatg

SEQ ID NO: 3540 - DNA, 203 bp, Homo sapiens
ggcgcgccagtcctagaaaaggtaaaacatatactaaccaaggcgcggttcataaagctaaattgtacgtggaagggtcgctgcctacactgctggacaacatgcatggaagacatgttaccctaaaggatattgtattagacctgcaacctccagaccctgtagggttacattgctatgagcaattacgactcggaccgatg

SEQ ID NO: 3541 - DNA, 203 bp, Homo sapiens
ggcgcgccagtcctttttcattacaggttctggattttatttgcatcctgcatggtattttgcacgtaaacgccgtaaacgtattcccttatttttttcagatgtggcggcctagcgacagcacagtatatgtgcctcctcctaaccctgtatccaaagttgttgccacggatgcttatgttactcgccgactcggaccgatg

SEQ ID NO: 3542 - DNA, 203 bp, Homo sapiens
ggcgcgccagtcctagaaacagacatcagagaagtgcaacagcttctgttgggaacactaaacatagtgtgtcccatctgcgcaccgaagacctaacaacgatggcggacgattcaggtacagaaaatgaggggtctgggtgtacaggatggtttatggtagaagctatagtgcaacacccaacaggtcgactcggaccgatg

SEQ ID NO: 3543 - DNA, 203 bp, Homo sapiens
ggcgcgccagtcctcattattctagttacaacaagaacctaggagttatatgccagaagtaagcctataaaatacacaggtaagactctgcacaggaccagatggcgacaccaatcgggaccgtcagacagctttccgaaagcctctgtatcccatatattgatgttttattgccttgtaatttttgtcgactcggaccgatg

SEQ ID NO: 3544 - DNA, 203 bp, Homo sapiens
ggcgcgccagtcctttgattttgcttggacgtgtgtacatagtccctgtatatattcccctcctacccccacataccttgaagcttgcaacattgtaacaaatgtatcgcctacgtagaaaacgcgctgcccccaaagatatatacccctcatgcaaaatatcaaacacctgcccacctgacattcaacgactcggaccgatg

SEQ ID NO: 3545 - DNA, 203 bp, Homo sapiens
ggcgcgccagtcctttacacctttggttattatagctcttaacaactcaacaggggattttgagttacatcctagtcttagaaagcgtcgtaaaagagcttatgtataatgtttttcagatggctgtctggttaccagcgcagaataagttctatcttcctccccagcccatcactagaatcctgtcccgactcggaccgatg

SEQ ID NO: 3546 - DNA, 203 bp, Homo sapiens
ggcgcgccagtcctaggagttagtgtcgcctcagcaaccttatgctgtcgttgcttcctgtgcctattgcgagaaactggttcgattgaccgtcctcgcggatcacagcgccattagacagctggaggaactccttctgcgatctttgaacatcgtgtgcccactgtgcaccctacagcgacagtaaacgactcggaccgatg

SEQ ID NO: 3547 - DNA, 203 bp, Homo sapiens
ggcgcgccagtcctatcacagcgccattagacagctggaggaactccttctgcgatctttgaacatcgtgtgcccactgtgcaccctacagcgacagtaaaatggcagataataaaggtactgaaaacgattggtttttggtggaggcgacagattgtgaggaaacgttagaggaaacctcacttggtcgactcggaccgatg

SEQ ID NO: 3548 - DNA, 203 bp, Homo sapiens
ggcgcgccagtcctttgctggctactgtcgttagcgggcagagacaggatagacagggaggagagcgaaggaggccccaactcgaccacgaccagtgtgcctactgcaaagaaaagggacattgggctagagattgccccaagaagccaagaggaccccggggaccacgaccccaggcctccctcctgcgactcggaccgatg

SEQ ID NO: 3549 - DNA, 203 bp, Homo sapiens
ggcgcgccagtcctaaaccccaagaccaattcaggcaggttctggagtgcgtggcaatcagtcacaaacttacaagccagctgctggtcgcggaggaagaggcaatcaaaaccgaaaccaacgatcatccggtgctggtgactcacgcgcagttaatactgtaacacaaagtgccacgtcctccacagcgactcggaccgatg

SEQ ID NO: 3550 - DNA, 203 bp, Homo sapiens
ggcgcgccagtcctgcttgtgtttaaaaattgtcgcagcttccccaaaccaagtggtcttggttttctctttttattatattgtcaatatggcttgcaaacacggatacccagacgtgtgccctatttgcacagccgttgacgctactcccgactttgaatatttgctcatggcagacggagaatggtcgactcggaccgatg

SEQ ID NO: 3551 - DNA, 203 bp, Homo sapiens
ggcgcgccagtcctgaccggcagctcgacagcggagacaacccgtacctcaagtacaaccacgccgacgcggagtttcaggagcgccttaaagaagatacgtcttttgggggcaacctcggacgagcagtcttccaggcgaaaaagagggttcttgaacctctgggcctggttgaggaacctgttaagcgactcggaccgatg

SEQ ID NO: 3552 - DNA, 203 bp, Homo sapiens
ggcgcgccagtccttcttccaggcgaaaaagagggttcttgaacctctgggcctggttgaggaacctgttaagacggctccgggaaaaaagaggccggtagagcactctcctgtggagccagactcctcctcgggaaccggaaaggcgggccagcagcctgcaagaaaaagattgaattttggtcagacgactcggaccgatg

SEQ ID NO: 3553 - DNA, 203 bp, Homo sapiens
ggcgcgccagtcctccggtagagcactctcctgtggagccagactcctcctcgggaaccggaaaggcgggccagcagcctgcaagaaaaagattgaattttggtcagactggagacgcagactcagtacctgacccccagcctctcggacagccaccagcagccccctctggtctgggaactaatacgcgactcggaccgatg

SEQ ID NO: 3554 - DNA, 203 bp, Homo sapiens
ggcgcgccagtcctacaccatgtggtcacgctgggtatttaagcccgagtgagcacgcagggtctccattttgaagcgggaggtttgaacgcgcagccgccatgccggggttttacgagattgtgattaaggtccccagcgaccttgacgagcatctgcccggcatttctgacagctttgtgaactggcgactcggaccgatg

SEQ ID NO: 3555 - DNA, 203 bp, Homo sapiens
ggcgcgccagtcctgtgtcgcagacgcaggagcagaacaaagagaatcagaatcccaattctgatgcgccggtgatcagatcaaaaacttcagccaggtacatggagctggtcgggtggctcgtggacaaggggattacctcggagaagcagtggatccaggaggaccaggcctcatacatctccttccgactcggaccgatg

SEQ ID NO: 3556 - DNA, 203 bp, Homo sapiens
ggcgcgccagtcctctcagagagtcgttggaagacgggaaggaagcccaacgactgagcagtccaccccaggcgtgattctggtcgcccggtggatcaagcatggaagccgtcataaaggtgatttcgtccgcgtgtaaaacctattgcgggaaaacctctccttctaagaaggaaataggggccatgcgactcggaccgatg

SEQ ID NO: 3557 - DNA, 203 bp, Homo sapiens
ggcgcgccagtcctcatgaagggcacgagctgcttcccaaaggcccccatccaagtataggtctctacatcgtaggtgacaaagagacgctcggtgcgaggatgcgagccgatcgggaagaactggatctcccgccaccagttggaggagtggctgttgatgtggtgaaagtagaagtccctgcgacgcgactcggaccgatg

SEQ ID NO: 3558 - DNA, 203 bp, Homo sapiens
ggcgcgccagtcctctcggttgtaacgcgcttaggaagtcccctcgaggtatggcagatatgctcttgcatagggggaaaaaatgtagtcttaatattgtctgtgtgctgcaggagctaagctgactctgctggtggcctcgcgtaccactgtggccaggcggtagctgggacgtgcagccgaccacccgactcggaccgatg

SEQ ID NO: 3559 - DNA, 203 bp, Homo sapiens
ggcgcgccagtccttgtgtgctgcaggagctaagctgactctgctggtggcctcgcgtaccactgtggccaggcggtagctgggacgtgcagccgaccaccatggggagcagcaagagcaagcctaaggaccccagccagcgccggcacagcctggagccacccgacagcacccaccacgggggattccgactcggaccgatg

SEQ ID NO: 3560 - DNA, 203 bp, Homo sapiens
ggcgcgccagtcctgcgaaaatcccgggatatgatagaggtgggggttattaaccgagacgggtctttggagcgacccctgctcctcttccccgcagtagctatggttagagggagtatcctaggaagagattgtctgcagggcctagggctccgcttgacaaatttatagggagggccactgttcttcgactcggaccgatg

SEQ ID NO: 3561 - DNA, 203 bp, Homo sapiens
ggcgcgccagtccttgccgagaactcagagggtcgtcggaagacggagagtgagcccgacgaccaccccaggcacgtctttggtcggcctgcggatcaagcatggaagccgtcattaaggtgatttcgtccgcgtgtaaaacctattgcgggaaaatctctccttctaagaaggaaataggggccatgcgactcggaccgatg

SEQ ID NO: 3562 - DNA, 203 bp, Homo sapiens
ggcgcgccagtcctacataccaaataccaagaccaactagaacaacaattttcaaaacaaaaaattgaaaagtggtgttacgtaaggaacagaagaaaggaatggaaaggaccctacaaagtgttgtgggacggagacggggcagcagtaatagaggaagagggaaaaacagccttatatccacaccgcgactcggaccgatg

SEQ ID NO: 3563 - DNA, 203 bp, Homo sapiens
ggcgcgccagtcctcaacgcttagctgcacttcagctgtgcactaacgcatgtctctgttggtacccgttaggacgcatcaacgacaccaccccgttgtggttgaacttttcgtctgggaaggaaccaacgatccaacaactgagtggccacccctaactcgtcgtaacattcatagattgtggcaatcgactcggaccgatg

SEQ ID NO: 3564 - DNA, 203 bp, Homo sapiens
ggcgcgccagtcctgggtggcgatgataatgttgccacagcccaaagaaagctttggaggaaagccaattggctggcttttctggaacacgtgcaaaggacctaggcgggactgtccacattgttgttgtcccatatgtagttggcattgtcagctttgctttttgcagaaaaatctaggaatcaactcgactcggaccgatg

SEQ ID NO: 3565 - DNA, 203 bp, Homo sapiens
ggcgcgccagtcctctgtcttactttctgtttctcgcggcccgcgctctctccctcggcgccctctagcggccaggagagaccggcaaacaattgggggctcgtccgggattgatcaccccggaaccctaacgatcctctggacccaccccctcggcggcgttttgggtctttcctttaaattatatccgactcggaccgatg

SEQ ID NO: 3566 - DNA, 203 bp, Homo sapiens
ggcgcgccagtcctcgtccgggattgatcaccccggaaccctaacgatcctctggacccaccccctcggcggcgttttgggtctttcctttaaattatatcatgggaaattccccctcctataacccccccgctggtatctccccctcagactggctcaaccttcgtcaaagcgcgcaaaggctcaatcgactcggaccgatg

SEQ ID NO: 3567 - DNA, 203 bp, Homo sapiens
ggcgcgccagtcctagctccccgggcaaaacaatcgtcggtggctaggacctctcccggccctagtcgaagcctcgggaggcgccctcctggctactaacccccccgtgtgggttccctggcgtttgctaaaagccttcaaatgcccaaagaacgacggtcccgaagacgcccacaaccgatcatcagcgactcggaccgatg

SEQ ID NO: 3568 - DNA, 203 bp, Homo sapiens
ggcgcgccagtcctcccccgtgtgggttccctggcgtttgctaaaagccttcaaatgcccaaagaacgacggtcccgaagacgcccacaaccgatcatcagatgggtaagtctcactcttactctcctcgctctctgtcagcccatccagacttggagatgctccctgtccctaggaaatcaacaatgcgactcggaccgatg

SEQ ID NO: 3569 - DNA, 203 bp, Homo sapiens
ggcgcgccagtcctgccatggaggcccatcagtttattaaggctcctggcatcactactgctattgagcaggctgctctagcagcggccaactctgcccttgcgaatgctgtggtagttaggccttttctctctcaccagcagattgagatccttattaacctaatgcaacctcgccagcttgttttccgactcggaccgatg

SEQ ID NO: 3570 - DNA, 203 bp, Homo sapiens
ggcgcgccagtccttttcactgagtcagtgaagccagtgctcgacctgacaaattcaatcctgtgtcgggtggaatgaataacatgtcttctgctgcgcccatgggttcgcgaccatgcgccctcggcctattttgctgttgctcctcatgtttctgcctatgctgcccgcgccaccgcccggtcagccgactcggaccgatg

SEQ ID NO: 3571 - DNA, 203 bp, Homo sapiens
ggcgcgccagtccttgaagccagtgctcgacctgacaaattcaatcctgtgtcgggtggaatgaataacatgtcttctgctgcgcccatgggttcgcgaccatgcgccctcggcctattttgctgttgctcctcatgtttctgcctatgctgcccgcgccaccgcccggtcagccgtctggccgccgccgactcggaccgatg

SEQ ID NO: 3572 - DNA, 203 bp, Homo sapiens
ggcgcgccagtccttgtctctagtttgtctgttcgagatcctacagttggcgcccgaacagggacctgagaggggcgcagaccctacctgttgaacctggctgatcgtaggatccccgggacagcagaggagaacttacagaagtcttctggaggtgttcctggccagaacacaggaggacaggtaagcgactcggaccgatg

SEQ ID NO: 3573 - DNA, 203 bp, Homo sapiens
ggcgcgccagtccttgatcgtaggatccccgggacagcagaggagaacttacagaagtcttctggaggtgttcctggccagaacacaggaggacaggtaagatgggagaccctttgacatggagcaaggcgctcaagaagttagagaaggtgacggtacaagggtctcagaaattaactactggtaaccgactcggaccgatg

SEQ ID NO: 3574 - DNA, 203 bp, Homo sapiens
ggcgcgccagtcctatggctagctatgcttactaataatcagcttagaagacaagtaattagggaagcacagatctggatgtggaaacataagggagctgcagttagaagaaattgtggttgcaggctatgtaaccccggctggggaagccaagtaagaaatgttgaactgtgataagcctgtctaggcgactcggaccgatg

SEQ ID NO: 3575 - DNA, 203 bp, Homo sapiens
ggcgcgccagtcctgcgtccacgacggaaaccccgccgagacctagccgcggtccctggatctccagatacggaggggagtctttttgttgttttttgtagatgcatccggtgttgcgacagatgcgtccgacggcgcctccaacacagccgccgctcccgccccccactagcgcccctgcagccgttcgactcggaccgatg

SEQ ID NO: 3576 - DNA, 203 bp, Homo sapiens
ggcgcgccagtcctaagccgtccccctcggagttagaagacgcgttcacaaaatggacgaagactgagtttccctgtcgttgccagccggtccccgtcagcatgagcaagcgcaagttcaaagaagagctgctggaggcccttgtgcctgaaatctatggccctgccgcggacgtcaagcccgacattcgactcggaccgatg

SEQ ID NO: 3577 - DNA, 203 bp, Homo sapiens
ggcgcgccagtcctcaaacccagccgcactcgctccacccgccgtcgtcgctctgtccgccgccgctcaaggcgcacggcccccatctctgtgcgtcgcgtaacccgccgtggacgcacgctgacccttcccaacgcgcgttaccaccctagcattctcgtttaatccgtgcgctgccgttttttcagcgactcggaccgatg

SEQ ID NO: 3578 - DNA, 203 bp, Homo sapiens
ggcgcgccagtcctaacccgccgtggacgcacgctgacccttcccaacgcgcgttaccaccctagcattctcgtttaatccgtgcgctgccgttttttcagatggctttgacttgccggtttcgcattcccgttccgtcctaccgaggaagatctcgccgtaggagaggcatggcgggcagtggccgccgactcggaccgatg

SEQ ID NO: 3579 - DNA, 203 bp, Homo sapiens
ggcgcgccagtcctgcgctttgcgcaggcgaataaaaggcggatttttgcccgcgttgattcccatcatcgccgccgccataggcgcaatcccaggcgtggcctccgtggccttgcaagcagctcgcaaacaataaaagaaggcttaacactgacttcctggtcctgactattttatgcagacaagaccgactcggaccgatg

SEQ ID NO: 3580 - DNA, 203 bp, Homo sapiens
ggcgcgccagtcctccaccagccgcaccgcggcgtcatcgaggccgtctacctgcgtacgccgttctcggccggtaacgccaccacataagaagccagccaatgggctccagcgagcaggagttggtcgccatcgtgcgcgaactgggctgcggaccttactttctgggcacgtttgacaaacgctttcgactcggaccgatg

SEQ ID NO: 3581 - DNA, 203 bp, Homo sapiens
ggcgcgccagtcctccttgccgtcctcggggggcgttacatagcccggatcttgctccacttgctcattttcctcctcatgtttcactagctcgacggcgccgacctcagagttgggggtggttaaggtttcggagtctggctgcagcttaagatcctcctccatattttctcgcctaggagtaaagccgactcggaccgatg

SEQ ID NO: 3582 - DNA, 203 bp, Homo sapiens
ggcgcgccagtcctaggcactgttcaataaatattgctcggtgtctcttaaggactaaacacccgcgctttttttaggcgccaaattacgtcattgacattatgagcaaagacattcccacgccttacatgtggagctatcagccgcaaatgggcctggcagctggagcttctcaggattactccagtcgactcggaccgatg

SEQ ID NO: 3583 - DNA, 203 bp, Homo sapiens
ggcgcgccagtcctcagacgacttcatcccgaactacgacgcggtgagcgaatctgtggacggctacgactgaagaccgatagtacggccgtgactgcgcggctgtaacatctgcatcggtgccgtaaccttcgctgctttacttaaaaagcctgtgatttcatttaccaccccagcacttggattaccgactcggaccgatg

SEQ ID NO: 3584 - DNA, 203 bp, Homo sapiens
ggcgcgccagtccttcgctggactttacaaaaagagaatctaaccactaccaccctccttccccttactacttatactttttcccaaaaaaagaattactttttgcccattattgcacttttggcctttgtctgtgttattaccgctaattatattttaattttcaatcttgataatttttactaatccgactcggaccgatg

SEQ ID NO: 3585 - DNA, 203 bp, Homo sapiens
ggcgcgccagtcctcgccttgctgacttatctcatcttcacctctgtttgctgcactgccatctgcagcattgccactttttttgtggccattttccaaactgcggactacctatacgttagagtggcatactatcgtcatcatccccaatataggaaccacgaggtggctacccttctgtgcctgtccgactcggaccgatg

SEQ ID NO: 3586 - DNA, 203 bp, Homo sapiens
ggcgcgccagtcctgtttcctattacagcccccaccgcccccaccggctcctgtgcagcgcgctccatcagttattagctactttcatcttaactctgaagatgtctgaccaactagaaatcgacgggcagtgcactgagcagcttatccttgctcggcgaaaactcaaacaacaaaatcaggaactgcgactcggaccgatg

SEQ ID NO: 3587 - DNA, 203 bp, Homo sapiens
ggcgcgccagtcctacatagggaatgctgggagttgaggaggtgtcataggggtagacggggttgaagtcgtcttcaattctggttcttttcatctgcaagatgaagattgtgggtcagggtaaaaaggtgaacaccgatataccctttaggacgtggagaaagtttgccgcccgttggcacatcccgcgactcggaccgatg

SEQ ID NO: 3588 - DNA, 203 bp, Homo sapiens
ggcgcgccagtccttcgcctaacatcaccttcagtgtcgtctacaacgagataaacagtgggtatgcttttacgtttaaatggtcagccgaaccgggaaaaccttttcacccacccaccgctgtattttgctacataactgaacaataaaatcattgcaggcgcaatcttcgcatttcttttttccagcgactcggaccgatg

SEQ ID NO: 3589 - DNA, 203 bp, Homo sapiens
ggcgcgccagtccttgtaatttttcaccaacgcagcggtggggagaggtgtgatcttcgtgacttgcactttggctcgctttacaaccgtctggaataattatgcctcttccgtctctccctccacctccagtgagtcgggatcaaggcctttgtatttcttggttggagttggctttaacctgctgtcgactcggaccgatg

SEQ ID NO: 3590 - DNA, 203 bp, Homo sapiens
ggcgcgccagtcctggagggacgtggagcgcctgcagcgttgccggcaaatccgctgtttccatcacgctttcgtaagaaggaggaggaccctcggcgtacgccatcaccggcggcactcccaccgcacgtctcattttgactaccgggaagagggaaaaaacagacaaagggacggacgctgttgctcgactcggaccgatg

SEQ ID NO: 3591 - DNA, 203 bp, Homo sapiens
ggcgcgccagtcctggcgattctctagttctaacacgaacgtttacggtcgttgccagctttttccttataaaactctggtgggaatttctcttgggacagatggacctgacatctgtacattcggttcgggatctgagttctgctctccgtatcccatttattgatttggttgttccttgcaattttcgactcggaccgatg

SEQ ID NO: 3592 - DNA, 203 bp, Homo sapiens
ggcgcgccagtcctcaccaccagatcatacattcaaaaagggagggcaaacaattgaggtaatctatgatgaggatcccaataatagcaccagacatactgtatggcgccatatatattatcaaaacggtgataacagatggagaaaagcagctagtgatgtagatgttcatggtgtgttttatttagcgactcggaccgatg

SEQ ID NO: 3593 - DNA, 203 bp, Homo sapiens
ggcgcgccagtcctgtaagcgactcccttccgtggtttggtggaaaagtcacaagggtaccatagcgaggaaccccggttcgaaaccggcaggatccgctatgagcacaagtgaggcgcttgcgcgttgaacccggccaaggacccccagacacggagaggagtctttttttatttattttttcttagcgactcggaccgatg

SEQ ID NO: 3594 - DNA, 203 bp, Homo sapiens
ggcgcgccagtccttgagcacaagtgaggcgcttgcgcgttgaacccggccaaggacccccagacacggagaggagtctttttttatttattttttcttagatgcatcctgtcctgcgacaaatgcgacctcagcccagggcaaccacggcctcagcagcggtggcgctttcgggctctggcgaacagcgactcggaccgatg

SEQ ID NO: 3595 - DNA, 203 bp, Homo sapiens
ggcgcgccagtcctggcagctggagtggcgtctgctgacgtcactggcgatgacgatgacgaagaccagtacgaggactgatcggccgtaccttttgttagatgcagcgaccggcgatcatcgcggagagggctcctaacctggatcccgcggttttggcggccatgcaaagccagccttctggcgttcgactcggaccgatg

SEQ ID NO: 3596 - DNA, 203 bp, Homo sapiens
ggcgcgccagtccttatgcgcagacgcatgaagggtggggtgctgcccttcctaattccacttattgctgcggccattggagccgttcccggaattgcctcagtagccttgcaggcttctcgaaaaaattaaaataaaataaaacttccaacttattactggtactatgactgttttatgcagactaacgactcggaccgatg

SEQ ID NO: 3597 - DNA, 203 bp, Homo sapiens
ggcgcgccagtcctgcggcgtcattgaagcggtctacctgcgcacgcccttctcggcgggtaacgctaccacctaagaaggcaccctcccagactgctgtaatgggttcaagcgaacaggagctgacggccattgttcgagatctaggctgtggaccctattttttgggaacctttgacaaacgttttcgactcggaccgatg

SEQ ID NO: 3598 - DNA, 203 bp, Homo sapiens
ggcgcgccagtccttcctcggggggagtctcgtagcccaagttctgctcaaccggtgcgtcttggggtatgagtagacttttgtccttctccatgacagccgtagcgccaatggcgggagcggtgggggcggttaagctttcctgtggctccagatccatcatgtgtttctttgcctaggattaaatacgactcggaccgatg

SEQ ID NO: 3599 - DNA, 203 bp, Homo sapiens
ggcgcgccagtcctgtagcgccaatggcgggagcggtgggggcggttaagctttcctgtggctccagatccatcatgtgtttctttgcctaggattaaataatggccagcaatcagcactcacagagggagcgcaccccagaccgcagcgctcagccgccgccgccaaaaatgggcagatactttctgcgactcggaccgatg

SEQ ID NO: 3600 - DNA, 203 bp, Homo sapiens
ggcgcgccagtcctttcttgacttttttctttggaggtaaaggcacagcttccagttcttcttcgctttcggaatccagaaagtatctgcccatttttggcggcggcggctgagcgctgcggtctggggtgcgctccctctgtgagtgctgattgctggccattatttaatcctaggcaaagaaacaccgactcggaccgatg

SEQ ID NO: 3601 - DNA, 203 bp, Homo sapiens
ggcgcgccagtccttcctttttcgggctcgcctggacactatcctgacgccttcatacccaactttgacgcagtgagtgaatctgtggatggctatgattaatgtctaatggagcggctgacagagcgcggctgcgacatttagaccactgtcgccaacctcactgctttgctcgagacatctgtgtccgactcggaccgatg

SEQ ID NO: 3602 - DNA, 203 bp, Homo sapiens
ggcgcgccagtcctttgagcttccagaggagcacccccaggggccagctcacggtgtcagaataacagttgaaaaaggaattgatacacacctcattaaatttttcaccaaacgcccgctattggtggaaaaagatcaaggaaatactatattaactttatattgcatttgtcctgttcccggattaccgactcggaccgatg

SEQ ID NO: 3603 - DNA, 203 bp, Homo sapiens
ggcgcgccagtcctaacacagtttaacacatacagtaagcacagtaatctttttaggaataattggcttcagcattttgattattatagcagcctttatttatctgtgctggcatagaaaatctttgtgtgtttctaaaacagaacctcttatgccgattccttactagttttcttttttcttacagtcgactcggaccgatg

SEQ ID NO: 3604 - DNA, 203 bp, Homo sapiens
ggcgcgccagtcctaagtgctaatacacctggtggtttttcttgaagaccattggaagaagtaaaagggggtgtaacaaagggtacgtctgatgtgtcaaatgggtcaaaagggtaaacggggttgaagtcatcattttcttctgtttcttcagcatactgggttctgctgcgcttcatctagaaaagcgactcggaccgatg

SEQ ID NO: 3605 - DNA, 203 bp, Homo sapiens
ggcgcgccagtccttgggtcaaaagggtaaacggggttgaagtcatcattttcttctgtttcttcagcatactgggttctgctgcgcttcatctagaaaagatgaagatggtgggtagggattgggaagaagaatctgaccttccatttaagatttggagaaagtttgctgtttgcaagtctgtcaggcgactcggaccgatg

SEQ ID NO: 3606 - DNA, 203 bp, Homo sapiens
ggcgcgccagtccttgaagataacacctgaagctgaatacattttagcaagcctgcgagagtggttgtactttgcttttttgacggaacgccaacgctgcaaacaaaaaggacgaggtgcgataaccagtggtcgtacgtggttttgtttttttaagtacgaagacgctcgcaagtctgttgtttacgcgactcggaccgatg

SEQ ID NO: 3607 - DNA, 203 bp, Homo sapiens
ggcgcgccagtcctcttttgtttatcgaaatcagagctgtggctcttttagaagctgttgttgaacatttggaaaatcgcttacaatttgatctggctgtgatctttcaccagcacagcggaggcgatcgctgccacctgcgagatttacgcattcaaatccttgctgaccgtcttgattaagtttttcgactcggaccgatg

SEQ ID NO: 3608 - DNA, 203 bp, Homo sapiens
ggcgcgccagtcctatccaggctcaagaatggagctcagtgttttgttgtttaatcattccgacgtgttttgcgatgttcgcgcaaagcagccagtcgcgcgcttgcttttaagtagagttgtttttccacccgtttgccaggcatctttaatttaacatatttttatttttcaggctaacctaaagccgactcggaccgatg

SEQ ID NO: 3609 - DNA, 203 bp, Homo sapiens
ggcgcgccagtcctattgtgctaaatgtaactgaggagctgagaagtgaccaccttaccctgtcttgcctgcggactgactatgagtcaagtgatgaagacgacaactgaggtaagtgggtggagctaggtgggattataaaaggctggaagtcaactaaaaattgtttttgttcttttaacagcacgcgactcggaccgatg

SEQ ID NO: 3610 - DNA, 203 bp, Homo sapiens
ggcgcgccagtcctgtgtcctcactgcgggagcacctccaaaggaaaaatacgggctaaaggccacgctacagaggctttgtcttatgatcttatgttaaaatgctaccttgccgaagcacagggagaagacacgcgcttcagcaccagccgcctcagtttaaagcgcacactggccagcgctcaacccgactcggaccgatg

SEQ ID NO: 3611 - DNA, 203 bp, Homo sapiens
ggcgcgccagtcctgtttcttccctccgtaggacccaaatagcggggaggcacgtagggtggcgccgctgccatcacggtttcgtaagagggaggtggtgtctcaggaaaagccactgtctgcagttccaccgcgcgcctcatttcacagctaacggaagaaggaaaataagacgaacactggtcgcccgactcggaccgatg

SEQ ID NO: 3612 - DNA, 203 bp, Homo sapiens
ggcgcgccagtcctttttaaccgactgttacgaatacagcctgatagggtgctgcagaggcccactgtattgctactaaaaatctctgctgtacatggcacatggagttgatcacaaatgaacttttatacaaaacatacaaacaaaaacccgtcggggtggaggaacctgtttatgatcaggcaggtcgactcggaccgatg

SEQ ID NO: 3613 - DNA, 203 bp, Homo sapiens
ggcgcgccagtcctgtctggaaagactagtactgctacagatggtagaacagcatgtgtttcaagtattgccattgtggagagccaggagaagtagtacaacagatttcccatggtgcagggacacaacgggatacacgcatgcgtggtctgtccaggagtgctggttgatggaatatctcttagaggcgactcggaccgatg

SEQ ID NO: 3614 - DNA, 203 bp, Homo sapiens
ggcgcgccagtccttattaaaggatgaagagaagggatattttcttatacctaggagacacataaggagagttccagaaccctgcgctcttcctgaaggggatgagtgaagaagattggcaggtaagtagaagactctttgcagtgctccaaggaggagtaaatagcgctatgctatacatatctaggcgactcggaccgatg

SEQ ID NO: 3615 - DNA, 203 bp, Homo sapiens
ggcgcgccagtcctatccctccaggaagcggccggggcagccttgctctccatagacggctccccccggtggatcccgtggcgattcctgaaaaaagctgcatgcccaagaccagacgccagcgaactcgccgagcacgccgcaacagaccaccaacaccatgggtaatgttttcttcctacttttatcgactcggaccgatg

SEQ ID NO: 3616 - DNA, 203 bp, Homo sapiens
ggcgcgccagtcctctccggcccctgaatgcggctaaccttaaccctagagccttatgccacgatccagtggttgtaaggtcgtaatgagcaattccgggacgggaccgactactttgggtgtccgtgtttctcatttttcttcatattgtcttatggtcacagcatatatatacatatactgtgatccgactcggaccgatg

SEQ ID NO: 3617 - DNA, 203 bp, Homo sapiens
ggcgcgccagtccttgcagtatgccctcaaaaacatcaaacctctgttaatacccctaatttgtgcccacgctgtaaaaaaggaaagcattgggcacgagactgccgttccaagacagatgttcaaggcaatcctttgcccccggtttcgggaaactgggtgaggggccagcccctggccccgaaacacgactcggaccgatg

SEQ ID NO: 3618 - DNA, 203 bp, Homo sapiens
ggcgcgccagtcctctgccgttccaagacagatgttcaaggcaatcctttgcccccggtttcgggaaactgggtgaggggccagcccctggccccgaaacaatgttatggggcaacactgcaggttccaaaagaaccattgcagacctctgtcgagccacaagaggcagcgcgggattggacctctgtcgactcggaccgatg

SEQ ID NO: 3619 - DNA, 203 bp, Homo sapiens
ggcgcgccagtcctgtgcaggtgcgactcttgtttgtgctggtcgcggcaggtggcgcccaacgtggggctcgagctcgacagttttcttccgccactactctcattaattgaactaagtaagtatatggataaacaagtagcctaaattaaggaggagtagtaaggtatatagttgagagtataaatcgactcggaccgatg

SEQ ID NO: 3620 - DNA, 203 bp, Homo sapiens
ggcgcgccagtccttaaattttttaactttagacacagaaggcaattcagcagcccagcgtttttggggagaacgatcctcatgcaaaaaaccacttgtgcgatggaaggatccacttaccaatctgtggtatgggccagaccctgtattaatatggggacgagggcatgtttgtgtttttccacaggcgactcggaccgatg

SEQ ID NO: 3621 - DNA, 203 bp, Homo sapiens
ggcgcgccagtccttaccctccatcattgttataaaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtccgactcggaccgatg

SEQ ID NO: 3622 - DNA, 203 bp, Homo sapiens
ggcgcgccagtcctggtatacaatgacagagatcttctagactaggtgcgagaggccgaggaccagaacaacatccgcctaccctccatcattgttataaaaaacttaggaaccaggtccacacagccgccagccaaccaaccatccactcccacgactggagccgatggcagaagagcaggcacgcccgactcggaccgatg

SEQ ID NO: 3623 - DNA, 203 bp, Homo sapiens
ggcgcgccagtccttcaagcccacctgaaattgtctccggcttccctctggccgaacgatatcggtagttaattaaaacttagggtgcaagatcatccacaatgtcaccacaacgagaccgaataaatgccttctacaaagacaacccacatcctaagggaagtaggatagttattaacagagaacatcgactcggaccgatg

SEQ ID NO: 3624 - DNA, 203 bp, Homo sapiens
ggcgcgccagtccttgatgtcacccagacatcaggcatacccactagtgtgaaatagacatcagaattaagaaaaacgtagggtccaagtggtttcccgttatggactcgctatctgtcaaccagatcttataccctgaagttcacctagatagcccgatagttaccaataagatagtagctatcctgcgactcggaccgatg

SEQ ID NO: 3625 - DNA, 203 bp, Homo sapiens
ggcgcgccagtccttaggcctccaagggctccccaaaatctgaatttctgagtagtcttcatcccctctcctgctctaaggtcaggtccatcctctctggtccttaccttgatgacaaggatccagccttctggtgtttttgagcatttcaaaggtctgcatagaaaggaacagccactaggtccattcgactcggaccgatg

SEQ ID NO: 3626 - DNA, 203 bp, Homo sapiens
ggcgcgccagtcctccttaccttgatgacaaggatccagccttctggtgtttttgagcatttcaaaggtctgcatagaaaggaacagccactaggtccattatgggacccctcattgtactcctaatgattttgctcttcggaccctgcattcttaatcgattagtccaatttgttaaagacaggatacgactcggaccgatg

SEQ ID NO: 3627 - DNA, 203 bp, Homo sapiens
ggcgcgccagtccttcagcctttttagagagactcaaggaggcctatcgcagatacactccttatgaccctgaggacccagggcaagaaaccaatgtgtccatgtcattcatctggcagtccgccccggatatcgggcgaaagttagagcggttagaagatttaaagagcaagaccttaggagacttacgactcggaccgatg

SEQ ID NO: 3628 - DNA, 203 bp, Homo sapiens
ggcgcgccagtcctcaaagtagacggcatctctgcggggatacacgccgctcacgtaaaagcggcgacaacccctccggccggaacggcatcaggaccgacatgaaaggtccagcattctcaaaaccccttaaagataagattaacccgtggggccccctgatagtcctggggatcttaataagggcacgactcggaccgatg

SEQ ID NO: 3629 - DNA, 203 bp, Homo sapiens
ggcgcgccagtcctgaccgaagccgcgccgcgcgtcttgtctgctgcagcatcgttctgtgttgtctctgtctgactgtgtttctgtatttgtctgagaatatgggccagactgttaccactcccttaagtttgaccttaggtcactggaaagatgtcgagcggatcgctcacaaccagtcggtagatcgactcggaccgatg

SEQ ID NO: 3630 - DNA, 203 bp, Homo sapiens
ggcgcgccagtcctcctcaaagtagacggcatcgcagcttggatacacgccgcccacgtgaaggctgccgaccccgggggtggaccatcctctagactgacatggcgcgttcaacgctctcaaaaccccttaaaaataaggttaacccgcgaggccccctaatccccttaattcttctgatgctcagacgactcggaccgatg

SEQ ID NO: 3631 - DNA, 203 bp, Homo sapiens
ggcgcgccagtccttacaggctctctacttagtccagcacgaagtctggagacctctggcggcagcctaccaagaacaactggaccatcctctagactgacatggcgcattcaacgccatgctcccaaacttccctggctgttcctaatcatttctccctagtgtctcatgtgactgtcccatctgagcgactcggaccgatg

SEQ ID NO: 3632 - DNA, 203 bp, Homo sapiens
ggcgcgccagtcctcaaagggacctcaaggctttccgagggacactaggctgactccatcgagccagtgtagagataagcttttgtttctgtttattttttatgggaccccttattgtactcctaatgattttgctcttcggaccctgcattcttaatcgattagtccaatttgttaaagacaggatacgactcggaccgatg

SEQ ID NO: 3633 - DNA, 203 bp, Homo sapiens
ggcgcgccagtcctcgcccgaacagggaccctcggataagtgacccttgtctctatttctactattttgtgttcgtcttgttttgtctctatcttatctggctattatcacaagagcggaacggactcaccacagggaactgcagtctcgcctacagagaagaggtaggttacggtgagccattggaacgactcggaccgatg

SEQ ID NO: 3634 - DNA, 203 bp, Homo sapiens
ggcgcgccagtcctctattatcacaagagcggaacggactcaccacagggaactgcagtctcgcctacagagaagaggtaggttacggtgagccattggaaatgggggtctcgggatcaaaagggcagaaactctttgtttctgttctacaaagactcctctcagagaggggtcttcatgtgaaagagcgactcggaccgatg

SEQ ID NO: 3635 - DNA, 203 bp, Homo sapiens
ggcgcgccagtcctaggctttaaatccattagattggacacaatatttcatttttataggtgttggagccctgcttttagtcattgtacttatgattttccccattgttttccagtgccttgcgaagagccttgaccaagtgcagtcagatcttaacgtgcttcttttaaaaaagaaaaaagggggaacgactcggaccgatg

SEQ ID NO: 3636 - DNA, 203 bp, Homo sapiens
ggcgcgccagtcctttgtttttctgagaacatcagctctggtattttcccatgccttgcaaaatggcgttactgcagttagctggctaagccttatgaaggggtctttcattcccccctctttctgtaaactgaataaaatcttttattcacgtgatttttaatcttttactgtcttaagtagccaaccgactcggaccgatg

SEQ ID NO: 3637 - DNA, 203 bp, Homo sapiens
ggcgcgccagtcctgccgaaaccgcgccgcgcgtcttatctgtctcagtgttattttgtcatttgtctggttcgttattgttttggaccgtttctaaaaatatgggacagaccgtaaccactcctttgagtctgaccctagaacactggggagacgtccagcgcattgcgtccaaccagtccgtggaccgactcggaccgatg

SEQ ID NO: 3638 - DNA, 203 bp, Homo sapiens
ggcgcgccagtcctcctactgggaaaagtagggaaatacccttcacaggacgaaaaggcgctgctgggggacaggaggagggttcgcagccctgagacttaaagaaggggacgagccctccgcctgaacctgaggagtgcaaaggcagcgctagtaagaaaaccgccgtggtgaatctagatagagaccgactcggaccgatg

SEQ ID NO: 3639 - DNA, 203 bp, Homo sapiens
ggcgcgccagtcctaagaaggggacgagccctccgcctgaacctgaggagtgcaaaggcagcgctagtaagaaaaccgccgtggtgaatctagatagagacatggcgacgcaaggctcaaaggagaagaagggataccctgagctcaaagaggtcattaagacaacatgtaaaataaaggtggggccccgactcggaccgatg

SEQ ID NO: 3640 - DNA, 203 bp, Homo sapiens
ggcgcgccagtcctcaaaggttcccatggtccgggaccgaagggttatacgataccttggtctatacaggattgctgggacatggaatcaatatataattaatggaggaagcaccaagaagaaggccaggaggcagcagagaagctgaagggatatttcggtattatgaggattgggaatgctgggaccgactcggaccgatg

SEQ ID NO: 3641 - DNA, 203 bp, Homo sapiens
ggcgcgccagtccttctccatggaatactcctatattcatcattaagaaaaaatcaggtagctggcgtcttttacaggatctaagagccgttaataaggtaatggtccccatgggagcccttcagcctggtcttccctctcctgtagccatccccctaaactatcacaaaattgttattgaccttaagcgactcggaccgatg

SEQ ID NO: 3642 - DNA, 203 bp, Homo sapiens
ggcgcgccagtcctctcagcctgcatatacgatcaaaaggaggatggcccccgctggctccctgagcgactaattagacacatcaataatcagacagcccccttgtgtgacaggccaagtaacccaaatacagccccagggccaaaaggctcgccctgaggagctccttttctcttcttccaggaagacgactcggaccgatg

SEQ ID NO: 3643 - DNA, 203 bp, Homo sapiens
ggcgcgccagtcctcttgtgtgacaggccaagtaacccaaatacagccccagggccaaaaggctcgccctgaggagctccttttctcttcttccaggaagaatgctctgcatcctcatcctcctactgcacccacgcctctgcccagtcacaaagggaggacttggaaagccatccggagacatttaccgactcggaccgatg

SEQ ID NO: 3644 - DNA, 203 bp, Homo sapiens
ggcgcgccagtcctcgtggggctcgatgccggcctccgtggaccgccgtcccctgtaaccggttccctgcacggccgtcccgattaaccgattccccgcacggagcaccgcggaccacccgaccgcgagccgactcctggagttcgttcctcatttcgacggcggcattactcaagtaagacccaatccgactcggaccgatg

SEQ ID NO: 3645 - DNA, 203 bp, Homo sapiens
ggcgcgccagtcctggagcaccgcggaccacccgaccgcgagccgactcctggagttcgttcctcatttcgacggcggcattactcaagtaagacccaatcatgggacaagcatcttcacacagtgaaaatgatctctttataagtcacttaaaggaatctctcaaggtgcgtagaattcgggttcgccgactcggaccgatg

SEQ ID NO: 3646 - DNA, 203 bp, Homo sapiens
ggcgcgccagtcctatgagcttaatgataagaactggaaatcctttttctcaaggacgtggtccagattaagtttgcacgaggacgaggacaaggaaaacgatggagactctttgccaacgtttaaatgtgtgtcaggacaaaatactaacacattatgaaaatgatagtacagacctacgtgaccatcgactcggaccgatg

SEQ ID NO: 3647 - DNA, 203 bp, Homo sapiens
ggcgcgccagtccttacgaacatattttgtgcagtttaaagatgatgcagaaaaatatagtaaaaataaagtatgggaagttcatgcgggtggtcaggtaatattatgtcctacatctgtgtttagcagcaacgaagtatcctctcctgaaattattaggcagcacttggccaaccaccccgccgcgacgactcggaccgatg

SEQ ID NO: 3648 - DNA, 203 bp, Homo sapiens
ggcgcgccagtcctcaagcagaaccggacagagcccattacaatattgtaaccttttgttgcaagtgtgactctacgcttcggttgtgcgtacaaagcacacacgtagacattcgtactttggaagacctgttaatgggcacactaggaattgtgtgccccatctgttctcagaaaccataatctacccgactcggaccgatg

SEQ ID NO: 3649 - DNA, 203 bp, Homo sapiens
ggcgcgccagtcctattatttacaaggaacttttaaaaactattatgtactgtttgctgacgatgcgaaaagatatggtacaactggagaatgggaagtaaaagttaataaggaaactgtgtttgctcctgtcaccagctccacgcctccagggtcgccaggaggacaagcagacacaaacaccaccccgactcggaccgatg

SEQ ID NO: 3650 - DNA, 203 bp, Homo sapiens
ggcgcgccagtcctcagctccacgcctccagggtcgccaggaggacaagcagacacaaacaccacccccgcgacccccaccacctccacaaccgccgttgactccacgtccagacagctcaccacatcaaaacagccacaacaaaccgaaaccagaggaagaaggtacggacggaggccctccagcaacgactcggaccgatg

SEQ ID NO: 3651 - DNA, 203 bp, Homo sapiens
ggcgcgccagtcctagttagattgctgtggcagaggccttccctttcataaggtgaggaacgcctggaagggaatctgtaggcagtgtaagcatttttatcatgattggtaaagaggtcaccgtgcaagatattattctggagctcagtgaggtgcagcccgaagtgctaccagttgacctgttttgtcgactcggaccgatg

SEQ ID NO: 3652 - DNA, 203 bp, Homo sapiens
ggcgcgccagtcctccacagaatttggtattagagctttccaacagctactgaccggagatctgcagctcctgtgccctgactgtcgcggaaactgcaaacatgacggatcctaattctaaaggtagtacatctaaagaagggtttggtgattggtgtttattggaagctgactgtagtgatgtagaacgactcggaccgatg

SEQ ID NO: 3653 - DNA, 203 bp, Homo sapiens
ggcgcgccagtcctaggggaatgcagccaaaccatgacctcaggaaggaaagtgcatgactcacagggaggagctgcttacccatggaatgcagccaaaccatgacctcaggaaggaaagtgcatgacagacatgttttgcgagcctaggaatcttggccttgtccccagttaaactggacaaaggcccgactcggaccgatg

SEQ ID NO: 3654 - DNA, 203 bp, Homo sapiens
ggcgcgccagtcctcaaaagtaccactgctttacctgctgtaaaagactctgtaaaagactcctaggtaagtaatccctttttttttgtatttccaggttcatgggtgctgctctagcacttttgggggacctagttgccagtgtatctgaggctgctgctgccacaggattttcagtggctgaaattcgactcggaccgatg

SEQ ID NO: 3655 - DNA, 203 bp, Homo sapiens
ggcgcgccagtcctggcctaactcctcaaacatatgctgtaattgctggtgctcctggggctattgctgggtttgctgctttaattcaaactgttagtggtattagttccttagctcaagtagggtataagttctttgatgattgggatcacaaagtttccactgtaggcctctatcagcaatcaggccgactcggaccgatg

SEQ ID NO: 3656 - DNA, 203 bp, Homo sapiens
ggcgcgccagtcctcgaacctctccactcagtccctctagacaataaagtccgagatgtcctaaagtcaacatgaaaaaaacaggcaacaccactgataaaatgaactttctacgtaagatagtgaaaaattgcagggacgaggacactcaaaaaccctctcccgtgtcagcccctctggatgacgatcgactcggaccgatg

SEQ ID NO: 3657 - DNA, 203 bp, Homo sapiens
ggcgcgccagtcctgagaggcaatcttcctcccgtgaaggacacaagcagtagctcacaatcatctcgtgtttcagcaaagtgtgcataattataaagtgctgggtcatctaagcttttcagtcgagaaaaaaacagtagatcagaagaacaactggcaacacttctcatcctgagacctacttcaagcgactcggaccgatg

SEQ ID NO: 3658 - DNA, 203 bp, Homo sapiens
ggcgcgccagtccttgggtcatctaagcttttcagtcgagaaaaaaacagtagatcagaagaacaactggcaacacttctcatcctgagacctacttcaagatgctcgatcctggagaggtctatgatgaccctattgacccaatcgagttagaggctgaacccagaggaacccccactgtccccaaccgactcggaccgatg

SEQ ID NO: 3659 - DNA, 203 bp, Homo sapiens
ggcgcgccagtcctggacttgcataggccattacaaccatgtactaataaatgctattgcaaaaaatgctgttatcactgtgagctttgcttcctgcagaagggcttaggagtgcgttatcatgtctctaggaaaagaagaaaaacaagcactcaagataatcaagaccctatacggcagcagtaagtcgactcggaccgatg

SEQ ID NO: 3660 - DNA, 203 bp, Homo sapiens
ggcgcgccagtcctgctgcagcttgagaataaggacttggtgttacaacatctgcctgaccctcctcatattcatcaggacagcagtgggatacctgcagtatgggctccagcaactccaagaggcagcaacagggcttgctcaagctctggcgagggctgcgagggaagcctggggcagactgggtgcgactcggaccgatg

SEQ ID NO: 3661 - DNA, 203 bp, Homo sapiens
ggcgcgccagtcctgcaccgaccgctgagttgctgagcgtcggagagggacgactcaggtagggtgagagcctacgagttttttgctacctagtcagcgagaaaggctaggccgcgacaggggcgcgggtcccattagtggcaaccaacccagttggacgaagggttggtaggggacgggtcggagcacgactcggaccgatg

SEQ ID NO: 3662 - DNA, 203 bp, Homo sapiens
ggcgcgccagtccttgtttgtgttatatagacatcttggtgtattgtaacataatatgtggtagcctgtacggatcccacatagggggttgtatatcatatgttgttgttgtgtgtaccctagtgtgctattgtggcaccattctttttctatttttgtttttttttttacagttaaataaagcaacccgactcggaccgatg

SEQ ID NO: 3663 - DNA, 203 bp, Homo sapiens
ggcgcgccagtcctgttgttgttgtgtgtaccctagtgtgctattgtggcaccattctttttctatttttgtttttttttttacagttaaataaagcaaccatggtggcacaacgtgcaaggcgtcgcaagcgtgcatccgccacacagctttataggacctgcaaggcctcaggcacatgccccccacgactcggaccgatg

SEQ ID NO: 3664 - DNA, 203 bp, Homo sapiens
ggcgcgccagtcctagaaaaagacagacatcgtaacgaacggcgacgactgcacaaaatatcagggtactggagaggtagttgtgagtattgctggtcacgatgcagggtccgcatcccacagtaaaagatatcgaattgagtcttgcaccagaggatatccctgtatgcaatgtgcaattagatgaacgactcggaccgatg

SEQ ID NO: 3665 - DNA, 203 bp, Homo sapiens
ggcgcgccagtcctccacttcccctttgtcttctacactttccactaagtatggaaatgtaacaattccctttgtgtctcctgttgatgtaactttacatactgggcctgatattgtactacctacttcagcacagtggccatatgtgcccctgtcacctgctgacaccacccattatgtgtacatagcgactcggaccgatg

SEQ ID NO: 3666 - DNA, 203 bp, Homo sapiens
ggcgcgccagtcctctgggcctgatattgtactacctacttcagcacagtggccatatgtgcccctgtcacctgctgacaccacccattatgtgtacatagatggcggggatttctatctttggcctgttacctttcacttctcccgacatcgtcgccgtaaacgtgtctcatatttttttgcagatgcgactcggaccgatg

SEQ ID NO: 3667 - DNA, 203 bp, Homo sapiens
ggcgcgccagtccttagatggcggggatttctatctttggcctgttacctttcacttctcccgacatcgtcgccgtaaacgtgtctcatatttttttgcagatggcactctggcgctctagtgacaacttggtgtacctgcctcccactcccgtgtctaaagttctcagcacggacgactatgtgacacgactcggaccgatg

SEQ ID NO: 3668 - DNA, 203 bp, Homo sapiens
ggcgcgccagtcctgagtgcagccacgcagatataagggcactggaacagctgctactaggcacattgaagctcgtgtgtcctcgctgcgtgtaacaggacatggacgataatacaggtacagaggggggcgcatgttccgaatcggaacgggcgggtggatggtttatagtggaagccattgtagatcgactcggaccgatg

SEQ ID NO: 3669 - DNA, 203 bp, Homo sapiens
ggcgcgccagtccttttgcttattttttatacctgcttgttttttacatttttatactgtaatggtaattgctacttagtccctttaataaacgtgttacaatggtagctgtccgtgcccctcgacgcaaacgagcatcagctacagacttatacaaaacatgtaaggccgctggtacgtgccctcctcgactcggaccgatg

SEQ ID NO: 3670 - DNA, 203 bp, Homo sapiens
ggcgcgccagtcctccagacaagctggacaagaagtgtgttacagaattgaagcacaatgttgtatgtgtaatagtatagtgcagctagctgtgcagagcagtcgacagaacgttcgagtgctggagcagatgttaatggaagacgtgtccttggtgtgccatcagtgtgctgcacagtaaacctgcacgactcggaccgatg

SEQ ID NO: 3671 - DNA, 203 bp, Homo sapiens
ggcgcgccagtcctctacaaatattaatgtaggccctgacctttcacctcctgagtctccgccctttattagtacacgtcctgtatcaccttcttttgactctgttatggtattaggatgggattttatattgcatcccagttatatgtggcgtaagcgccgtaaacctgtaccatatttttttgcagcgactcggaccgatg

SEQ ID NO: 3672 - DNA, 203 bp, Homo sapiens
ggcgcgccagtcctacctataaaacaggacatacaacgttacagaatagtgtgtggttgtacacagtgtggacggtcagttaaacttgttgtcagtagtacaggcgcggacatacaacagctgcatcagatgcttctggacacactgggcattgtgtgtccattgtgtgcctgcgtggagtgactgcacgactcggaccgatg

SEQ ID NO: 3673 - DNA, 203 bp, Homo sapiens
ggcgcgccagtcctaggcgcggacatacaacagctgcatcagatgcttctggacacactgggcattgtgtgtccattgtgtgcctgcgtggagtgactgcaatggcggatgatacaggtacagaggaggggctagggtgttctggttggttttctgtagaagcaatagtagaaaggactacagaaaatcgactcggaccgatg

SEQ ID NO: 3674 - DNA, 203 bp, Homo sapiens
ggcgcgccagtcctgccctgatattgctttacctgtacctactgcagaaaccatttttaccccaactgtacctgtacagccttctggtcctatatatatatatgggtccgattttatattgcatcctagcttgtatgtcattccacgcaaacgtaaacgtttgtcatatttttttgcagatgtggcgacgactcggaccgatg

SEQ ID NO: 3675 - DNA, 203 bp, Homo sapiens
ggcgcgccagtcctgaaagtaacaatcctacttttatagacagggagtaaccgaaataggtttaggaccgaaaacggtacatataaaagcactgtgtacaacacccaggacatccatggatcgtcagttatttgaaaatacagaagagcgaccacgtacattgcaccagctatgtgaagttgtgaatacgactcggaccgatg

SEQ ID NO: 3676 - DNA, 203 bp, Homo sapiens
ggcgcgccagtccttacttttatagacagggagtaaccgaaataggtttaggaccgaaaacggtacatataaaagcactgtgtacaacacccaggacatccatggatcgtcagttatttgaaaatacagaagagcgaccacgtacattgcaccagctatgtgaagttgtgaataaaccattgctggagcgactcggaccgatg

SEQ ID NO: 3677 - DNA, 203 bp, Homo sapiens
ggcgcgccagtcctagggaggcaagtggcgggaaagagcaaaatggaggctcacaacatagtgtgtgtagcagagatgggagcatagggtcaggaagtgatatggatgtggatagacaggatataatgccactgcaacaaatacaagatatattaaaatgtagtaatgtgcaggccaagctatattgtcgactcggaccgatg

SEQ ID NO: 3678 - DNA, 203 bp, Homo sapiens
ggcgcgccagtcctaccaattaaataatgcaaactggaaatgtttttttgaaaggacatggtccagattagatttggataacgacgaagacaaggaaaacgatggagacgctatgccaacgtttagatgcgtgccaggagaaaattctagactgttttgaaagagatagcaaaaatattacagaccatcgactcggaccgatg

SEQ ID NO: 3679 - DNA, 203 bp, Homo sapiens
ggcgcgccagtccttacttatacttttattttggtttgttgtggcatcatcctacataaccacatttacactatatatactttttttttacttccctttattatgtttctatagccatgctgtgtggttaattaacacacaataaatcacagtttttttgtattgtatgtatttgtgtgttatatatacgactcggaccgatg

SEQ ID NO: 3680 - DNA, 203 bp, Homo sapiens
ggcgcgccagtccttatgtttctatagccatgctgtgtggttaattaacacacaataaatcacagtttttttgtattgtatgtatttgtgtgttatatataatggttgcccaccgggcacgcagacgtaagcgggcatcagcaacgcagctatatcaaacatgtaaacaatctggcacatgtcctgagcgactcggaccgatg

SEQ ID NO: 3681 - DNA, 203 bp, Homo sapiens
ggcgcgccagtccttagttatacagggctccacatttgcgttatggcctgtttattttttgaaacgtaggcgtcgtaaacgtattccctattttcttgcagatggcggtgtggcggcctagtgacagcaaggtttatctgcctcctacccctgtatcaaaggtcattacaacggatgcctatgtaaaacgactcggaccgatg

SEQ ID NO: 3682 - DNA, 203 bp, Homo sapiens
ggcgcgccagtcctacggtttcacaaaatttcacatatgtggaccgggtcgtgcctgacatgctggagacacacaacagcaactgaatcagcagtataatcatgcacggtaacgtaccaacacttccacaatatattatagaacttataccacaaactgagattgacctgcaatgccatgagcaattgcgactcggaccgatg

SEQ ID NO: 3683 - DNA, 203 bp, Homo sapiens
ggcgcgccagtccttagacgggacgaacaacatccttgttacctaattgaaacacagtgttgtaggtgtgagtcgttggtgcagttggctgttcagagttcaacaaaagagctgcgtattttacaacaaatgcttatgggcacagtggagcttgtgtgccccctctgcgcaacaaggcgataactgcacgactcggaccgatg

SEQ ID NO: 3684 - DNA, 203 bp, Homo sapiens
ggcgcgccagtccttgtttaataattgtacagttactaaagggcgtaaccgaaaagggtccgaccgaaaacggtacatataaaaaccaacccaaaaaacctgatctggggccactatgtctgcacgttgcggctccacagctagaactttatttgaattatgtgaccagtgcaatataacattgcctacgactcggaccgatg

SEQ ID NO: 3685 - DNA, 203 bp, Homo sapiens
ggcgcgccagtcctcattcttaacatctggtcctgacatagtgtttccttctgttcctgcaggtacaccatatttgcctgtgtcaccttctatacctgccatatctgtactgattcgcggtactgattattatttgaatcctgcatactatttcagaaaacgccgaaagcgcatattagcatattaggcgactcggaccgatg

SEQ ID NO: 3686 - DNA, 203 bp, Homo sapiens
ggcgcgccagtccttatctgtactgattcgcggtactgattattatttgaatcctgcatactatttcagaaaacgccgaaagcgcatattagcatattaggatgtggcaacttaatgaaaaccaagtgtatttaccaccgcccacgcctgttgctacaattgttagcacagatgagtacgtgcaacgccgactcggaccgatg

SEQ ID NO: 3687 - DNA, 203 bp, Homo sapiens
ggcgcgccagtcctggacttgcaagtaaatttgcaatcatttaaaatagtaacacattgtgtattttgtcactgtttagttcgcctagtagtccattgtactgctactgatataaggcaggttcatcagttgctgatgggcacactaaatatagtgtgccccaactgtgcagctacagcgtgacaacacgactcggaccgatg

SEQ ID NO: 3688 - DNA, 203 bp, Homo sapiens
ggcgcgccagtcctgaaatgttgatgatctgtaagctttactaacgctaacgctggcattgctactaacccatactaactaacaaacccatactaactaacatggttcgtgcaaaacgtactaaacgtgcctctgttacagatatatacagaggctgcaaagctgctggtacatgtccaccagatgtacgactcggaccgatg

SEQ ID NO: 3689 - DNA, 203 bp, Homo sapiens
ggcgcgccagtcctaacctgcagaggaggagcagtgtctcactccctacaagatcgtagctggctgtggttgcggtgcaagacttcgtttatacgtgcttgctacaaatttaggaattcgagcgcaacaggaacttttgctgggtgatatacaactggtgtgtccggagtgccgaggcagacttcgcccgactcggaccgatg

SEQ ID NO: 3690 - DNA, 203 bp, Homo sapiens
ggcgcgccagtcctcctaaattttcaatcatacacataataaccattttagtagcgttgcctttcagtacagtctaggtgattgttgaaagacttccaagcatggcagaattatcaacgcgttacaacttgcctgcaaatgttacggaaaatagtataaatcttgaccttaattccacagcacgatggcgactcggaccgatg

SEQ ID NO: 3691 - DNA, 203 bp, Homo sapiens
ggcgcgccagtcctttaatttctttaaatttgaccagaataatattttgtcagtgaatatattctcatatcacttgattaaaaacagaaaattaccctaacatgaagaccacatgtttccttatcagtcttatcttaattcaagggacaaaaaatctccccattttagagatagctagtaataatcaacgactcggaccgatg

SEQ ID NO: 3692 - DNA, 203 bp, Homo sapiens
ggcgcgccagtccttccggcccctgaatgtggctaaccttaaccctgcagccgttgcccataatccaatgggtttgcggtcgtaatgcgtaagtgcgggatgggaccaactactttgggtgtccgtgtttcctgtttttcttttgattgcattttatggtgacaatttatagtgtatagattgtcatccgactcggaccgatg

SEQ ID NO: 3693 - DNA, 203 bp, Homo sapiens
ggcgcgccagtcctggaacacccacctgctagccccgctgctctctttgctttcctcctcgcttcggtctcccccaactcctagcatcccctcctatcgctatggtctactccctctcgcgatgcgctctctgttcgctgaaggggtcctctggaggtgatttctctgttctactccgtgtggcttcccgactcggaccgatg

SEQ ID NO: 3694 - DNA, 203 bp, Homo sapiens
ggcgcgccagtcctttctgtgactatattatctttcatttttttgcaacttttgcttagtctgtaagttttgggtgctatttctgttactgcgagcccgtaatggaaacgacaaagaaccggcgtgtgcgatttactggaggccttcatgagccagcgcaagattctacgatgtgtgggaatgctgagcgactcggaccgatg

SEQ ID NO: 3695 - DNA, 203 bp, Homo sapiens
ggcgcgccagtcctgaatgacaaggctgcacagattatagagaccagccagatccgtaaattaatggtgtctacacgactggaggccataccagctctgtgatggagaacaggtttcagaacgatactctgttctcagagtggttcggtcagagtttgtccgatgtaagatttccggacaatgtcacccgactcggaccgatg

SEQ ID NO: 3696 - DNA, 203 bp, Homo sapiens
ggcgcgccagtccttatcagaagtgtttaatttaacccaaacgcaccccgaaaacagcgaaccgattttcgattcgaacattttctccccaaacccggagaatgaaatccttgaaaaaattaaaagaattagaaacctcagacgtattcaacatcttacacgtccgaactatcctaaaggtgatcaagcgactcggaccgatg

SEQ ID NO: 3697 - DNA, 203 bp, Homo sapiens
ggcgcgccagtcctggcaaaaaaggcagaggttgagcgaattcatcaatacctatgcacagagcatcagcaaattcgctgttgaactcggtttcgggatccatgatgtggcgaaaccaatcttccggcagacgcccctccaagcgtctttctgataacgaagccaccttatctacaatcaactctattcgactcggaccgatg

SEQ ID NO: 3698 - DNA, 203 bp, Homo sapiens
ggcgcgccagtccttcatttgtgttagatgagcggcaaatgactcatctttctgggatttatatgggaatattctggtaaaagtgcatgtatcaattttagtcgtttttggatttctgtaatgttacgatttgctatgtgtattttcatgatgtcgagcatgtttattttattttttacacagataagcgactcggaccgatg

SEQ ID NO: 3699 - DNA, 203 bp, Homo sapiens
ggcgcgccagtcctcgaatggacatttcgacaagtctttttccctactatatataagatgttgttcccgtcgtgttaacttttccaaataaaaaaataaccatggaacttttactatttgtaatgtcactcatattactaaccttctcaaaagcaatacctcttttcaaccataattctttctattttcgactcggaccgatg

SEQ ID NO: 3700 - DNA, 203 bp, Homo sapiens
ggcgcgccagtcctactgtctattaagcttcaattttataaacatgttttccagaacaaaaatgcaaacaaggaaatgataacgacgtcattcaaagcgccatgaaattatccggactatactgtgatgcggacatcacacacacacaaccgttgagtgataatacgcatcaagatcctatatattctcgactcggaccgatg

SEQ ID NO: 3701 - DNA, 203 bp, Homo sapiens
ggcgcgccagtcctgatgtgcagacatctagaggtgacaagccaggggaattaccttattttccgtatacaactataaaaaacttgggaggcgcaaacggtatgttttccataataaatccgagtgatgatttctggactaaggacaaatatatcatgttgactatcaaaggccccatggagtgggagcgactcggaccgatg

SEQ ID NO: 3702 - DNA, 203 bp, Homo sapiens
ggcgcgccagtcctaaccctagccataaccgcataactctgttcacaaccctaacactaatcctcgcatccgcacctaacgctgcccctctttcacaccatcaccccctgccgcttcaacttcaccttcttcctccatctcgccccgcttgtttctacacttgtccgcccctctattcttactctaggcgactcggaccgatg

SEQ ID NO: 3703 - DNA, 203 bp, Homo sapiens
ggcgcgccagtcctcaccccctgccgcttcaacttcaccttcttcctccatctcgccccgcttgtttctacacttgtccgcccctctattcttactctaggatgccgctaacggtgcgtgccgggcacgcgccatatcgtcttccgctctccaattattggtggctactcttgggtcgacattcccttcgactcggaccgatg

SEQ ID NO: 3704 - DNA, 203 bp, Homo sapiens
ggcgcgccagtcctccacccctccccgtcacagaccagcaaacaccttgccacatcgacatcgcgggcggcaaattaaaaaaaaaaataacataaatatagtgaaagagaggcccccgtcccacataaggacagaagaacaggcaaaaaaaaaaacccgtccgttattcacacagcattcggaaagcccgactcggaccgatg

SEQ ID NO: 3705 - DNA, 203 bp, Homo sapiens
ggcgcgccagtcctcaaacctcgcactccgtactttaagaaggaaacctccatcgttccggcttctgtattgcactcctcggatttcgatttagaaaacagctgtacgactgtcttccataactttctaacagccatatcggcagatccacttcagagaaaacgaactcgaaacaccactaaaaacagcgactcggaccgatg

SEQ ID NO: 3706 - DNA, 203 bp, Homo sapiens
ggcgcgccagtcctcggtttacctttttgctgttgtggttctttgttcttgctggtttgctttggatccgttgtttaatatgtgggcgtaacccttcgacgttgtggtatgacggcgatcttatattaaagatcgcctcgctggacttagtggacgctagtgatcacaaaagagaaggaaaacccagccgactcggaccgatg

SEQ ID NO: 3707 - DNA, 203 bp, Homo sapiens
ggcgcgccagtcctggcgggattagttttatcggggcgttcgtaattctgatagtcattttgtgtaattggtataagaaagacaagcagaggtctttgttttgggatgaagagaaaaaaccggatgtacaaatgaggagggatgtaaagacttgcagatgaggttctcatagattgttattagtgattcgactcggaccgatg

SEQ ID NO: 3708 - DNA, 203 bp, Homo sapiens
ggcgcgccagtcctcgacggaagtgcgttggcatcaaaacaggaaatgcaatataaaataaccaactacatggtccccgctaaaaacggaactgcgggctctagcttatttaacgagaaggaagatagcgaaagtgacgattccatgcattttgactacagctctaatcccaatcccaagaggcagagcgactcggaccgatg

SEQ ID NO: 3709 - DNA, 203 bp, Homo sapiens
ggcgcgccagtcctaataccgcatactgtctgatgaggtcaaagtgatattttttcggggttagtcgattaataaaagctattactctgttgtgtgttacgctatcggctgccagggataaaagttcgatttttgccgtagcggctagtaatgattctggagacgtgctgtttttgagtgaactaaggcgactcggaccgatg

SEQ ID NO: 3710 - DNA, 203 bp, Homo sapiens
ggcgcgccagtcctttcctttctttttctacaacattatttaaggttccctcatcgatagatatatattttctcttcttcacagcttccacagtatccacaatggcagctcgtgcactcgatttagagttcatccttagttcactcaaaaacagcacgtctccagaatcattactagccgctacggcacgactcggaccgatg

SEQ ID NO: 3711 - DNA, 203 bp, Homo sapiens
ggcgcgccagtcctgcgggaaagttgtaaataaagcttctgcggttgtgacatcacaggagagtataaagcagttctatgaaaaagagaagtcattactgtccggtgtgaagttttggagactaagtgaaagacattgtcggtttgcgcttgtcggcatctgttttcttttagccttgtatttttgttcgactcggaccgatg

SEQ ID NO: 3712 - DNA, 203 bp, Homo sapiens
ggcgcgccagtccttaactaatctgcagtcggtattcgagacggtgtcttcaaacgatgctccggtctatgacttttctgaaattctagcggaggaggacgatcaaggaaacggtgtattaaaatgtgatgaaacggaaaccgaaacagatgagccgatgactaagaaaaaccgattataatcggagtcgactcggaccgatg

SEQ ID NO: 3713 - DNA, 203 bp, Homo sapiens
ggcgcgccagtcctttatatttaacaataatcggaaagattaaatgttcactgggacttctacataggatactaaaaattacgttggcggcatcgtattcagtcgcaaacactacgatggtcattgtgtagagctctgttgattacagatgaatttagctttaaatgtccttggggtattggggtgttcgactcggaccgatg

SEQ ID NO: 3714 - DNA, 203 bp, Homo sapiens
ggcgcgccagtccttggagaataaaagtccacttccgtagcggccgcaaaaacaagaatgtaaaagaggcagagactgacatataagctttgccttgcgcttttcttacaactcatcttaagcgttattttcaactagtcttcgcgtcgacgtgattaacagcagacagctctctgtcacctggaaaacgactcggaccgatg

SEQ ID NO: 3715 - DNA, 203 bp, Homo sapiens
ggcgcgccagtcctagcatgtcgggtgagttgaccacaatgaatttgtacaagtagaatgtgtgactaaaatagtatttgctttttttataggattggacgatgacctccaaatgcatgctgtgttggaccgcgattacgaatgccctggctattttaatgttattactagtaatttaccgggcgatacgactcggaccgatg

SEQ ID NO: 3716 - DNA, 203 bp, Homo sapiens
ggcgcgccagtcctataacgtcgggaatgtgtcagttcaacgctgtcttttttccctaacagtcgtagtatccttaacgcgatcgtagacgtttatgcgagactgccggtaacgctgtcgttatcgttatattttttatttttgttttccatttttaattttatctcggattccgcacagaaaataaacgactcggaccgatg

SEQ ID NO: 3717 - DNA, 203 bp, Homo sapiens
ggcgcgccagtcctactgccggtaacgctgtcgttatcgttatattttttatttttgttttccatttttaattttatctcggattccgcacagaaaataaaatgttttgtggctctccgtttctcggcatatcttcttggagtctggcatctgcggctctgtgtcctccttcgtgctctttctctgcgcgactcggaccgatg

SEQ ID NO: 3718 - DNA, 203 bp, Homo sapiens
ggcgcgccagtcctccatccgtcatacaaaatgacctcatcccttaaaaaaacacagtatttaaaaagggagatgaaacataaaatgttttttgtaccagcatgttttctcctcaactaaaccatgtcttgcaactcgtttttgattgcaatcacatagtttcgaattcttaccaagaaatcattttgcgactcggaccgatg

SEQ ID NO: 3719 - DNA, 203 bp, Homo sapiens
ggcgcgccagtcctttcagcaagtaactgagaggtgggaagctcaaagccaaagtcctaatgtgcagtcaggtgaatttattgaaaaatttgaggctcctggtggtgcaaatcaaagaactgctcctcagtggatgttgcctttacttctaggcctgtacggaagtgttacttctgctctaaaagcttcgactcggaccgatg

SEQ ID NO: 3720 - DNA, 203 bp, Homo sapiens
ggcgcgccagtcctaccctaactgacacacattccacagctggttctttccgcctcagaaggtacctaaccaagttcctctttcagaggttatttcaggccatggtgctgcgccggctgtcacgccaggcctccgttaaggttcgtaggtcatggactgaaagtaaaaaaacagctcaacgcctttttcgactcggaccgatg

SEQ ID NO: 3721 - DNA, 203 bp, Homo sapiens
ggcgcgccagtcctcgggaaacgcaaaaaaccagaaaggttaactgaaaaaccagaaagttaactggtaagtttagtctttttgtcttttatttcaggtccatgggtgctgctttaacactgttgggggacctaattgctactgtgtctgaagctgctgctgctactggattttcagtagctgaaattcgactcggaccgatg

SEQ ID NO: 3722 - DNA, 203 bp, Homo sapiens
ggcgcgccagtcctagattttcttgcacgtgcatgcgtttgcttcggacagcattagcagcggttggtttgaaagagatattcttttgtttctaccagtcgtgaacgtgttgagaaaaagacagcttaggagaacaagagctggggatggtcaagaaggccatcctgaaaggtaaggggggcggtccccgactcggaccgatg

SEQ ID NO: 3723 - DNA, 203 bp, Homo sapiens
ggcgcgccagtcctctgaatttggaatacgttgttttgagcaactgttactgaaagagctttgtttattttgtcctgcgtgctccagacaacttccccgcaatggcagatcataaaggtactgataatattgatcataatgatgttttagatgggtcttggtgtttaataactgaagctgaatgtgagcgactcggaccgatg

SEQ ID NO: 3724 - DNA, 203 bp, Homo sapiens
ggcgcgccagtcctaagcttacttgctatctgatttgattggtagacctttgagtgaaatcgcaattcgctgtgaaaattgtatgtgtttgttggattatattgaaaagtacgattgtatttgtcacggtggttattttcatttagttagaggtaattggaggggctgttgtagaaattgttacgaaccgactcggaccgatg

SEQ ID NO: 3725 - DNA, 203 bp, Homo sapiens
ggcgcgccagtcctacatagcagaatctgaaaggtcaccattcaagattgattctacgtgtaagcattgtcattgtcgcgttagactgtgttgtgtcgccaccgacgcagctatccgtgtgtttgagtgccttcttcaatcagaattttcttttctgtgtcttaagtgctccaaagaattgctacgaacgactcggaccgatg

SEQ ID NO: 3726 - DNA, 203 bp, Homo sapiens
ggcgcgccagtcctcagctttgcaagtatcagagtacaaagccaagcaggcaatcgaaatgggattgttattaaccagtttaagcaaatcccaatatgcttcagaactatggggtttaacagatacaagtgcagaattgttattaacccctccaagaaatacatttaaaaagaagggatatactgtaacgactcggaccgatg

SEQ ID NO: 3727 - DNA, 203 bp, Homo sapiens
ggcgcgccagtcctttttatgaaattagtaactttgccaagaggttgtacatatacatttggaacattaaactctttgtaatatttgtaaaacaaaacaaaatgtatgctagagtaaagcgtgttaaaagagactctgttgaaaacttatataaacaatgtcaacttggtgctgactgccctcctgatcgactcggaccgatg

SEQ ID NO: 3728 - DNA, 203 bp, Homo sapiens
ggcgcgccagtcctaggagaagtattagaagttctaactcgtattcctttgagttctctttctgtacgctgttttgattgccttacattgttatcttttgcagaaaaaatagattgtataattagtggtcaaaacttttatcttgtaaggggtcgctggagatcatattgtagaaattgcattgagaacgactcggaccgatg

SEQ ID NO: 3729 - DNA, 203 bp, Homo sapiens
ggcgcgccagtccttagatgtttatgatgacttttatttacatcctcatcttcttaggcgacgcaaacgaaaacggttggattttttttaatgttttacagatggctctttggttgcagacagctggacaattgtatcttccaccaagcaagcctgttgctcgtgtactcagtacggatgaatatgtacgactcggaccgatg

SEQ ID NO: 3730 - DNA, 203 bp, Homo sapiens
ggcgcgccagtcctctccttctgctgtaataactcttcgtcaactattgcttcaagaagtgttcctgacctgtttgaggtgctccagatccctttttcgacatggcagatcctaataaaggtattaattctcttgaattaaatgaggggcatagcgaatggtatgttgtgacagaagctgagtgtattcgactcggaccgatg

SEQ ID NO: 3731 - DNA, 203 bp, Homo sapiens
ggcgcgccagtcctttcaagaagttacccaaaggctagatttaaaaaccccaaatgtgcaatctggtgaatttatagaaagaagtattgcaccaggaggtgcaaatcaaagatctgctcctcaatggatgttgcctttacttttagggttgtacgggactgtaacacctgctcttgaagcatatgaagcgactcggaccgatg

SEQ ID NO: 3732 - DNA, 203 bp, Homo sapiens
ggcgcgccagtcctcacaaggctgtatatataaaaaaaagggaagggatggctgccagccaagcatgagctcatacctagggagccaaccagctaacagccagtaaacaaagcacaaggggaagtggaaagcagccaagggaacatgttttgcgagccagagctgttttggcttgtcaccagctggcccgactcggaccgatg

SEQ ID NO: 3733 - DNA, 203 bp, Homo sapiens
ggcgcgccagtcctggtagtgctattgctcagttgggatatagattttttgctgactgggatcataaagtttcaacagttgggctttttcagcagccagctatggctttacaattatttaatccagaagactactatgatattttatttcctggagtgaatgcctttgttaacaatattcactatttacgactcggaccgatg

SEQ ID NO: 3734 - DNA, 203 bp, Homo sapiens
ggcgcgccagtcctccccaccgctctcaaagttgacggcatctctgcgtggatacacgccgctcacgtaaaggcggcgacaactcctccggccggagcagcatggaaggtccagcgttctcaaaaccccttaaagataagattaacccgtggggccccctaatagttatagggatcttggtgagggcacgactcggaccgatg

SEQ ID NO: 3735 - DNA, 203 bp, Homo sapiens
ggcgcgccagtccttagccggcgagttgacaaggaccagtgggggccgggggcttggagagggactccaagtcccgcccttcccggtgggccgggaaatgcatggggccacccagctccgcggcggcctgcagccggggtagcccaagaatccttcgggtgagggcgggtggcatttcctttttctatcgactcggaccgatg

SEQ ID NO: 3736 - DNA, 203 bp, Homo sapiens
ggcgcgccagtcctttctttgacaaaaatgttaaaggatcaaaagctgcagctgaaagcgcaaaggaaaaatgctgctcagctagaatgtgtagatttggatgacattttggatacggcagcggaagtgaaatccgtcaccgacaatataaaagaaactttactggccggattagaatcagactaaatcgactcggaccgatg

SEQ ID NO: 3737 - DNA, 203 bp, Homo sapiens
ggcgcgccagtcctaagtggcaatccaacaaattttgtccaaaccattccaaaaataattgatcattttgaagctgagtttccatttgacagatccccacaatggcattgagcagagtagatgtgattaatatgagaatttgggtcttaagtataatctgtgcttgtttaacgtatgtcaacgtcacacgactcggaccgatg

SEQ ID NO: 3738 - DNA, 203 bp, Homo sapiens
ggcgcgccagtcctaaatagaaactttacttgacatgtggcacgtatcaagaaccaatctgaaaacctacaaagagttacgtaaggctctgacagaagcttcaaaaaaaagacaaagaaaaaaaatttataaattactaggtcacaatataagttcttatatcagtgaaactggttgtctcttccagccgactcggaccgatg

SEQ ID NO: 3739 - DNA, 203 bp, Homo sapiens
ggcgcgccagtcctcccgttaattcaagaaatggaaaaatataatgaagtgcttccattccgaagcgagttttcgaatttgctcattagaacttactgacgcatgctttatagatcgctcaacttatgtgtcacgtgttcaggcaacattaataaaaagcccatgaacactgcttctcccattcaatacgactcggaccgatg

SEQ ID NO: 3740 - DNA, 203 bp, Homo sapiens
ggcgcgccagtcctcatgctttatagatcgctcaacttatgtgtcacgtgttcaggcaacattaataaaaagcccatgaacactgcttctcccattcaataatggcattactacagtggatgctggaaaacatttcagatgacaactcaataaaaatgtctcttgaagaacaacatgaaacgtttcaacgactcggaccgatg

SEQ ID NO: 3741 - DNA, 203 bp, Homo sapiens
ggcgcgccagtcctctgcttttcgttataatagcttcaacccttctgtgtaaactaggaactcatcaacattgaaaattttgaaagcttcagtacttgaatatgaggggcaaaaaacgtaaaactgtttgtaaggccaaaggtaaactcacttctaaaagctgcatgtgtactaaagccaatgctcgacgactcggaccgatg

SEQ ID NO: 3742 - DNA, 203 bp, Homo sapiens
ggcgcgccagtccttgacgacggaaacatgtgagtttttactgtatgggacaatacttttcgtcttagaaacaaactcatttcttaatttctcgttcgcagcatatatcaggccggaggtattacatactgcactcctatatatacgagtacaacaatcatacatgaaattaaacctacgcctaacaacgactcggaccgatg

SEQ ID NO: 3743 - DNA, 203 bp, Homo sapiens
ggcgcgccagtccttgacctactgggagcgccgccaaatctgttttgccccgcccctgcgcgcgcgggaactgtcggcgccgcgctgctgctagcccgccttccagagctccctccctccgtctgcctcctcacccttgccactcacccttccatctcttctatcacagactctgtgttacaccacctcgactcggaccgatg

SEQ ID NO: 3744 - DNA, 203 bp, Homo sapiens
ggcgcgccagtccttccagagctccctccctccgtctgcctcctcacccttgccactcacccttccatctcttctatcacagactctgtgttacaccacctatgactgctgcaaccacagaacattttgctctccgcgcggcactcaatcgttactggtggctgcttctgggacgacacaagctcagtcgactcggaccgatg

SEQ ID NO: 3745 - DNA, 203 bp, Homo sapiens
ggcgcgccagtcctctgtagagacacttcctttaagtagaccttagagacacaccaaatacaaccacaaccaaaaaaaaaacagaaaacaacacaaagccaatgagtgcagaaatgctccgcgctgttcagctccagccaagacgccggggacattcctcatctcccacttcccctccactcgaaggacgactcggaccgatg

SEQ ID NO: 3746 - DNA, 203 bp, Homo sapiens
ggcgcgccagtcctcatttttagcaaagctgtagcaaatcataacattagattatcataccaggattttttggaaatcaattagagtgtccatgtcggcagcgcatgtatctaatcaaagagaaaatagagactattaaactaattttttaagaagtgttcaataatgctcaacagaaaaaacgagtccgactcggaccgatg

SEQ ID NO: 3747 - DNA, 203 bp, Homo sapiens
ggcgcgccagtcctcttaagcataaagcgacgtcatgcttcagtaatatataaaaacctagtcacaactgctgttttcataagcttagagtgtgcttcaacatggccgaaagtgaacaaaaagttcgatttaggcatgcactcgcaaatttaagccttgttaaacaagccttttatcgcgattctcttcgactcggaccgatg

SEQ ID NO: 3748 - DNA, 203 bp, Homo sapiens
ggcgcgccagtcctcaacacaattttcacatctagagtatcttttcaaaggaaaaatttcttcggggtatgtatggcaatgcattggaaaaatgctgcaatgttcatcaatagttaattgtgttttttttgttttatagaagtaccgtggactttcttgaagaaattgtgaagtctttataaaggacccgactcggaccgatg

SEQ ID NO: 3749 - DNA, 203 bp, Homo sapiens
ggcgcgccagtccttcggttatcttatgtctgattcttattctacacatcttcaatgttcgatatgggggtacgaagccctgaattttacaccgattccagcacttttttgcgttgcttaaaaacagtaatttagtcggcacacgtacaatattaaactaggcttcttctaattgcgcagtgtttaaacgactcggaccgatg

SEQ ID NO: 3750 - DNA, 203 bp, Homo sapiens
ggcgcgccagtcctatgttttataagtacaaccattttttcccagagacctatgaagattgttggaaagggatttattatttgtttgttctgtttattttggcttgcattgcatatcatgattatataagtccttcaatagcagagaatatgttatcatttatcaggtgctctaaatatccctagaagcgactcggaccgatg

SEQ ID NO: 3751 - DNA, 203 bp, Homo sapiens
ggcgcgccagtcctttgatttgctgagtggtttttctgatggtgtggtgatgagtactatgcatgtatttcagtgatgtaataaaaatttggcgccaaaaaaacacagtatataatggtttgaatatctctgtgattttttagtattctcatacaactcttcctgttaatatctatttttggtgcagccgactcggaccgatg

SEQ ID NO: 3752 - DNA, 203 bp, Homo sapiens
ggcgcgccagtcctcagtattcccagttactgttcctatttttgcacggagaaataatattctttgtggttttttggttgccgccttactaattgtatgctatgtcatctttaaggaatttgctttgtcggctgatttctccgctgtgtaaacatggttcgtacagtcatttgcagttatttcttattcgactcggaccgatg

SEQ ID NO: 3753 - DNA, 203 bp, Homo sapiens
ggcgcgccagtcctcttgaatctaagtgtgcatataaaagaatttcattaaaaagttctgagttcatagaaaaggaatcggagttccatcccttataagccatgtctaacgacaatgccaaaacagatatagaaattctttatgaacaattatcttcccgagttgaaattgaaatagcttttctccctcgactcggaccgatg

SEQ ID NO: 3754 - DNA, 203 bp, Homo sapiens
ggcgcgccagtcctttgaaaaacatgtttggttagccattcatttttttaaagcatttcaggtttcaaaattaaaccacaaaaataaaacgcttatatctgatttcttaaaggatttcacacagctcttagcagatcaaaactttgaaattgtcgatcctacatttaccattcattattacgtttagccgactcggaccgatg

SEQ ID NO: 3755 - DNA, 203 bp, Homo sapiens
ggcgcgccagtccttaaaaaccacagaggcgtcaccgctacacgagacaaaaataatataaaaggccgtttatgaacaaggttctcattttcgacagaaacatgtatccacgcggggttaaaaagaatgtattagggcggcaacgatatggtttgaaaaccattaaacgaactcttgttcataaacctcgactcggaccgatg

SEQ ID NO: 3756 - DNA, 203 bp, Homo sapiens
ggcgcgccagtcctttgatggtttatatttaacgattattggaaaaattaaatgttcactagggttcttacataagatatttactatcacgtgcgcggggtcatattccgttgcaaacacagtaatagtcattgtgaatgtctttcagtttatcttccaacagcttttaatataagacaataggaatccgactcggaccgatg

SEQ ID NO: 3757 - DNA, 203 bp, Homo sapiens
ggcgcgccagtcctactgtgcctataacggcattttcattgtggtttatattcaatggaatattcaaaccatttccggaattgatttcttcttgtatcgtcctccttggcagataaaagttatcatttatatcattatcatcatacacacataggaagcctgccactagcacagtttccattattacgcgactcggaccgatg

SEQ ID NO: 3758 - DNA, 203 bp, Homo sapiens
ggcgcgccagtccttcacaagatgattgcgcagtccatgcaccagatttgataagtacgatttgctcgacaacgcacacaacgcatcacgacctagtcagaatgaatggctcagctactggcaactcagctagtcttcccgctcctcagttttccgaatgtgtttttttaccgaaagatacattttgccgactcggaccgatg

SEQ ID NO: 3759 - DNA, 203 bp, Homo sapiens
ggcgcgccagtcctagactctctcccaattttgacagttcatcccatgacagactttccctacgaacaaatacaagagacagaaaacattagacataactctatgaacataacaccccgcttcaaacgtatgcaattgtaatatcaactatttaagtattttacaacaataaaagatttaaagtaagacgactcggaccgatg

SEQ ID NO: 3760 - DNA, 203 bp, Homo sapiens
ggcgcgccagtcctaaattaaaacggttttcaccatgattaaccaaatcaattcccttacacaagaaaaaacgtttttcattgtggctgatgtttctgctgacaataggctggcaacttgtatatttaaagagtgaataaaaagttctttgaaatagtgtctgttgtaacagattttatttcagctcccgactcggaccgatg

SEQ ID NO: 3761 - DNA, 203 bp, Homo sapiens
ggcgcgccagtcctaactggatcatttgggtcgaaacgcaaacgctttaaccgttttacgttttattgtagaaaatggttattataaaaggaagacaatttttcgcaaacttttgaagtatttagctactacatcttttaatgctcatgttcaaactgaaagtaatcgtttactcaacttgatgcacacgactcggaccgatg

SEQ ID NO: 3762 - DNA, 203 bp, Homo sapiens
ggcgcgccagtcctaaactctgagggaaataaaggaagaagccttaagacattttgatccccgcttgctaattgctcttggctactatatccataatagacatggagacacccttgaaggcgccagagagctcattaaaaccctacaacgagccctcttcgtgcacttcagagcgggatgtaaccgctcgactcggaccgatg

SEQ ID NO: 3763 - DNA, 203 bp, Homo sapiens
ggcgcgccagtcctcttggccaataaactatgtgcagttcctgatccacctactgactcgcctcttgatcgggctatacaacatctgcagagacttactatccaagaactccccgacccgccgactgatctcccagagtctaacagcaatcagggactggctgagacttaaggcggcccaactgcaatcgactcggaccgatg

SEQ ID NO: 3764 - DNA, 203 bp, Homo sapiens
ggcgcgccagtcctcagccaggagccttttcttcataaagagattcgagaaacgaagcgtcaaccccggggagaaacgacaggaggaagcgcgcctggaacatgaagctggttcttctgttcagcctcagcgttctacttgggtgagttcgttctaatctatttatcggaaagaatacaaggctacaacgactcggaccgatg

SEQ ID NO: 3765 - DNA, 203 bp, Homo sapiens
ggcgcgccagtcctgtgcaaaatataaagttctcagagcaggaccaccaatgggcgtaggacgatcggctgaagggccctgccaaaaactacaggtagaccatgtgggacctttgggacctggtacccatggatacaggtacctcacaaccatggttgatgtgtacacaggttggttctgggccaaaccgactcggaccgatg

SEQ ID NO: 3766 - DNA, 203 bp, Homo sapiens
ggcgcgccagtcctatggggtaaatagacattagttagagttcaatcaatctcaacaaccatttataccgccaattcaatacatatactataaatcttaaaatgggaaatacatccatcacaatagaattcacaagcaaattttggccctattttacactaatacatatgatcttaactctaatctctcgactcggaccgatg

SEQ ID NO: 3767 - DNA, 203 bp, Homo sapiens
ggcgcgccagtcctttaactcatagttacataaaaacctcaagtatcacaatcaaacactaaatcaacacatcattcacaaaattaacagctggggcaaatatgtcgcgaagaaatccttgtaaatttgagattagaggtcattgcttgaatggtagaagatgtcactacagtcataattactttgaacgactcggaccgatg

SEQ ID NO: 3768 - DNA, 203 bp, Homo sapiens
ggcgcgccagtccttaatacaagtatatgataagtaatcagcaatcagacaatggacaaaaggaaaatataaaaaacttaggagcaaagcgtgctcggaaaatggacactgaatctaacaatggcactgtatctgacatactctatcctgagtgtcaccttaactctcctatcgttaaaggtaaaatacgactcggaccgatg

SEQ ID NO: 3769 - DNA, 203 bp, Homo sapiens
ggcgcgccagtcctcccttgttggagcggtcgcgttttctctgttcccgtcgtgccggttcctaccccccgctccctgggaccgccccctaccccccacctccccgtttgggcctcccccctcgcaccacccctttcctcgtccgtctgcggggagggcgtgtgtaaaaaatcgggcctccggccacccgactcggaccgatg

SEQ ID NO: 3770 - DNA, 203 bp, Homo sapiens
ggcgcgccagtcctccccgtttgggcctcccccctcgcaccacccctttcctcgtccgtctgcggggagggcgtgtgtaaaaaatcgggcctccggccaccatgtccgtgcgcgggcatgccgtacgccggacgcgcgcctccacccggtcccatgccccgtccgcgcatcgcgccgactcgcccgtgcgactcggaccgatg

SEQ ID NO: 3771 - DNA, 203 bp, Homo sapiens
ggcgcgccagtcctggacgcgagatgtcagtcctcggggacgcacggcacccccggcgattcccttcgcgagggccccggcctttttctgtcgcgggtcccggatccctccccccctctccgccgccgggcgctcgggcacgtctcattcgcctctcgagatcgttattcccggacccaaccgccccccgactcggaccgatg

SEQ ID NO: 3772 - DNA, 203 bp, Homo sapiens
ggcgcgccagtcctaacccgcagggagccactcccgcggcccccgtgggttacgcaggccctcgctgctctcccgtaccccgccggtctccctctttccctccctcgccgccttccgacgctctctgcctccttcgccgacgccttccctgtgatccgcacgggcgtccccggtgtctccgatagacccgactcggaccgatg

SEQ ID NO: 3773 - DNA, 203 bp, Homo sapiens
ggcgcgccagtcctggctccccgggcacgcccgcgacgagcgcgacgaacaacagcaccacccagcggcccagtcttgcgggtttccccgtcatcgcggcgatgagtcagtgggggcccagggcgatccttgtccagacggacagcaccaaccggaatgccgatggggactggcaagcggccgtagctcgactcggaccgatg

SEQ ID NO: 3774 - DNA, 203 bp, Homo sapiens
ggcgcgccagtccttcgcagtcttccgtccccatcgcccctgcgaacccggagggggtggggtgggggaaagccggcgcagagccgcgcgcgtgttccgggatggcgtccctgctcggggtgctgtgcggttggggaacgcgccccgaggaacaacaatatgagatgattcgggccgcggctccgccccgactcggaccgatg

SEQ ID NO: 3775 - DNA, 203 bp, Homo sapiens
ggcgcgccagtcctaccccgagcagggacgccatcccggaacacgcgcgcggctctgcgccggctttcccccaccccaccccctccgggttcgcaggggcgatggggacggaagactgcgatcacgaagggcggtcggttgcggctcccgtggaggttacggcgctgtatgcgaccgacgggtgcgttcgactcggaccgatg

SEQ ID NO: 3776 - DNA, 203 bp, Homo sapiens
ggcgcgccagtcctctcaagttttctcacccgtcgcccctctccaaggtcccgtttgggacgtgccagcatttcctcgccgcgaatcgctacctcgaaacccgggacattatgccgatcgactggtcggtataagatgccgacatccggggtcttgatttacgagggggcaattaataaagactgttgcgactcggaccgatg

SEQ ID NO: 3777 - DNA, 203 bp, Homo sapiens
ggcgcgccagtcctataaatgtggggccccggcccggcccgcttcatagcgcgtccaggaactcacggcagacgcgtattcaccgacccccccctcgcaacatgacaacgacgcccctctcgaacctgtttttacgggccccggacatcacccacgtcgcccccccgtactgtctgaatgccacgtggcgactcggaccgatg

SEQ ID NO: 3778 - DNA, 203 bp, Homo sapiens
ggcgcgccagtccttaattagcaacccctggggctataaaaggcgcggtctgtgcacggggacctcggttgggcgacgtctgcggtctagtggtcggcgtggggaccggctgtgtggtgggtgggggaggcacgttggactacgaccgaccacacgacatgcaggcttctgagccgcgaatccccacccgactcggaccgatg

SEQ ID NO: 3779 - DNA, 203 bp, Homo sapiens
ggcgcgccagtcctctgcacatgaatctaaacccgctccgggagcgccacgaacgcgatgacgtcattagcgagcacatactatctgctctacgcgatccgaatgtggtcattgtctattaaccctccattccctcgcgttcccaccgcacccgggccgggtgacattcacccccacccccccgagaccgactcggaccgatg

SEQ ID NO: 3780 - DNA, 203 bp, Homo sapiens
ggcgcgccagtccttgccgccgccccttaagagggcccgcaacacggcccgggctgcgcacgccagccgggacgggtgagttcgctaggcaagcacggactggcggttacacgtgcatgcgtgccgagtgaactctcccgccccgacgcgctccggctccgggcctacgccgagcccagccgcccgcccgactcggaccgatg

SEQ ID NO: 3781 - DNA, 203 bp, Homo sapiens
ggcgcgccagtccttcccaacatccgcgctttctcgcaggccgggcgccgccttcgtggacgggacaccggtgtggtaactggcgacaaggcgttgccactatggcagacatccccccggacccgcccgcgctcaacacgacgcctgcgaatcatgctcccccatccccacccccgggttcacggaagcgactcggaccgatg

SEQ ID NO: 3782 - DNA, 203 bp, Homo sapiens
ggcgcgccagtcctggggggtgtgtcgacaaactgccgcttcttaaaacaccggggcccgtcgctcggggtgctcgttggttggcacgcgcgacgcggcaaatggcctgtcgtaagttctgtggggtctaccgtagacccgacaagagacaggaggcgtccgtcccgccggagacaaacacggccccgcgactcggaccgatg

SEQ ID NO: 3783 - DNA, 203 bp, Homo sapiens
ggcgcgccagtccttaaaacccggggtcggtgtggtgttcggtcataagctgcattgcgaacgactagtcgccgtttttcgtgtgcatcgcgtatcacggcatggggcgtttgacctccggcgtcgggacggcggccctgctagttgtcgcggtgggactccgcgtcgtctgcgccaaatacgccttacgactcggaccgatg

SEQ ID NO: 3784 - DNA, 203 bp, Homo sapiens
ggcgcgccagtcctctggccccttgatacgatctcgtcgaccggggactcccctctacccccacccaaccagcgcgccggcgcttagggtgtgacccccccatggcatccggggtttccccggcccacccccaaaccccggttggggcgggcagccgagacctttccttaaaaggcaccccatccgaccgactcggaccgatg

SEQ ID NO: 3785 - DNA, 203 bp, Homo sapiens
ggcgcgccagtcctagctgctgctgcgagagctctcggatgcgtgcgatgattggttggaccccgtgcatggacgtaaaatttaaaaacgcctcgtccctgaaccgcacggcgggtctggccccgggctgctgtgggggcggacctggtgcccggacgtcccgcgagccctccccgccggacgccgcccgactcggaccgatg

SEQ ID NO: 3786 - DNA, 203 bp, Homo sapiens
ggcgcgccagtcctgcttgcgcacgcacgcctccggcgcccagcccaacactgacatcattctcgaggcggctctgtcggagcttcccaccgaggcctggcccatgatgcagggggcggtgaactttagcaccctataagtctggggccgcgctcgttcgatacacggcaacccccgggcgtcgtggccgactcggaccgatg

SEQ ID NO: 3787 - DNA, 203 bp, Homo sapiens
ggcgcgccagtcctccatgatgcagggggcggtgaactttagcaccctataagtctggggccgcgctcgttcgatacacggcaacccccgggcgtcgtggcatggaagcccccggcatcgtttgggtggaggagagcgtcagcgccattaccctatacgcggtatggctgcccccgcgcacgcgcgaccgactcggaccgatg

SEQ ID NO: 3788 - DNA, 203 bp, Homo sapiens
ggcgcgccagtccttacgtggccagcaggctctgcgtgtccaaccggagggggacggctacacccccgcgcacctcgaccgtggcgttcgccttcgcataagaggtcgcgggggcgtaaaggcagggaaacctgtcccggaacacagaggccagcaccaggagccccacgacgcagatggccgagacgcgactcggaccgatg

SEQ ID NO: 3789 - DNA, 203 bp, Homo sapiens
ggcgcgccagtcctgaggtcgcgggggcgtaaaggcagggaaacctgtcccggaacacagaggccagcaccaggagccccacgacgcagatggccgagacgatgaacgtcgccacctgcacacaccagacccaccacgccgcccgcgccccgggcgcgacgtcggcgcccggcgcggcctcgggggatcgactcggaccgatg

SEQ ID NO: 3790 - DNA, 203 bp, Homo sapiens
ggcgcgccagtcctataggcgccgggtataaggcagccccgtgtgacggtcgggccgcattcgcaccccggcactgcgagcgacggagcggcggcccggcgggaggaggagacccggagagacagagactaaaacccggcaagagagagaccgcgggccgccgtctcgagtctaccctaccccggctccgactcggaccgatg

SEQ ID NO: 3791 - DNA, 203 bp, Homo sapiens
ggcgcgccagtcctagtgtataaattaccagcgcacgcacaaggccgtcctgtcgtcggtgtcgctgccgcccgagctgaggccgctgctggtgctggtctcccgcctctgtcacgccaacccggccgcgcgccactctctgtcgtgaggatcccttccgccctcgagctcttcggctgctcgtaaaacgactcggaccgatg

SEQ ID NO: 3792 - DNA, 203 bp, Homo sapiens
ggcgcgccagtcctgcgcccgcgggccccgaggacgcgcacacgcaccccccacccacgccccttccggcaccgggaagggctcgcaccgccggccgggccatgaacgcgcactttgccaacgaggtccaatacgatctcacccgggacccgagcagccccgcctcgctgattcacgtcatcatctcccgactcggaccgatg

SEQ ID NO: 3793 - DNA, 203 bp, Homo sapiens
ggcgcgccagtcctctcacctggggctcctgcgcacgacagacctccccgtgcgtgctgctgagccctgccccgccccctctcccacacggtcggtgccccccatctctgtttcatcatcgtcccggttgcgttgcgctttccggccctcccgcacccccgcgttccggtgtctcgcggcccggcgcccgactcggaccgatg

SEQ ID NO: 3794 - DNA, 203 bp, Homo sapiens
ggcgcgccagtcctaacgccccctttacgcctttcctcccctcgcctgttgttggtcgggttgccccttggggttttggcggcccgtgggttgttagtcgcgtccgccggcggtgaggcgttgtgcgggaggggcttggccttcccgagctcggcttgatggagcctgcgaatcccccaaggaacccacgactcggaccgatg

SEQ ID NO: 3795 - DNA, 203 bp, Homo sapiens
ggcgcgccagtcctgtccgccggcggtgaggcgttgtgcgggaggggcttggccttcccgagctcggcttgatggagcctgcgaatcccccaaggaacccaatggccgctcctgcccgcgaccccccgggttaccggtacgccgcggccatcctgcccaccggctccatcctgagtacgatcgaggtgcgactcggaccgatg

SEQ ID NO: 3796 - DNA, 203 bp, Homo sapiens
ggcgcgccagtcctgccaggcactcgcatccgcggatactacccgggtgggggttgtgtgtagaacccgcgcggtgcttgtttgattttggcctccgccccccatccctgaagcttgggtccggacccgggcccgcgccgccagcactactttcggttttgctgcctcgccggctccccgcaccgacccgactcggaccgatg

SEQ ID NO: 3797 - DNA, 203 bp, Homo sapiens
ggcgcgccagtcctccatccctgaagcttgggtccggacccgggcccgcgccgccagcactactttcggttttgctgcctcgccggctccccgcaccgaccatgacaatgcgggatgatgttcctttgttggatcgcgagctggtagacgaggccgcgtgtggcggggaggacggagaactgccgctccgactcggaccgatg

SEQ ID NO: 3798 - DNA, 203 bp, Homo sapiens
ggcgcgccagtcctcgcgccaccgccagcccttgctcccaccaccctcctcccaccaccccactattcccccccccaagtccgccccgtggctcgccggccatggagctcagctatgccaccaccctgcaccaccgggacgttgtgttttacgtcacggcagacagaaaccgcgcctactttgtgtgccgactcggaccgatg

SEQ ID NO: 3799 - DNA, 203 bp, Homo sapiens
ggcgcgccagtccttccttgttttcggtctggtactccctttgtgcttttaccctcaccccaccccatcctttggcccgcgcttacggcaacaaagggcctccgatagcctccgaggtgcggagcctctttgggccgtgggtacggacacccccccccatctgcggactggcagccgggacgacgacccgactcggaccgatg

SEQ ID NO: 3800 - DNA, 203 bp, Homo sapiens
ggcgcgccagtcctcttccccaccccgtggggtccgtctatataaacccgcagcagcgtgggcagctccggatccccgcgggctccggaggccccctggcgatggctaggacgggacgccgcgcggccgtcggtaggcccgctcgcacgagcagcctgaccgaacgcaggcgcgtgctgttggccggccgactcggaccgatg

SEQ ID NO: 3801 - DNA, 203 bp, Homo sapiens
ggcgcgccagtcctgcgcggggactcatttgtcgccggcgacacccacccgacaacagcccctgggtgtcgaccgctgtcgcccccgtctgtcgcctctcccttttttccccccctcaaagaacgtggtgttgggcgccggccaattcttcccggagcgccgtcgtcgcccgcccgccgccctcgaaccgactcggaccgatg

SEQ ID NO: 3802 - DNA, 203 bp, Homo sapiens
ggcgcgccagtcctgccgccgcatcagtccgcgcggcgcgcgcctctgacccacccccccccaaaccttaactaaaccacagcacggccgggtgactcgccatggcggccgcgcccccggccgcggtttccgagcccactgcggcccgacagaaactgttggccctgctcgggcaggtacagacgtaccgactcggaccgatg

SEQ ID NO: 3803 - DNA, 203 bp, Homo sapiens
ggcgcgccagtcctacgagttcgaggggcgggtctgtatagccctgcgggccctcatctacaccttcaagacgtaccaggtatttgtgccgaagcccaccgcgctggccacatttgtccgcgaggccggcgcgctgctcagacgacactcgatctctctcctgtccctggagcacaccctctgtacctcgactcggaccgatg

SEQ ID NO: 3804 - DNA, 203 bp, Homo sapiens
ggcgcgccagtcctcgcgcttcggcggggcaccggcaccgggaccgacttgttttacataacagtagggggtgggggaacgcgcacccttgcccggtcgcgatggcggggatggggaagccctacggcggccgcccgggggacgcgttcgagggtctcgttcagcgcatcaggctcattgttcccgcccgactcggaccgatg

SEQ ID NO: 3805 - DNA, 203 bp, Homo sapiens
ggcgcgccagtcctcttcatggggtgggatgtgtcttcccgggaaaccacacacacgcgataccgggtgtgtggttagggggacgaacaggcggttgatgggcgggggggttcgggcggcggaaacaacagtactcatcgggacgcccggcccataaacaggccccgctcgtggcgggcgcggcacaccgactcggaccgatg

SEQ ID NO: 3806 - DNA, 203 bp, Homo sapiens
ggcgcgccagtcctaccgattcctgttgcgttcctgtcggccggtgctgtcctgtcgacagattgttggcgactgcccgggtgattcgtcggccggtgcgtcctttcggtcgtaccgcccaccccgcctcccacgggcccgccgctgtttccgttcatcgcgtccgagccaccgtcaccttggttccacgactcggaccgatg

SEQ ID NO: 3807 - DNA, 203 bp, Homo sapiens
ggcgcgccagtcctcctttcggtcgtaccgcccaccccgcctcccacgggcccgccgctgtttccgttcatcgcgtccgagccaccgtcaccttggttccaatggccaaccgccctgccgcatccgccctcgccggagcgcggtctccgtccgaacgacaggaaccccgggagcccgaggtcgccccccgactcggaccgatg

SEQ ID NO: 3808 - DNA, 203 bp, Homo sapiens
ggcgcgccagtcctacgacaacatcgtctgcacaagctgcgcgctgtaagcaacagcgctccgatcggggtcaggcgtcgctctcggtcccgcatatcgccatggatcccgccgtctcccccgcgagcaccgaccccctagatacccacgcgtcgggggccggggcggccccgattccggtgtgcccccgactcggaccgatg

SEQ ID NO: 3809 - DNA, 203 bp, Homo sapiens
ggcgcgccagtcctcacaggggcggcgggcttgggtgtccgggaccgtcacacctatacagctctgtagagagacctatccgcacctacaatcgtgccggaatgggtctgtttggcatgatgaagtttgcccagactcaccatctggtgaagcgccggggcctccgggccccggagggctactttacccgactcggaccgatg

SEQ ID NO: 3810 - DNA, 203 bp, Homo sapiens
ggcgcgccagtcctccgtagtccttggctcgggtagccactgctctgtggctcgggtcccccggcccccctaacccccatcgggtccgcgtcatccgccccctccgcctgcgacacaaacggccgcgcctccgggcccggtgacacgacgcgcctcgtctctgcggattgtcccgggagcgtcgcggccgactcggaccgatg

SEQ ID NO: 3811 - DNA, 203 bp, Homo sapiens
ggcgcgccagtcctcgcgtgattcggttgctcgcggttgtcttgtttggacgttttttatgcgggaacaagggggcttaccggttacactgtccgctcgctatggggttcgtctgtctgtttgggcttgtcgttatgggagcctggggggcgtggggtgggtcacaggcaaccgaatatgttcttcgtcgactcggaccgatg

SEQ ID NO: 3812 - DNA, 203 bp, Homo sapiens
ggcgcgccagtcctaaggccaggggggcaggcgggcccatcactgttagggtgttaggttgggaggtggcacaaaaagcgacactcccgtgttgtagttgtccgcgggaggcggtggtttccggcaaccctcctcgctgcgccgcgcgcgcccaccggtccttcgcgggggccggggctcttctggtccgactcggaccgatg

SEQ ID NO: 3813 - DNA, 203 bp, Homo sapiens
ggcgcgccagtcctcccgatccgaacggcgcacgccgcgtgggctccaaacgcctccggaagagagcgccccgccccgatattcaagcccgcggtggtgctatggctttccgtgcttcgggacccgcctaccagcccctcgcccccgcggcctccccggcgcgggctcgtgttccggccgtggcctggcgactcggaccgatg

SEQ ID NO: 3814 - DNA, 203 bp, Homo sapiens
ggcgcgccagtcctactcacgcactcgccgctgcgtcgggcgacgcgatttacggcctgccaacaccacgtcaacgtgggaaccgcctgtgtcgtcggacgatgaagcgagctcgcagtcgaagcccctcgccacccagccgcccgtcctcgccctttcgaacgcccccccacggcgggtctccccgacgactcggaccgatg

SEQ ID NO: 3815 - DNA, 203 bp, Homo sapiens
ggcgcgccagtcctttgctgaagcgcgcacggcaagaggcgaggggcggcgactggtgagtacgccaaaaattttgactagcggaggctagaaggagagagatgggtgcgagagcgtcagtattaagcgggggagaattagatcgatgggaaaaaattcggttaaggccagggggaaagaaaaaatatcgactcggaccgatg

SEQ ID NO: 3816 - DNA, 203 bp, Homo sapiens
ggcgcgccagtccttctggaaaggtgaaggggcagtagtaatacaagataatagtgacataaaagtagtgccaagaagaaaagcaaagatcattagggattatggaaaacagatggcaggtgatgattgtgtggcaagtagacaggatgaggattagaacatggaaaagtttagtaaaacaccatatgcgactcggaccgatg

SEQ ID NO: 3817 - DNA, 203 bp, Homo sapiens
ggcgcgccagtcctttcagactctgctataagaaaggccttattaggacacatagttagccctaggtgtgaatatcaagcaggacataacaaggtaggatctctacaatacttggcactagcagcattaataacaccaaaaaagataaagccacctttgcctagtgttacgaaactgacagaggatagcgactcggaccgatg

SEQ ID NO: 3818 - DNA, 203 bp, Homo sapiens
ggcgcgccagtccttctacaatacttggcactagcagcattaataacaccaaaaaagataaagccacctttgcctagtgttacgaaactgacagaggatagatggaacaagccccagaagaccaagggccacagagggagccacacaatgaatggacactagagcttttagaggagcttaagaatgaacgactcggaccgatg

SEQ ID NO: 3819 - DNA, 203 bp, Homo sapiens
ggcgcgccagtcctcagaataggcgttactcgacagaggagagcaagaaatggagccagtagatcctagactagagccctggaagcatccaggaagtcagcctaaaactgcttgtaccaattgctattgtaaaaagtgttgctttcattgccaagtttgtttcataacaaaagccttaggcatctcctcgactcggaccgatg

SEQ ID NO: 3820 - DNA, 203 bp, Homo sapiens
ggcgcgccagtcctttatagaagtagtacaaggagcttgtagagctattcgccacatacctagaagaataagacagggcttggaaaggattttgctataagatgggtggcaagtggtcaaaaagtagtgtgattggatggcctactgtaagggaaagaatgagacgagctgagccagcagcagataggcgactcggaccgatg

SEQ ID NO: 3821 - DNA, 203 bp, Homo sapiens
ggcgcgccagtcctatcaaacaaaacccatctggagcctcagatcatcccaagtcattgttcatcagatctagtactcaaataagttaataaaaatatccacatggggcaaataatcattggaggaaatccaactaatcacaatatctgtcaacatagacaagtcaacacgccaggcaaaatcaaccacgactcggaccgatg

SEQ ID NO: 3822 - DNA, 203 bp, Homo sapiens
ggcgcgccagtcctaatgaaatccattggacctctcaagacttgattgatgcaattcaaaattttctacaacatctaggtattactgatgatatatacacaatatatatattagtgtcataacactcaatcctaatgcttaccacatcatcaaactattaactcaaacaattcaagccatgggacaaacgactcggaccgatg

SEQ ID NO: 3823 - DNA, 203 bp, Homo sapiens
ggcgcgccagtcctcggcgggtagccttcgcgggagatactgcgtttttttgcgccggccccgtcgctcccgtccattcccatcgcgagggggtccggcggcacctaccccggcctccatccgcgctgtggggtctttttcttttttggggggtagcggacatccgataacccgcgtctatcgccacccgactcggaccgatg

SEQ ID NO: 3824 - DNA, 203 bp, Homo sapiens
ggcgcgccagtcctctcgacctctccacacctgcaccacccccgccgtccgaacccaggcctaattgtccgcgcatccgaccctagcgtgttcgtggaaccatgacctctcgccgctccgtgaagtcgggtccgcgggaggttccgcgcgatgagtacgaggatctgtactacaccccgtcttcaggtcgactcggaccgatg

SEQ ID NO: 3825 - DNA, 203 bp, Homo sapiens
ggcgcgccagtcctctaaccttcggcataaaagccaccgcgcgcctgttgaccaggttcagttgcacgactccgcccccgcgagtagcgacggccgtgtgccagtcgccatcgtacccccgacccaagctgtccggctggacaaggatcgccccggatccccactgactcatcttcctgttagggacgcgactcggaccgatg

SEQ ID NO: 3826 - DNA, 203 bp, Homo sapiens
ggcgcgccagtccttggccagtgttttgggtctcgcaccgcgcgcccccgatcccatcgcgcccgccctcctcgccgggcggctccccgcgcgggcccgcgtctcccgccgctaaggcgacgagcaagacaaacaacaggcccgcccgacagacccttctgggggggcccatcgtccctaacaggaagcgactcggaccgatg

SEQ ID NO: 3827 - DNA, 203 bp, Homo sapiens
ggcgcgccagtcctgggagtcccggccgcccgcctctccccgcggttcccgtcttcctgccccattgcgtccgcgcgcccaagggccagtacccgcccgcgatggcttctcttctcggggctatatgtggctggggagcgcgccccgaggaacaatatgagatgatccgcgcggccgttccgccctcgcgactcggaccgatg

SEQ ID NO: 3828 - DNA, 203 bp, Homo sapiens
ggcgcgccagtcctttcctcggggcgcgctccccagccacatatagccccgagaagagaagccatcgcgggcgggtactggcccttgggcgcgcggacgcaatggggcaggaagacgggaaccgcggggagaggcgggcggccgggactcccgtggaggtgaccgcgctttatgcgaccgacgggtgccgactcggaccgatg

SEQ ID NO: 3829 - DNA, 203 bp, Homo sapiens
ggcgcgccagtcctcccgtcgcccctctccaaggttccgttcggaacctgccagcatttcctcgtggcgaaccgatacctcgagacccggtcgatttcacccatcgactggtcggtttgaaaggcatcgacgtccggggtttttgtcggtgggggcttttgggtatttccgatgaataaagacggttacgactcggaccgatg

SEQ ID NO: 3830 - DNA, 203 bp, Homo sapiens
ggcgcgccagtcctgtgcgtgtccttgtgtcagcagtgctttgccgccaaatgcgacagcaaccgcctgcacacgctgtttaccattgacgccggcacgccatgctcgccgtccgttccctgcagcacctctcaaccgtcgtcttgataacggcgtacggcctcgtgctcgtgtggtacaccgtcttccgactcggaccgatg

SEQ ID NO: 3831 - DNA, 203 bp, Homo sapiens
ggcgcgccagtcctaccacgggtataaggacatccaccacccggccggtggtggtgtgcagccgtgttccaaccacggtcacgcttcggtgcctctccccgattcgggcccggtcgctcgctaccggtgcgccaccaccagaggccatatccgacaccccagccccgacggcagccgacagccgggtccgactcggaccgatg

SEQ ID NO: 3832 - DNA, 203 bp, Homo sapiens
ggcgcgccagtcctcgtggacgcggccctcggttgggcgacgcatgccagcccaacaaaatccgccggggtgccagtcccattcccgaaggcgtagcccgttaacttggctggcttggatggggagtagggccttttccattaccccaaggacctagcgcgcgggagtcgtggctttggggcgcatcccgactcggaccgatg

SEQ ID NO: 3833 - DNA, 203 bp, Homo sapiens
ggcgcgccagtcctccccccccaaaacacaccccccgggggtcgcgcgcggccctttaaagcggtggcggcgggcagcccgggccccccgcggccgagactagcgagttagacaggcaagcactactcgcctctgcacgcacatgcttgcctgtcaaactctaccaccccggcacgctctctgtctcccgactcggaccgatg

SEQ ID NO: 3834 - DNA, 203 bp, Homo sapiens
ggcgcgccagtcctcctgtcctttttcccacccaagcatcgacgggtccgcgctagttccgcgtcgacggcgggggtcgtcggggtccgtgggtctcgccccctccccccatcgagagtccgtaggtgacctaccgtgctacgtccgccgtcgcagccgtatccccggaggatcgccccgcatcggcgcgactcggaccgatg

SEQ ID NO: 3835 - DNA, 203 bp, Homo sapiens
ggcgcgccagtcctcccccgcgtcggcctgtctccccgccgtgcgtggccttacaaatctgcaagtgccccaaatcggacacgggcctgtaatataccaacatgggcgttgttgtcgtcaacgtaatgaccctccttgaccagaacaacgccctgccccggacttccgtcgacgcaagcccggccctgcgactcggaccgatg

SEQ ID NO: 3836 - DNA, 203 bp, Homo sapiens
ggcgcgccagtcctacgtcgaatatctggtttgcaaagccctcaccttcgacggcgcgcttcgccccagcgccgcagagctgctttgtttgccgctgtttcaacagaaatgaccgccccctgggggcggtgctgtttgcgggttggcacaaaaagaccccgatccgcgtctgtggtgtttttggcatccgactcggaccgatg

SEQ ID NO: 3837 - DNA, 203 bp, Homo sapiens
ggcgcgccagtcctaacagaaatgaccgccccctgggggcggtgctgtttgcgggttggcacaaaaagaccccgatccgcgtctgtggtgtttttggcatcatgtcgcagggcgccatgcgtgccgttgttcccattatcccattccttttggttcttgtcggtgtatcgggggttcccaccaacgtccgactcggaccgatg

SEQ ID NO: 3838 - DNA, 203 bp, Homo sapiens
ggcgcgccagtcctgtgtggcggacgcggggcggtcattggacggggtgcagttaaatacatgcccgggacccatgaagcatgcgcgacttccgggcctcagaacccacccgaaacggccaacggacgtctgagccaggcctggctatccggagaaacagcacacgacttggcgttctgtgtgtcgcgcgactcggaccgatg

SEQ ID NO: 3839 - DNA, 203 bp, Homo sapiens
ggcgcgccagtcctgaacccacccgaaacggccaacggacgtctgagccaggcctggctatccggagaaacagcacacgacttggcgttctgtgtgtcgcgatgtctctgcgcgcagtctggcatctggggcttttgggaagcctcgtgggggctgttcttgccgccacccatcggggacctgcggcccgactcggaccgatg

SEQ ID NO: 3840 - DNA, 203 bp, Homo sapiens
ggcgcgccagtcctttgttcggtcataagcttcagcgcgaacgaccaactaccccgatcatcagttatccttaaggtctcttttgtgtggtgcgttccggtatggggggggctgccgccaggttgggggccgtgattttgtttgtcgtcatagtgggcctccatggggtccgcagcaaatatgccttgcgactcggaccgatg

SEQ ID NO: 3841 - DNA, 203 bp, Homo sapiens
ggcgcgccagtcctccggaaaccaaagaaggaagcaaagaatggatgggaggagttcaggaagccggggagagggcccgcggcgcatttaaggcgttgttgtgttgactttgcctcttctggcgggttggtgcggtgctgtttgttgggctcccattttacccgaagatcggctgctatccccgggaccgactcggaccgatg

SEQ ID NO: 3842 - DNA, 203 bp, Homo sapiens
ggcgcgccagtccttgttgactttgcctcttctggcgggttggtgcggtgctgtttgttgggctcccattttacccgaagatcggctgctatccccgggacatggatcgcggggcggtggtggggtttcttctcggtgtttgtgttgtatcgtgcttggcgggaacgcccaaaacgtcctggagacggcgactcggaccgatg

SEQ ID NO: 3843 - DNA, 203 bp, Homo sapiens
ggcgcgccagtccttcggtggctccggggggcttccggcctgggggccgtcctgtgtgggattgcgtggtatgtgacgtcaattgcccgaggcgcataaagggccggtggtccgcctagccgcagcaaattaaaaatcgtgagtcacagcgaccgcaacttcccacccggagctttcttccggcctcgcgactcggaccgatg

SEQ ID NO: 3844 - DNA, 203 bp, Homo sapiens
ggcgcgccagtcctgctctcccgggctgctgcccgaaatcgcccccaacgcatccttgggtgtggcacatcgaagaaccggcgggaccgtgaccgacagtccccgtaatccggtaacccgttgagtcccgggtacgaccatcacccgagtctctgggcggagggtggttcccccccgtggctctcgagcgactcggaccgatg

SEQ ID NO: 3845 - DNA, 203 bp, Homo sapiens
ggcgcgccagtcctcccgtaatccggtaacccgttgagtcccgggtacgaccatcacccgagtctctgggcggagggtggttcccccccgtggctctcgagatgagccagacccaacccccggccccagttgggccgggcgacccagatgtttacttaaaaggcgtgccgtccgccggcatgcacccccgactcggaccgatg

SEQ ID NO: 3846 - DNA, 203 bp, Homo sapiens
ggcgcgccagtccttcgtgccttcccgcaggaggaacgtcctcgtcgaggcgaccggcggcgaccgttgcgtggaccgcttcctgctcgtcgggggggagcatgtcgtgggccctggaaatggcggacaccttcctggacaccatgcgggttgggcccaggacgtacgccgacgtacgcgatgagatccgactcggaccgatg

SEQ ID NO: 3847 - DNA, 203 bp, Homo sapiens
ggcgcgccagtcctcgtcaccggtttccgcgacccaccgggcccggccaggcacggcagcatgggacccacagaccgcccgtgatccttaggggccgtgcgatggacaccgcagatatcgtgtgggtggaggagagcgtcagcgccattaccctttacgcggtatggctgcccccccgcgctcgcgagcgactcggaccgatg

SEQ ID NO: 3848 - DNA, 203 bp, Homo sapiens
ggcgcgccagtcctataagttagccctggcccgacagtctggtcgcatttgcacctcggcactcggagcgagacgcagcagccaggcagactcgggccgccccctctccgcatcaccacagaagccccgcctacgttgcgacccccagggaccctccgtccgcgaccctccagccgcatacgaccccccgactcggaccgatg

SEQ ID NO: 3849 - DNA, 203 bp, Homo sapiens
ggcgcgccagtcctcctggaggacggcgccggggctctcggggccgcaggacccagcaaggcgtccattctcccgaaccaggccgttccgatcgccctgatcattacccccgtccgcatcgatccggagatctataaggccatccagcgaagcagccgcctggcattcgacgacacgctcgccgagctcgactcggaccgatg

SEQ ID NO: 3850 - DNA, 203 bp, Homo sapiens
ggcgcgccagtcctcattacccccgtccgcatcgatccggagatctataaggccatccagcgaagcagccgcctggcattcgacgacacgctcgccgagctatgggcctctcgttctccggggcccggccctgctgctgccgaaacaacgtcctcatcaccgacgacggggaggtcgtctcgctgacccgactcggaccgatg

SEQ ID NO: 3851 - DNA, 203 bp, Homo sapiens
ggcgcgccagtcctacacacacaaggcgatactgtcgtcggtggcgctgcctcccgagcttaagcctctcctggtgctggtgtcccgcctgtgtcacaccaacccgtgcgcgcggcacgcgctgtcgtgagaatcagcgttcacccggcggcgcgctcaaccaccgctccccccacgtcgtctcggaacgactcggaccgatg

SEQ ID NO: 3852 - DNA, 203 bp, Homo sapiens
ggcgcgccagtcctacccgtgcgcgcggcacgcgctgtcgtgagaatcagcgttcacccggcggcgcgctcaaccaccgctccccccacgtcgtctcggaaatggagtccacggtaggcccagcatgtccgccgggacgcaccgtgactaagcgtccctgggccctggccgaggacacccctcgtggccgactcggaccgatg

SEQ ID NO: 3853 - DNA, 203 bp, Homo sapiens
ggcgcgccagtcctgggtcgcggcggcgaagtaccccgatcacgggccttgggcacgcgagactatcagagcaccccccgggtcgcccgcagggtggcggaatggaccgagatgccgcccacgcggccctgcgccgacgcctggccgagacgcacctccgagccgagatttacaaggaccagaccctgcgactcggaccgatg

SEQ ID NO: 3854 - DNA, 203 bp, Homo sapiens
ggcgcgccagtcctgacccggggggtgctctgatagtctcgcgtgcccaaggcccgtgatcggggtacttcgccgccgcgacccgccacccggtgtgcgcgatgtttggtcagcagctggcgtccgacgtccagcagtacctggagcgcctcgagaaacagaggcaacttaaggtgggcgcggacgagcgactcggaccgatg

SEQ ID NO: 3855 - DNA, 203 bp, Homo sapiens
ggcgcgccagtcctcttagcctctcggaccccgtcgcgcgggccgctgtccttaggttttgtcgcaaggtgtcgtccgggaacggccggtctcgctagcgggcgccttcccccggccacctcgcccacccactcctccccgcgccgttggcccccgcctctggggtttgccctccccccgcccccggccgactcggaccgatg

SEQ ID NO: 3856 - DNA, 203 bp, Homo sapiens
ggcgcgccagtcctgaatacgcatacgcgcgccaaacccacgcccttcccgcggactcgggggacccgcatcgcctacacacccacacccacccccgaaccatgaacgcgcacttggccaacgaggtccagacgatctcggccacggcccgggtcggccctcggtctttggttcacgtcatcatatcccgactcggaccgatg

SEQ ID NO: 3857 - DNA, 203 bp, Homo sapiens
ggcgcgccagtcctccgaccggcacccggcctctcacacagcatcccccgcctttttgggtccgggcccgtcgtgtctttcggtggaccttgggccgtcgggcacgtacacgggtggccgggcgttggggtggatcttagcctccccgggccaatatcgctagagacagccgatctccacgcgacccccgactcggaccgatg

SEQ ID NO: 3858 - DNA, 203 bp, Homo sapiens
ggcgcgccagtcctgcacgtacacgggtggccgggcgttggggtggatcttagcctccccgggccaatatcgctagagacagccgatctccacgcgaccccatggccgctcccaaccgcgaccctccgggataccggtatgccgcggccatggtgccgaccgggtccctccttagcacgatcgaggtgcgactcggaccgatg

SEQ ID NO: 3859 - DNA, 203 bp, Homo sapiens
ggcgcgccagtccttggtcaacatcaaaggttatatcaaggcgcggaacggccttatcaaaacactcgcctccgcggatgcaacccgggtggtgtttgtgcaagaacccgggtgtctttgatctcgggatcctgctgacgtaagcgaccctttgcggtttcggtctccccacctccaccgcacacccccgactcggaccgatg

SEQ ID NO: 3860 - DNA, 203 bp, Homo sapiens
ggcgcgccagtcctaagaacccgggtgtctttgatctcgggatcctgctgacgtaagcgaccctttgcggtttcggtctccccacctccaccgcacaccccatgaccatgcgggatgaccttcctctggtggatcgagatctggtcgacgaggccgccttcgggggggaggagggagaactgccgctgcgactcggaccgatg

SEQ ID NO: 3861 - DNA, 203 bp, Homo sapiens
ggcgcgccagtcctgggttgcctgtgtccggttcggcccccaccgcgtgcggcacgcacgaggacgagtccgcgtgctttattggcgttccaagcgttgccctccagtttctgttgtcggtgttcccccatacccacgcccacatccaccgtagggggcctctgggccgtgttacgtcgccgcccgcgcgactcggaccgatg

SEQ ID NO: 3862 - DNA, 203 bp, Homo sapiens
ggcgcgccagtcctctccagtttctgttgtcggtgttcccccatacccacgcccacatccaccgtagggggcctctgggccgtgttacgtcgccgcccgcgatggagcttagctacgccaccaccatgcactaccgggacgttgtgttttacgtcacaagggaccgaaaccgggcctactttgtgtgccgactcggaccgatg

SEQ ID NO: 3863 - DNA, 203 bp, Homo sapiens
ggcgcgccagtcctctggcactctgtcgataccccaccgagaccccattgggaccaatacgcccgcgtttcttccttttccccaccccaacccccaagttcgggtgaaggcccagggctcgcagccaacgtcggggcggcaagccctgccatagccacgggccccgtgggttagggacggggtccccccgactcggaccgatg

SEQ ID NO: 3864 - DNA, 203 bp, Homo sapiens
ggcgcgccagtcctgggtgaaggcccagggctcgcagccaacgtcggggcggcaagccctgccatagccacgggccccgtgggttagggacggggtcccccatggggaatggtttatggttcgtgggggttattattttgggcgttgcgtggggtcaggtccacgactggactgagcagacagacccacgactcggaccgatg

SEQ ID NO: 3865 - DNA, 203 bp, Homo sapiens
ggcgcgccagtcctcccgcttaacagcgtcaacagcgtgccgcagatcttggtggcgtgaaactcccgcacctcttcggccagcgccttgtagaagcgcgtatggcttcgtacccctgccatcaacacgcgtctgcgttcgaccaggctgcgcgttctcgcggccataacaaccgacgtacggcgttgcgactcggaccgatg

SEQ ID NO: 3866 - DNA, 203 bp, Homo sapiens
ggcgcgccagtcctcggcgggagccacccgacaacagcccccgggttttcccacgccagacgcgggtccgctgtgccatcgcgccccctcatcccaccccccatcttgtccccaaataaaacaaggtctggtagttaggacaacgaccgcagttctcgtgtgttattttcgctctccgcctctcgcagcgactcggaccgatg

SEQ ID NO: 3867 - DNA, 203 bp, Homo sapiens
ggcgcgccagtcctaaaaggtcataccccgtaaacggcgggctccagtcccggcccggcggttggcgtgaacgcaacggcgggagctgggttagcgtttagtttagcattcgctctcgcctttccgcccgccccccgaccgttgcgcctttttttttttcgtccaccaaagtctctgtgggtgcgcgccgactcggaccgatg

SEQ ID NO: 3868 - DNA, 203 bp, Homo sapiens
ggcgcgccagtccttacccggggggttgtcggtgaaggggagggattcattccccaaccccggtctccaaccctccccttgaccgtcgccgcccccccccggattttgacgctcgggagacataccttgtcgggcgtccgtcgtcgtgccgggattacctccgttcggggaccgattgacaaaaggaccgactcggaccgatg

SEQ ID NO: 3869 - DNA, 203 bp, Homo sapiens
ggcgcgccagtcctgattttgacgctcgggagacataccttgtcgggcgtccgtcgtcgtgccgggattacctccgttcggggaccgattgacaaaaggacatggagacaaagcccaagacggcaaccaccatcaaggtcccccccgggcccctgggatacgtgtacgctcgcgcgtgtccgtccgaacgactcggaccgatg

SEQ ID NO: 3870 - DNA, 203 bp, Homo sapiens
ggcgcgccagtcctacacctatcacgtgactggccgtcaggagctcggcgcagagagcctcgttaagagccaggaggctgggatcgaaggccacatacgcgcgctcgaacgcccccgccttccagctgctgccgggggactcttcgcacaccgcgacgctcgccaggaccccggggggcgaagttgcccgactcggaccgatg

SEQ ID NO: 3871 - DNA, 203 bp, Homo sapiens
ggcgcgccagtcctggggctgacgcgcgtgctgttgggcgggacggttcgcgaaccctttggtgggtttacgcgggcacgcacgctcccatcgcgggcgccatggcgggactgggcaagccctacaccggccacccaggtgacgccttcgagggtctcgttcagcgaattcggcttatcgtcccatctcgactcggaccgatg

SEQ ID NO: 3872 - DNA, 203 bp, Homo sapiens
ggcgcgccagtcctcctaatcgccagtgcgttccggacgccttcgccccacacagccctcccgaccgacacccccatatcgcttcccgacctccggtcccgatggccgtcccgcaatttcaccgccccagcaccgttaccaccgatagcgtccgggcgcttggcatgcgcgggctcgtcttggccacccgactcggaccgatg

SEQ ID NO: 3873 - DNA, 203 bp, Homo sapiens
ggcgcgccagtcctacttaagtggccgtataacaccccgcgaagacgcggggtactcgcaacgcctgcgggggtcctggagggccgcgggggatcgataattcgccgctccctacagcgcacgacagtcattcccgcccggtctcgtcgttggtctacgctgtcccccacccacgcgagccgggcgtccgactcggaccgatg

SEQ ID NO: 3874 - DNA, 203 bp, Homo sapiens
ggcgcgccagtccttcgccgctccctacagcgcacgacagtcattcccgcccggtctcgtcgttggtctacgctgtcccccacccacgcgagccgggcgtcatggcagaccgcggtctcccgtccgaggcccccgtcgtcacgacctcacccgcgggtccgccctcggacggacctatgcagcgcctacgactcggaccgatg

SEQ ID NO: 3875 - DNA, 203 bp, Homo sapiens
ggcgcgccagtcctcgtccctccccggtttcctttgcgctcccgccttccggacctgctctcgcctactcttctttggctctcggtgcgattcgtcaggcagcggccttgtcgaatctcgaccccaccactcgccggacccgccgacgtcccctctcgagcccgccgaaacccgccgcgtctgttgaacgactcggaccgatg

SEQ ID NO: 3876 - DNA, 203 bp, Homo sapiens
ggcgcgccagtcctgcggccttgtcgaatctcgaccccaccactcgccggacccgccgacgtcccctctcgagcccgccgaaacccgccgcgtctgttgaaatggccagccgcccagccgcatcctctcccgtcgaagcgcgggccccggttgggggacaggaggccggcggccccagcgcagccacccgactcggaccgatg

SEQ ID NO: 3877 - DNA, 203 bp, Homo sapiens
ggcgcgccagtcctcatgagctgcgcgctgtgaccgacaaaccccctccgcgccaggcccgccgccactgtcgtcgccgtcccacgctctcccctgctgccatggattccgcggccccagccctctcccccgctctgacggcccttacggaccagagcgcgacggcggacctggcgatccagattccacgactcggaccgatg

SEQ ID NO: 3878 - DNA, 203 bp, Homo sapiens
ggcgcgccagtcctccgcgtggagttgggccatcgaaattataaagagcgtcccctaacggattattgtcctcttgtgtcggtgttgttgtctgggtcaccatacacagagagacaggctcgggtgtccgggaccgtcgcaccaaccacgccttagttaggccgatccgcagttacaattgacctgaccgactcggaccgatg

SEQ ID NO: 3879 - DNA, 203 bp, Homo sapiens
ggcgcgccagtcctatacacagagagacaggctcgggtgtccgggaccgtcgcaccaaccacgccttagttaggccgatccgcagttacaattgacctgacatgggtttgttcgggatgatgaagtttgcccacacacaccatctggtcaagcgccggggccttggggccccggccgggtacttcacccgactcggaccgatg

SEQ ID NO: 3880 - DNA, 203 bp, Homo sapiens
ggcgcgccagtcctgtttctggctcggtgagcgagggtccggttgcttgggtcccctggctgccatcaaaaccccaccctcgcagcggcatacgccccctccgcgtcccgcacccgagaccccggcccggctgccctcaccaccgaagcccacctcgtcactgtggggtgttcccagcccgcgttgggcgactcggaccgatg

SEQ ID NO: 3881 - DNA, 203 bp, Homo sapiens
ggcgcgccagtcctcgcgtcccgcacccgagaccccggcccggctgccctcaccaccgaagcccacctcgtcactgtggggtgttcccagcccgcgttgggatgacggattcccctggcggtgtggcccccgcctcccccgtggaggacgcgtcggacgcgtccctcgggcagccggaggagggggcgcgactcggaccgatg

SEQ ID NO: 3882 - DNA, 203 bp, Homo sapiens
ggcgcgccagtcctcccgttacctttttaatatctatatagtttggtcccccctctatcccgcccaccgctgggcgctataaagccgccaccctctcttccctcaggtcatccttggtcgatcccgaacgacacacggcgtggagcaaaacgcctccccctgagccgctttcctaccaacacaacggccgactcggaccgatg

SEQ ID NO: 3883 - DNA, 203 bp, Homo sapiens
ggcgcgccagtcctctcaggtcatccttggtcgatcccgaacgacacacggcgtggagcaaaacgcctccccctgagccgctttcctaccaacacaacggcatgcctctgcgggcatcggaacacgcctaccggcccctgggccccgggacaccccccatgcgggctcggctccccgccgcggcctggcgactcggaccgatg

SEQ ID NO: 3884 - DNA, 203 bp, Homo sapiens
ggcgcgccagtcctattcgcgcacccgccgctgtgtagggcgacaggatttgggacctaccaacggaacgtctggacggaccccggttctgccgccggacgatgaagcgggcctgcagccgaagcccctcaccacgccgccgcccatcatcgccacgtcggaccccaccccgcgacgggacgccgccacgactcggaccgatg

SEQ ID NO: 3885 - DNA, 203 bp, Homo sapiens
ggcgcgccagtcctaacacctcggccttctagggcacccacgaattggtactattacaaactccctggtcttaccaatcagcggtggaaaggacctttgcaatctctccaggaagctgcaggagcagccttactctcgatagacggctcccctcagtggatcccgtggcggctcctgaaaaagactgtcgactcggaccgatg

SEQ ID NO: 3886 - DNA, 203 bp, Homo sapiens
ggcgcgccagtcctacccagccacttcgggtccttgttctctccgggagagacaaacaagtgggggctcgtccgggatacctacccctgccctctcgcattatgggacaaacctacggcctctcgtccagcccaatccccaaggcccccagggggttatcaacccaccattggttaaacttcctccaacgactcggaccgatg

SEQ ID NO: 3887 - DNA, 203 bp, Homo sapiens
ggcgcgccagtcctagccgaagccgcgccgcgtgtcttgtctgctgcagcatcgttctgtgttgtctctgtttgactgtttttctgtatttgtctgaaagcatgggccagactgttaccacccccttaagtttgactttagaccactggaaagatgtcgaacggacagcccacaaccagttggtggagcgactcggaccgatg

SEQ ID NO: 3888 - DNA, 203 bp, Homo sapiens
ggcgcgccagtcctctaggacaaaaccttttcaatccagttctagcctccaccccaacctcgtcacggagaatccaagaggcactggaggaggaacacccggacagcatacactcggtggagaccaggacatgcgggtcgatacttccggtattaagcccttatcctctttgtgccaatgtgccagggcgactcggaccgatg

SEQ ID NO: 3889 - DNA, 203 bp, Homo sapiens
ggcgcgccagtcctgacagcatacactcggtggagaccaggacatgcgggtcgatacttccggtattaagcccttatcctctttgtgccaatgtgccagggatgaccctggacgcagtgataacccactggaaatggcagaaccagtacagccctggtggaccgacagttctctggagccagagatcacgactcggaccgatg

SEQ ID NO: 3890 - DNA, 203 bp, Homo sapiens
ggcgcgccagtcctggtggtatctactggaaccttatagagttatctggaatccactaaagattggagaaggtcacaacaattggcgcccaacgtggggctcgagttttcttctgaccaagataactaagaggggagtgagaaggctcttgcttactatccctagggaactgaggcaccgtctcaggacgactcggaccgatg

SEQ ID NO: 3891 - DNA, 203 bp, Homo sapiens
ggcgcgccagtcctcgagttttcttctgaccaagataactaagaggggagtgagaaggctcttgcttactatccctagggaactgaggcaccgtctcaggaatggctcttaatgacttcgaccctatagctctccaggggtatttacccgcaccacgagttttgcaacataatgatattataatatgtcgactcggaccgatg

SEQ ID NO: 3892 - DNA, 203 bp, Homo sapiens
ggcgcgccagtcctgacagccaacccctggaaacgggaaccaaaacaggaatttcagccggggtcccgcccccgtcaacgagcaaagtcgcggacgtgggagaagcagccaaggaacaaacaacacaggaagttctgcggtccacagtgtgagattaacatctgctgctccacccatacccccacaagcgactcggaccgatg

SEQ ID NO: 3893 - DNA, 203 bp, Homo sapiens
ggcgcgccagtcctgaagcagccaaggaacaaacaacacaggaagttctgcggtccacagtgtgagattaacatctgctgctccacccatacccccacaagatgccggcactccgcccacttcaagtggaaatcaagggcaatcatcttaaaggctactgggactctggggctgaaatcacttgtgtccgactcggaccgatg

SEQ ID NO: 3894 - DNA, 203 bp, Homo sapiens
ggcgcgccagtcctacaaatatcatcaaccgcagtgtacatggtcctgtgaagatcgttgtgggcatcgttggaaggagtgcgggaattgtattccacaggatggctcctccgatgacgcttcagcagtggctgcagtggagatataacctagagacgaccaacctcttacagatgaaccctaaaatgcgactcggaccgatg

SEQ ID NO: 3895 - DNA, 203 bp, Homo sapiens
ggcgcgccagtccttgttttcagcatactagcctatgctaaaccggtcattattgggataatacttatcattttacttttgttagtcatcagaatattgagatggctagcggtggaacgccggagaaagcaagagtagcctgcagacgagtggatctctcctccttcttggcccagcccgatgactaccgactcggaccgatg

SEQ ID NO: 3896 - DNA, 203 bp, Homo sapiens
ggcgcgccagtcctcgcacatttagttcccagagggcgttgtcgtctccccctaagcaagggagaaacacgtggcacatgatcttgcgcttaacgataaaaatggaatctgataaaagtatggcctgtttaaatagaattttgatgaataagatgatgtttgtggaagataagatctctacccttaagcgactcggaccgatg

SEQ ID NO: 3897 - DNA, 203 bp, Homo sapiens
ggcgcgccagtcctgggggccgggcccactattgttgtgggctccgagttcctctagggatggccgaaaggcagccatggggccacccaggcggcgccgtgctacaggcggcaaggggaaaaatccttcgggtgaccccgggtggcattccctcccttagcagcatgagtgtggtggtagctgcaacccgactcggaccgatg

SEQ ID NO: 3898 - DNA, 203 bp, Homo sapiens
ggcgcgccagtcctcttattattttatacaacaatttatggtgacattgactgatactattgagttcgcccgcttgccattgaatattgccttgtattaccttatagcatttcaaaaagccacagatctcaccctcgagctcattcactttgcagtttgtttgaatcgcatacacaagacatttgaaccgactcggaccgatg

SEQ ID NO: 3899 - DNA, 203 bp, Homo sapiens
ggcgcgccagtcctttatagcatttcaaaaagccacagatctcaccctcgagctcattcactttgcagtttgtttgaatcgcatacacaagacatttgaacatgggagcccagttgagcagaaatactgccgggagccacactactggaacctacgctaccggaggctcaaccattaattataacaaccgactcggaccgatg

SEQ ID NO: 3900 - DNA, 203 bp, Homo sapiens
ggcgcgccagtcctcacgataaccacagccactgaaggcacggacgctgaagacacgagtgaggtcgacgtcatcaacgtcgtcgatccaataggataactatgttttcagactcagattcctcggacgaggaactaagcagaataattactgacattgacgagagcccccaggatatccagcaaagtcgactcggaccgatg

SEQ ID NO: 3901 - DNA, 203 bp, Homo sapiens
ggcgcgccagtcctgtcagcatatcatcaacaggttgtggaccagtggccttctacaagcctccccccaggcccagagcccggatcctggtgtatgcttagaaacccaaagaaatcatctaattgggaaggaccttttctgatcctcctctctacaccaacggcggtaaaagttgaaggacgaccaaccgactcggaccgatg

SEQ ID NO: 3902 - DNA, 203 bp, Homo sapiens
ggcgcgccagtcctaaacccaaagaaatcatctaattgggaaggaccttttctgatcctcctctctacaccaacggcggtaaaagttgaaggacgaccaacatggatacacctggatcattgcaagttattgcgatcatctctctcctcctcgttgggggggccagtcaaccagctactttcttagagcgactcggaccgatg

SEQ ID NO: 3903 - DNA, 203 bp, Homo sapiens
ggcgcgccagtcctttggccagctggtccaggagagggtgtacaggccgtcacaattaaggcctaagtggaggaagcctacaaaggtcttggaaatattgaatcctagaactgtgattatagtggaccatctaggccaacggaaatctgtgagtattgacaatttaaaacctacagcacaccagcatacgactcggaccgatg

SEQ ID NO: 3904 - DNA, 203 bp, Homo sapiens
ggcgcgccagtcctatcctagaactgtgattatagtggaccatctaggccaacggaaatctgtgagtattgacaatttaaaacctacagcacaccagcataatggaacaagaacatgtgatgaccctgaaggaatggatggaatggaatgctcacaaacaactacagaaacttcagtcgactcatcctcgactcggaccgatg

SEQ ID NO: 3905 - DNA, 203 bp, Homo sapiens
ggcgcgccagtcctactaatcaagacgccgtcgtgcagcccacaaaagtctagatacgtcacaggagagcatacgctaggtcgcgttgactatccttatatatgacctgcaaatataaacgaaaacactacaacaaaaatacaacagcaaatcctttcttttagttcggaaggtgaatccccgtcgtccgactcggaccgatg

SEQ ID NO: 3906 - DNA, 203 bp, Homo sapiens
ggcgcgccagtcctacaggtaggcagacagggaacctgagcaaccaggcaaagaagacacctagggatggaagacctccactagacaaagaccagtgcgcatactgtaaagagaagggccattgggcaagagaatgtccccgaaaaaaacacgtcagagaagccaaggttctagccctagataactagcgactcggaccgatg

SEQ ID NO: 3907 - DNA, 203 bp, Homo sapiens
ggcgcgccagtcctcccaaatctgggaccagatcaaagaggtgtataagcctggtaccgtaacaatccctcacccgttccaggtcggggatcaagtgcttgtcagacgccatcgacccagcagccttgagcctcggtggaaaggcccatacctggtgttgctgactaccccgaccgcggtaaaagtcgcgactcggaccgatg

SEQ ID NO: 3908 - DNA, 203 bp, Homo sapiens
ggcgcgccagtcctcggtcgcctcgccgccgtctctggtttctttttgtttcgtttctggaaagcctctgtgtcacagtctttctctcccaaatcatcaatatgggacaagataattctacccctatctccctcactctaaatcactggagagatgtgagaacaagggctcacaatctatccgtggaacgactcggaccgatg

SEQ ID NO: 3909 - DNA, 203 bp, Homo sapiens
ggcgcgccagtcctgtgttaaaaaactgcgtatgtttaaaacttaggaaccaagacagtgacaattggtcttggtattggacaattgttcaaggttccaaaatgagtgatatatttgacgaggcggctagtttcagaagctatcaatcgaaactcggtcgagatgggcgggcaagtgcggcaacagctcgactcggaccgatg

SEQ ID NO: 3910 - DNA, 203 bp, Homo sapiens
ggcgcgccagtcctgaccctggtgcaaggttatatatagagcccaattctcctaattaaacagtgtctcaggttgacaaatggacaagttggatctagtcaatgatggcctcgatattattgactttattcagaagaaccaaaaagaaatacaaaagacatacggacgatcaagcatccaacaaccaacgactcggaccgatg

SEQ ID NO: 3911 - DNA, 203 bp, Homo sapiens
ggcgcgccagtcctaatattctcatacctgtccattcaccttggacttaaagagagacaatcattcagccccgtccaagacacacctgagtggccagaaccatggattttagtgtgagtgataaccttgatgatccaatagaaggtgtttcagattttagtcccacctcatgggagaatggagggtatcgactcggaccgatg

SEQ ID NO: 3912 - DNA, 203 bp, Homo sapiens
ggcgcgccagtcctaatatcttggcaaacactacactaacctcgtctgtactgtctgaaagtggtcaggattgattgacagttattatttatctttaagcaatggctacacaagaggtcaggctaaagtgtttgctctgtgggatcatagttctggttttgtcattagaagggctagggatactacatcgactcggaccgatg

SEQ ID NO: 3913 - DNA, 203 bp, Homo sapiens
ggcgcgccagtcctaggcaggtaccccacctccgggtgggatctgagcctgggctaattgtctacgggtagtttcatttccaatccttttatgtcggagtcatggctgcaacacgggtttcacgatctgtgctcgctgctgtggctcactctgccgctcaccgcacctaccacactgtccttgactgccgactcggaccgatg

SEQ ID NO: 3914 - DNA, 203 bp, Homo sapiens
ggcgcgccagtcctaaccaagaacctcgagccacggtggaaaggaccacatatcgtcctcctgaccacccccacagccttaaaggtagacggagttgctgcctggattcacgcctctcacgtgaaagctgcaggaccaaccaccaatcaagacctctcggacagccccagctcagacgatccatcaagcgactcggaccgatg

SEQ ID NO: 3915 - DNA, 203 bp, Homo sapiens
ggcgcgccagtcctctggattcacgcctctcacgtgaaagctgcaggaccaaccaccaatcaagacctctcggacagccccagctcagacgatccatcaagatggaaagtccaacgcacccaaaaccctctaaagataagactctctcgtggaacttagcgtttctggtggggatcttattcacaatacgactcggaccgatg

SEQ ID NO: 3916 - DNA, 203 bp, Homo sapiens
ggcgcgccagtcctcccgacccccgggaccaccgacccaccatcaggaggtaagctggccggcgaccatacctgttgtccttgtataagtgtctctgtcaattgatctgattttggcggtgggatcgaaggagctgacgagctcgtacttcgcccccgcaaccctggaagacgttccacgggtgtctgcgactcggaccgatg

SEQ ID NO: 3917 - DNA, 203 bp, Homo sapiens
ggcgcgccagtcctcaggatggcaggccatgttccgctggatgcgcttccatgacctcggattgtggacaggagatcgcgatcttctgcccgaattcgtaaatgatgatggcgtctaaggacgctacatcaagcgtggatggcgctagtggcgctggtcagttggtaccggaggttaatgcttctgaccgactcggaccgatg

SEQ ID NO: 3918 - DNA, 203 bp, Homo sapiens
ggcgcgccagtcctgtgaatgatgatggcgtcaaaagacgtcgttcctactgctgctagcagtgaaaatgctaacaacaatagtagtattaagtctcgtctattggcgagactcaagggttcaggtggggctacgtccccacccaactcgataaagataaccaaccaagatatggctctggggctgatcgactcggaccgatg

SEQ ID NO: 3919 - DNA, 203 bp, Homo sapiens
ggcgcgccagtcctcaaagcataccctgatggtttcctcacttgtgtccccaatggggctagctcgggtccacaacagctgccgatcaatggggtctttgtctttgtttcatgggtgtccagattttatcaattaaagcctgtgggaactgccagctcggcaagaggtaggcttggtctgcgccgatacgactcggaccgatg

SEQ ID NO: 3920 - DNA, 203 bp, Homo sapiens
ggcgcgccagtcctagcaaaagcaggggaaaataaaaacaaccaaaatgaaggcaaacctactggtcctgttatgtgcacttgcagctgcagatgcagacacaatatgtataggctaccatgcgaacaattcaaccgacactgttgacacagtgctcgagaagaatgtgacagtgacacactctgttacgactcggaccgatg

SEQ ID NO: 3921 - DNA, 203 bp, Homo sapiens
ggcgcgccagtccttcaatccgaccttacttttcttaaaagtgccagcacaaaatgctataagcacaactttcccttataccggagaccctccttacagccatgggacaggaacaggatacaccatggatactgtcaacaggacacatcagtactcagaaaaggcaagatggacaacaaacaccgaaacgactcggaccgatg

SEQ ID NO: 3922 - DNA, 203 bp, Homo sapiens
ggcgcgccagtcctagtaaatcctgtgtgctaattgaggtgcattggtctgcaaatcgagttgctaggcaataaacacatttggattaattttaatcgttcgttgagcgattagcagagaactgaccagaacatgtctggtcgtaaagctcagggaaaaaccctgggcgtcaatatggtacgacgaggcgactcggaccgatg

SEQ ID NO: 3923 - DNA, 203 bp, Homo sapiens
ggcgcgccagtcctcattagtcgaggagtctcgagatgccatgtggacgagggcatgcccacggcacatcttaacccacgcgggggttgcatgggtgaaagcgctattcgtggcgttatggacacagcctgatagggtgtagcagagacctgctattccgctagtaaaaactctgctgtacatggcaccgactcggaccgatg

SEQ ID NO: 3924 - DNA, 203 bp, Homo sapiens
ggcgcgccagtcctgcttccccggcgtgtcagaatctcaaccggtcgtcagaaagaggacgtatcggaaactctgtgccattcatcatctgctggggcgggctcccgagattgcttgctcggcctgcgatctggtcaacgtggacctggatgactgtgtttctgagcaataaatgacttaaaccaggtcgactcggaccgatg

SEQ ID NO: 3925 - DNA, 203 bp, Homo sapiens
ggcgcgccagtcctgacaccacgtggccatttagggtatatatggccgagtgagcgagcaggatctccattttgaccgcgaaatttgaacgagcagcagccatgccgggcttctacgagatcgtgatcaaggtgccgagcgacctggacgagcacctgccgggcatttctgactcgtttgtgagctggcgactcggaccgatg

SEQ ID NO: 3926 - DNA, 203 bp, Homo sapiens
ggcgcgccagtcctcccggaagtggtgttttgcgatttcgaggccgggctcgatcctcacctttcattgtcgataggggacattttgacactacctggaaaatgtcgtctgtgctcaaagcatttgagcgattcacaatagaacaggaacttcaagacaggggtgaggagggttcaattccgccggagcgactcggaccgatg

SEQ ID NO: 3927 - DNA, 203 bp, Homo sapiens
ggcgcgccagtcctaaggccagcaccgaggatgctctgaatgatatcaagcgagacatcataagaagcgccatatgaactcaccaggaacaccagactcacgggaaaatccacaaactgaaagccacaatgattccctgtttaataaaaaataagcacgaacacaagtccaatccaaccatagcagcacgactcggaccgatg

SEQ ID NO: 3928 - DNA, 203 bp, Homo sapiens
ggcgcgccagtcctgaaaaaatcaagccagaacaagcttaggatcacaatacaacacagaaccccagctgctatcataactgttctctggccgctcgaaagatggagccctccaaactcttcacaatgtcagacaatgccacctttgcacctgggcctgttatcaatgcggctgacaagaagacattccgactcggaccgatg

SEQ ID NO: 3929 - DNA, 203 bp, Homo sapiens
ggcgcgccagtcctttgctagttaccagatgcaaggatctggtgggaagcgaagagcgaccgaacggaccatatctcccggtcatcagcctattcccaatcaacagccggagccccagagcagcttgtcaacagattctacacttctacaggacccaggagaaggacaatcatccagagatcatttggcgactcggaccgatg

SEQ ID NO: 3930 - DNA, 203 bp, Homo sapiens
ggcgcgccagtccttaccttcagcttattaacctatgccaaaccagtaattattggcatagttgttatcgttctccttatccttattattaggatattatcatggctagcagctcttggaccccgtcgccgtcgccgagaggacaaaggagaataaccagaaaagaactctgggaagtggacttatcccgactcggaccgatg

SEQ ID NO: 3931 - DNA, 203 bp, Homo sapiens
ggcgcgccagtcctagcagaagcacgcactttcttaaaatgtcgctgtttggagacacaattgcctacctgctttcactaatagaagatggagaaggcaaagcagaactagctgaaaaattacactgttggttcggtgggaaagaatttgacctagattctgctttggaatggataaaaaacaaaaggcgactcggaccgatg

SEQ ID NO: 3932 - DNA, 203 bp, Homo sapiens
ggcgcgccagtcctaaaaccttcatcatccttacgtcaattgaattctctagcactcgaagcttattgtcttcaatgtaaaagaaaagctggtctaacaagatgacaactagaacaaagggcaggggccatactgcggccacgactcaaaacgacagaatgccaggccctgagctttcgggctggatccgactcggaccgatg

SEQ ID NO: 3933 - DNA, 203 bp, Homo sapiens
ggcgcgccagtcctacagacattgcccttctaattaagaaaaaatcggcgatgaagattaagccgacagtgagcgtaatcttcatctctcttagattatttgttttccagagtaggggtcgtcaggtccttttcaatcgtgtaaccaaaataaactccactagaaggatattgtggggcaacaacacacgactcggaccgatg

SEQ ID NO: 3934 - DNA, 203 bp, Homo sapiens
ggcgcgccagtcctgttttccagagtaggggtcgtcaggtccttttcaatcgtgtaaccaaaataaactccactagaaggatattgtggggcaacaacacaatgggcgttacaggaatattgcagttacctcgtgatcgattcaagaggacatcattctttctttgggtaattatccttttccaaagacgactcggaccgatg

SEQ ID NO: 3935 - DNA, 203 bp, Homo sapiens
ggcgcgccagtccttccttgattctacaatcatgacagttgtctttagtgacaagggaaagaagcctttttattaagttgtaataatcagatctgcgaaccggtagagtttagttgcaacctaacacacataaagcattggtcaaaaagtcaatagaaatttaaacagtgagtggagacaacttttaacgactcggaccgatg

SEQ ID NO: 3936 - DNA, 203 bp, Homo sapiens
ggcgcgccagtcctcattctacaaacgccttactcgaggttccgtctcgtgtttgtgtggaagcaaagttctgtctttgtggaaaccagtaactgttcctaatggcctgcaaccgtgtgacacttgccgtagcaagtgattctgaaatttctgcaaatggctgttctactattgcgcaagccgtccgccgactcggaccgatg

SEQ ID NO: 3937 - DNA, 203 bp, Homo sapiens
ggcgcgccagtcctgttaaaatatataacgtatttttaaaacttaggaaccaagacaaacacttttggtcttggtattggatcctcaagaaatatatcatcatgagtgatatctttgaagaggcggctagttttaggagttatcaatctaagttagggagagatgggagggctagtgcagcaactgctcgactcggaccgatg

SEQ ID NO: 3938 - DNA, 203 bp, Homo sapiens
ggcgcgccagtcctcaaaggagagattgaatgcttttttggagatctagatcattactatatgtgtctcctataatcacatcataggagtgaaccataatacacatctttgggtaggggaaggaaagtattgttgacgtactgattgatctgcttgagtcaaataatcagtcataacaattcaagaaacgactcggaccgatg

SEQ ID NO: 3939 - DNA, 203 bp, Homo sapiens
ggcgcgccagtcctggctgccccgtcgtttccaagaccccataagccagccgacttctccagttacggagcgagcccctcttttgttttgttttttgccagatgcatcccgtactgcggcagatgcgcccccaccctccaccgcaacagcagccccctcctacgcaacagccggcgcttctgcctccgcgactcggaccgatg

SEQ ID NO: 3940 - DNA, 203 bp, Homo sapiens
ggcgcgccagtcctcctgaccggggccgggaccgagggggagagctactttgacatgggcgcggacctgcactggcagcccagccgccgggtcttggaagccgcggcggtcccttacgtagaagaggtggacgatgaggatgagggcgagtacctggaagactgatggcgcgaccgtatttttgctagcgactcggaccgatg

SEQ ID NO: 3941 - DNA, 203 bp, Homo sapiens
ggcgcgccagtcctcgcggcggtcccttacgtagaagaggtggacgatgaggatgagggcgagtacctggaagactgatggcgcgaccgtatttttgctagatgcagcaacagccacctcctgatcccgcaatgcgggcggcgctgcagagccagccgtccggcattaactcctcggacgattggacccgactcggaccgatg

SEQ ID NO: 3942 - DNA, 203 bp, Homo sapiens
ggcgcgccagtcctgattccgccgacgacagcagcgtgttggacttgggcgggagtggtggtggtaacccgttcgctcacctgcgcccccgcgtcgggcgcctgatgtaaaaagaaaccaaaaataaatggtactcaccaaggccatggcgaccagcgtgcgttcgtttcttctctgttgtatctagtcgactcggaccgatg

SEQ ID NO: 3943 - DNA, 203 bp, Homo sapiens
ggcgcgccagtcctctgatgtaaaaagaaaccaaaaataaatggtactcaccaaggccatggcgaccagcgtgcgttcgtttcttctctgttgtatctagtatgatgaggcgtgcgtacccggagggtcctcctccctcgtacgagagcgtgatgcagcaggcaatggcggcggcggcggcgatgcagcgactcggaccgatg

SEQ ID NO: 3944 - DNA, 203 bp, Homo sapiens
ggcgcgccagtcctacgccccaggcattaagtgccacacatgtgtgtttacttgaggtgatgtcagtatttatagggtgtggagtgcaataaaatatgtgttgactttaagtgcgtggtttatgactcaggggaggggactttgggtatataagcaggtgcagacctgtgtggttagctcagagcggtcgactcggaccgatg

SEQ ID NO: 3945 - DNA, 203 bp, Homo sapiens
ggcgcgccagtccttgtgcgcgtgcccgtgcgcacccgcccccctcgcacttgaagatgttcacttcgcgatgttgatgtgtcccagcggcgaggagaaggatgtccaagcgcaaattcaaggaagagatgctccaggtcatcgcgcctgagatctacggccccgcggcggcggtgaaggatgaaagacgactcggaccgatg

SEQ ID NO: 3946 - DNA, 203 bp, Homo sapiens
ggcgcgccagtcctaccgccgcggccgcgcgcctctgaccctgccgcgggcgcgctaccacccgagcattaccatttaactttgccgtcgcctttgcagatatggctctcacatgccgcattcgcgtccccattacgggctaccgaggaagaaaaccgcgccgtagaaggctggcgggaagcgggatgcgactcggaccgatg

SEQ ID NO: 3947 - DNA, 203 bp, Homo sapiens
ggcgcgccagtcctagcgccactgagacacacacttggaaattgtaataaacccgaatggactctgacgctcctggtcctgtgatgtgtttttgtagacagatggaagacatcaatttttcgtccctggctccgcgacacggcacgcggccgtttatgggcacctggagcgacatcggcaccagccaacgactcggaccgatg

SEQ ID NO: 3948 - DNA, 203 bp, Homo sapiens
ggcgcgccagtcctggcagagcactctgaacagcatcgtgggtctgggagtgcagagtgtgaagcgccgccgctgttattaaaaaacactgtagcgcttaacttgcttgtctgtgtatatgtgtatgtccgccgccgctgctgtccagaaggaggagtgaagagaaaggcgcgtcgtcgagttgcaagcgactcggaccgatg

SEQ ID NO: 3949 - DNA, 203 bp, Homo sapiens
ggcgcgccagtcctcttgcttgtctgtgtatatgtgtatgtccgccgccgctgctgtccagaaggaggagtgaagagaaaggcgcgtcgtcgagttgcaagatggccaccccatcgatgctgccccagtgggcgtacatgcacatcgccggacaggacgcttcggagtacctgagtccgggtctggtgcgactcggaccgatg

SEQ ID NO: 3950 - DNA, 203 bp, Homo sapiens
ggcgcgccagtcctccgcggcgtcattgaggccgtctacctgcgcacccccttctcagccggtaacgccaccacataaattcttgcttcttgcaagaagccatggccgcgggctccggcgagcaggagctcagggccatcatccgcgacctggggtgcgggccctacttcctgggcaccttcgataagcgactcggaccgatg

SEQ ID NO: 3951 - DNA, 203 bp, Homo sapiens
ggcgcgccagtcctccgcgatcgggggtgcgctcccggcggcgctctaactgacttcctccgcggccggccattgtgttctcctagggaacaacaacaagcatggagactcagccatcgtcgccaacctcgccatctgcccccaccgccgacaagaagcagcagcagaatgagagcttaaccgccccgcgactcggaccgatg

SEQ ID NO: 3952 - DNA, 203 bp, Homo sapiens
ggcgcgccagtcctcacccgcagttgtctgtatcacaagagcgaagaccaacttcagcgcacgcttgaggacgccgaggctctcttcaacaagtactgcgcactcactcttaaagagtagcccgcgcccgcccacacacggaaaaaggcgggaattacgtcacctgtgcacccccacccagcaccgctcgactcggaccgatg

SEQ ID NO: 3953 - DNA, 203 bp, Homo sapiens
ggcgcgccagtcctcccttctccggctcccccggccactatccggacgagttcatcccgaacttcgatgccatcagcgaatcggtagacggctacgattgaatgtcccatggtggcgcggctgacctagctcggcttcgacacctggaccactgccgccgctttcgctgcttcgctcgggacctcgcccgactcggaccgatg

SEQ ID NO: 3954 - DNA, 203 bp, Homo sapiens
ggcgcgccagtcctttgagctgtccgaggagcaccctcagggcccggcccacggagtgcggatcgtcgtcgaagggggcctagactcccacctgcttcgtatcttcagccagcgcccgatcctggtccagcgccaacagggcaacaccctcctgaccctttactgcatctgcaaccaccccggcctgccgactcggaccgatg

SEQ ID NO: 3955 - DNA, 203 bp, Homo sapiens
ggcgcgccagtcctacctgggaccgcaatgtccagggttagtagtcagcggcatcgtcggtgtgctttgtgggttagcagttataatcatctgcatgttcatttttgcttgctgctacagaaggcttcaccgacagaaatcagacccactgctgaacctctatgtttaatttttgattttccagagcccgactcggaccgatg

SEQ ID NO: 3956 - DNA, 203 bp, Homo sapiens
ggcgcgccagtcctcattgtgatcggggtggtcatcctagcgatgctgctctacttcatcttctgccgccgcatccccaacgcgaaaccggtctacaagcccatcgttatcgggcagccggagccgcttcaggtggagggaggtctaaggaatcttctcttctcttttacagtatggtgatttgaactcgactcggaccgatg

SEQ ID NO: 3957 - DNA, 203 bp, Homo sapiens
ggcgcgccagtcctcatcgttatcgggcagccggagccgcttcaggtggagggaggtctaaggaatcttctcttctcttttacagtatggtgatttgaactatgattcctagacagttctttatcattggtcttctctgcgcgctccaagtctgtgccaccctcgctctggtggctaatgcgagtccacgactcggaccgatg

SEQ ID NO: 3958 - DNA, 203 bp, Homo sapiens
ggcgcgccagtcctggtctttgtgcgcatcgcctacctgcgccaccacccccagtaccgcgaccaaagagtggcgcagctgctcaggctcatctgataagcatgcgggctttgctacttctcatgcttctactattgctagctcccctggtcgccccctttcccctcaaatcccccacccagtccccccgactcggaccgatg

SEQ ID NO: 3959 - DNA, 203 bp, Homo sapiens
ggcgcgccagtccttcggccagcctaagggacaacacccccaggggcttttcttggaatccatctgaagagacgaagggagggttgatgaagggcacggtcggtgcgttgtctgcatcgtagggatacacggggtcgaagccatcatccacccgcgcgcgctttttggacatctaatagaaataaaaacgactcggaccgatg

SEQ ID NO: 3960 - DNA, 203 bp, Homo sapiens
ggcgcgccagtcctggtgcgttgtctgcatcgtagggatacacggggtcgaagccatcatccacccgcgcgcgctttttggacatctaatagaaataaaaaatgaagattgagggacaggaggaatttgacatccccttcagagtgtggaggaagtttgcagcccgccggggcctgcagtaccagagccgactcggaccgatg

SEQ ID NO: 3961 - DNA, 203 bp, Homo sapiens
ggcgcgccagtcctccccggcgggctgcaaacttcctccacactctgaaggggatgtcaaattcctcctgtccctcaatcttcattttttatttctattagatgtccaaaaagcgcgcgcgggtggatgatggcttcgaccccgtgtatccctacgatgcagacaacgcaccgaccgtgcccttcatccgactcggaccgatg

SEQ ID NO: 3962 - DNA, 203 bp, Homo sapiens
ggcgcgccagtccttttccaccaacacagtgggggcgagaggtgccacctccgggacctgcattttgaagtgttccgagaccgtttggaataaagttaatcatggttcttcctgttcttccctcccccgccgtcaccgaaacccaacaaaattgcatcatctggctgggtttggcccattccaccgtgcgactcggaccgatg

SEQ ID NO: 3963 - DNA, 203 bp, Homo sapiens
ggcgcgccagtccttagagtgagtagtgttttggggagggagaggacctgcataaggggcagaatgattaaaatctgtgcttttctgtgtgttgcagcagcatgagcggaaacggctcctttgagggaggggtattcagcccttatctgacggggcgtctcccctcctgggcgggagtgcgtcaaaatcgactcggaccgatg

SEQ ID NO: 3964 - DNA, 203 bp, Homo sapiens
ggcgcgccagtccttgtggcttgcccttctcttgttcctggtggtcctatggctaaaaatttcggagaagatatgaatgagtacatacagttactgctaagggaggagcttagggattgcggcagagcaattgatattccacttgttaatctactacaggtgaaccaggagcagaatctgttggaattcgactcggaccgatg

SEQ ID NO: 3965 - DNA, 203 bp, Homo sapiens
ggcgcgccagtcctgaagtgcacgtatttttttagtgtgtcaccggtttctgggcgtgttggcgggtatttttagaccttggcctttacgtcagtgaggttagggctatatattgagtacagaagcgggcagttaggttagagctcagctttttctctgactcttgcgcctgccgtgctcggtaagctcgactcggaccgatg

SEQ ID NO: 3966 - DNA, 203 bp, Homo sapiens
ggcgcgccagtcctagggctatatattgagtacagaagcgggcagttaggttagagctcagctttttctctgactcttgcgcctgccgtgctcggtaagctatggacgctcaggttttgtatgtgtttctggagggagcgggggctttgctgcctgtgcagaaggggagtaattacattttttacgcacgactcggaccgatg

SEQ ID NO: 3967 - DNA, 203 bp, Homo sapiens
ggcgcgccagtcctcgcggcgtcccactcgaggaccgacccataaagtcggtttacggggacacggacagcctctttgtcacccagcggggacacgagctcatggagaccagaggtaagaaacgcatcaaaaagaacggcggaaaactggtttttgatcccaatcagcccgacctcacctggctcgtgcgactcggaccgatg

SEQ ID NO: 3968 - DNA, 203 bp, Homo sapiens
ggcgcgccagtcctgccgtgccaacggtcccattttagctggagggcgagatcaagggcgagctcaacgagccggtcgtccccggagagtttcatgaccagcatgaaggggacgagctgcttgccgaaggaccccatccaggtgtaggtttccacatcgtaggtgaggaagagcctttcggtgcgaggcgactcggaccgatg

SEQ ID NO: 3969 - DNA, 203 bp, Homo sapiens
ggcgcgccagtcctcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgactcggaccgatg

SEQ ID NO: 3970 - DNA, 203 bp, Homo sapiens
ggcgcgccagtcctatccctcaaggaagcagctggagcggctctcatcccagtaggtggaagccatctctggatcccgtggcgtctcctaaagaggggtatatgcccaagacccgaaagcaacgcagtcgccgacccagaaaccaaagaccatcaactccatgggtaagtccggtctttatttcagtccgactcggaccgatg

SEQ ID NO: 3971 - DNA, 203 bp, Homo sapiens
ggcgcgccagtccttgctgcctgcagcgaggcttggcccggggccaacgcctgtgagattacccagctcggagttgggcctcaagaaagtaagggctaaagctgctagccctaggggagaaagcaaacaggtgggggctcgtccgggatcgatcacctctctgtatctgcccttccccaatcagaacccgactcggaccgatg

SEQ ID NO: 3972 - DNA, 203 bp, Homo sapiens
ggcgcgccagtcctctgctagccctaggggagaaagcaaacaggtgggggctcgtccgggatcgatcacctctctgtatctgcccttccccaatcagaaccatgggaaagacttatagctctccggtaaaccctatccccaaagccccaaaagggctagcaattcaccactggctaaactttctccaacgactcggaccgatg

SEQ ID NO: 3973 - DNA, 203 bp, Homo sapiens
ggcgcgccagtccttagattcggtgccggtaacgattccagttttatactatctgatcattctctatctctattaaggatatttctagtctaaagttcaaaatgtcaagtgttttaaagacatttgaaagatttactatacaacaggagcttcaggagcaatctgatgacactccagtacctcttgagcgactcggaccgatg

SEQ ID NO: 3974 - DNA, 203 bp, Homo sapiens
ggcgcgccagtcctgacacaatagagaaaatctaggtccgaaagcttgcctctcagacagatcccaaaatcatagtccaaaccccaaacacagcagcagacatgcctataatatcattaccagcagatccaacttcacccagtcaatcccttactccgtttccaatacaacttgacaccaaagatggccgactcggaccgatg

SEQ ID NO: 3975 - DNA, 203 bp, Homo sapiens
ggcgcgccagtcctgatgttatcataggtccgaactgatcaatctaacaaaaaaactaaacgttccacaataaatcaacgttcaggccaaaatattcagccatgcatcacctgcatccaatgatagtatgcatctttgttatgtacactggaattgtaggttcagatgccattgctggagatcaactacgactcggaccgatg

SEQ ID NO: 3976 - DNA, 203 bp, Homo sapiens
ggcgcgccagtcctctcaaccagacaccaccagcatacacgaaaccaaccttcacagtggatacctcagcatccaaaactctccttcccgaatggatcaggatgccttcttttttgagagggatcctgaagccgaaggagaggcaccacgaaaacaagaatcactctcagatgtcatcggactccttgcgactcggaccgatg

SEQ ID NO: 3977 - DNA, 203 bp, Homo sapiens
ggcgcgccagtcctcttcccgaatggatcaggatgccttcttttttgagagggatcctgaagccgaaggagaggcaccacgaaaacaagaatcactctcagatgtcatcggactccttgacgtcgtcttatcctacaagcccacagaaattggagaagacagaagctggctccatggtatcatcgacacgactcggaccgatg

SEQ ID NO: 3978 - DNA, 203 bp, Homo sapiens
ggcgcgccagtcctccctacatgggtaacaactccaattaaaaaatcagatcaagtacattgtagcatacatacaacaatcaaatctatccacaacttcaccaatcaggtgtacaacaagtaagaaaaacttagggttaaagacaatccagtcaacctataaggcaacagcatccgattatacaaacgcgactcggaccgatg

SEQ ID NO: 3979 - DNA, 203 bp, Homo sapiens
ggcgcgccagtcctagttgatcctgccagcggtgggtcgctactgtttcgcgaaccagtcgttttgacagttggttgggatcaaatttgttctgtgcgcgtcacgccactttttgtggcgggaatgtgcgaaaataacaggaaaaagaaccctggaaagggttcaaagaagaaaaagaatgctggaagcgactcggaccgatg

SEQ ID NO: 3980 - DNA, 203 bp, Homo sapiens
ggcgcgccagtcctatggcggggaatttgaagaagaaatctgccaaacccaaggcccaaaggagaccacctcagggccgaggagggcaggtcaaacaaaaacccggtgctgctattgtgggagtcatgcattacgtgacccaccaggcgctgggcatgaagttaagtgggagacttaagaagttctggcgactcggaccgatg

SEQ ID NO: 3981 - DNA, 203 bp, Homo sapiens
ggcgcgccagtcctacctaacggtgttggggttacagcctgatagggtgctgcagaggcccacgaataggctagtataaaaatctctgctgtacatggcacatggagttgaacaagtttgaacttttatacaaaacaagtaaacaaaaaccagtgggggtgactgaacctatctacgactcagcgggtcgactcggaccgatg

SEQ ID NO: 3982 - DNA, 203 bp, Homo sapiens
ggcgcgccagtcctgtgctttagtcagtgtccgcagcgttctgttgaacgtgagtgtgttgagaaaaagacagcttaggagaacaagagctgggagtggttatgatgaccacttctaaaggaaaggggggcggtccccctaggcgcaagcttaaagtgaccgcaaataagtcgcgaccagcaacgagccgactcggaccgatg

SEQ ID NO: 3983 - DNA, 203 bp, Homo sapiens
ggcgcgccagtcctcagcgactgtgattgtggatattctttctgcaagttttgtcgtgaacgtgttgagaaaaagacagcttaggagaacaagagctgggaatggccgggaaggccgttctaaaaggaaagggggggggtccccctcgacgagcgtcgaaagtggccccaaagaagacgcgtcagttgcgactcggaccgatg

SEQ ID NO: 3984 - DNA, 203 bp, Homo sapiens
ggcgcgccagtcctcatccgtaatacaacccggaataacctccaaaccgagaagaactagtctatgaccagacgaaaaggaactagtccctgttcttttcttagggcctttttcacctgggtaaagtgtagttattgcgtataactctggtatcaataccacccggaagaaattatttatctgccatccgactcggaccgatg

SEQ ID NO: 3985 - DNA, 203 bp, Homo sapiens
ggcgcgccagtcctatagtctgtgtgacctgcaggcattttgtgaaaagggtaaagtatgaaagctactctcagaaaagtacttatgtattgatgagagccttaaaatgactttatattcacaaaactgctggaagacaatgatctggggtatcacattccctcttaggttaagtttcgcactactagcgactcggaccgatg

SEQ ID NO: 3986 - DNA, 203 bp, Homo sapiens
ggcgcgccagtcctttaaaatgactttatattcacaaaactgctggaagacaatgatctggggtatcacattccctcttaggttaagtttcgcactactaggaatttttgcgaaaattcttaattccattcttatggtgtagtgtttgttcttttcaattggggcgtatctctctttcgcagagaccccgactcggaccgatg

SEQ ID NO: 3987 - DNA, 203 bp, Homo sapiens
ggcgcgccagtcctacgggctgaaggatgccctgaaggtacccataggtaaccttaagcgactatggatctgatcaggggcccaccatgtaacacatgggtagaagtcttcggaccttgggttaaaaaacgtctaggcccgccccccacagggatgtggggtttcccttataaccccaatattgtatacgactcggaccgatg

SEQ ID NO: 3988 - DNA, 203 bp, Homo sapiens
ggcgcgccagtcctagaagtcttcggaccttgggttaaaaaacgtctaggcccgccccccacagggatgtggggtttcccttataaccccaatattgtataatggctgcatccaaaatgaatcccgttggcaacctgctctccacagtctcctcaaccgttggatctcttctacaaaacccctctgttcgactcggaccgatg

SEQ ID NO: 3989 - DNA, 203 bp, Homo sapiens
ggcgcgccagtcctcacgggttggggcttggccataggccatcggcgcatgcgtggaacctttgtggctcctctgccgatccatactgcggaactcctagcagcttgttttgctcgcagccggtctggagcgaaacttatcggaaccgacaactcagttgtcctctctcggaaatacacctcctttcccgactcggaccgatg

SEQ ID NO: 3990 - DNA, 203 bp, Homo sapiens
ggcgcgccagtcctctccacaacattccaccaagctctgctagatcccagagtgaggggcctatattttcctgctggtggctccagttccggaacagtaaaccctgttccgactactgcctcacccatatcgtcaatcttctcgaggactggggaccctgcaccgaacatggagagcacaacatcaggcgactcggaccgatg

SEQ ID NO: 3991 - DNA, 203 bp, Homo sapiens
ggcgcgccagtcctagactgggaggagttgggggaggagattaggttaaaggtctttgtactaggaggctgtaggcataaattggtctgttcaccagcaccatgcaactttttcccctctgcctaatcatctcatgttcatgtcctactgttcaagcctccaagctgtgccttgggtggctttggggccgactcggaccgatg

SEQ ID NO: 3992 - DNA, 203 bp, Homo sapiens
ggcgcgccagtccttgcccttggacaaaggcattaaaccgtattatcctgaatatgcagttaatcattacttcaaaactaggcattatttacatactctgtggaaggctggcattctatataagagagaaactacacgcagcgcctcattttgtgggtcaccatattcttgggaacaagagctacagccgactcggaccgatg

SEQ ID NO: 3993 - DNA, 203 bp, Homo sapiens
ggcgcgccagtcctgcatttggtccagggttcaccccaccacacggaggccttttggggtggagccctcaggctcagggcatattgacaacactgccagcagcacctcctcctgcctccaccaatcggcagtcaggaagacagcctactcccatctctccacctctaagagacagtcatcctcaggcccgactcggaccgatg

SEQ ID NO: 3994 - DNA, 203 bp, Homo sapiens
ggcgcgccagtccttccaatttggcctgttctgaactacaccatctactgctgtgaagaatgtcctgaaggcaagctggttacagccctgatcaggagccccgctcgtgactctcgatcgacgcggggtcaaaaactgtctaagcagcagcagaaacgcgggagcgtttctttttccttatttgtttccgactcggaccgatg

SEQ ID NO: 3995 - DNA, 203 bp, Homo sapiens
ggcgcgccagtcctcgctcgtgactctcgatcgacgcggggtcaaaaactgtctaagcagcagcagaaacgcgggagcgtttctttttccttatttgtttcatgatggcggcgtctaaggtatacagagtgtgcgagcagactctactagcaggcgctgttcggatgatggacaaattcttgcaaaagcgactcggaccgatg

SEQ ID NO: 3996 - DNA, 203 bp, Homo sapiens
ggcgcgccagtcctggttacagccctgatcaggagccccgctcgtgactctcgatcgacgcggggtcaaaaactgtctaagcagcagcagaaacgcgggagcgtttctttttccttatttgtttcatgatggcggcgtctaaggtatacagagtgtgcgagcagactctactagcaggcgctgttcggcgactcggaccgatg

SEQ ID NO: 3997 - DNA, 203 bp, Homo sapiens
ggcgcgccagtcctacagaagagcaagtactcctgactgggcaatgggactgcattgcatatccctaggcacctattgagatttctctggggcccaccagcatggagttcctgtatgggaatgcaggactggacttgtgctgcctgacagggtcgcggctggccgtctgtactttgtatagtcagttgcgactcggaccgatg

SEQ ID NO: 3998 - DNA, 203 bp, Homo sapiens
ggcgcgccagtcctaggttgggaaacctggactgggtctatactgcctgatagggtcgcggctggccgcctgtaactagtatagtcagttgaaaaccccccatggaatctactactactctttcattttgcaactggatccccaagaaacagagagcccgtgtgtaccttaccaccagtgtcacacaccgactcggaccgatg

SEQ ID NO: 3999 - DNA, 203 bp, Homo sapiens
ggcgcgccagtcctaagacaggtggaaatttttacgtagtagactgcagctgtttacctttcctaatgcatttcctgtaaatcagaaaggggatcccttgtatacactaaatgatgcaaactggaaatgcttcttccaaaggttgtgggctcggttagacttacacgagcaggacgaccaggaggacacgactcggaccgatg

SEQ ID NO: 4000 - DNA, 203 bp, Homo sapiens
ggcgcgccagtcctatgtacaaagcggtgatgatgatacatggaccaaggtgtctggccatgtggaccatgcaggactatactttacacacgaagggacacgtgtaacctatgttaggtttgcacaggaagcacagacatatgggaacactggcacctgggaggtgcatgtgggaggacagctaatttcgactcggaccgatg

SEQ ID NO: 4001 - DNA, 203 bp, Homo sapiens
ggcgcgccagtcctgtgtaacctatgttaggtttgcacaggaagcacagacatatgggaacactggcacctgggaggtgcatgtgggaggacagctaatttatgatgcattcgactcctctgtgtctagcacccaggacaccgaccaagaaccgctatcctctactagacctactgaccccccatacacgactcggaccgatg

SEQ ID NO: 4002 - DNA, 203 bp, Homo sapiens
ggcgcgccagtccttatatgtattgtatacacagtgtatgtagacacatgtagtgggtttgtgggtgtcatacatttattgggtgtggggtattcattatagtggtgtggtttggtgttttgtttttggctttttgtatggtttgtatttttcatttttttacattatattgctaaataaattttagtcgactcggaccgatg

SEQ ID NO: 4003 - DNA, 203 bp, Homo sapiens
ggcgcgccagtcctgtggtgtggtttggtgttttgtttttggctttttgtatggtttgtatttttcatttttttacattatattgctaaataaattttagtatgcatcgctctaaacgtcgcaagcgtgcctccgctacccaattatatcaaacctgcaaattggcaggtacctgtccctccgatgtgcgactcggaccgatg

SEQ ID NO: 4004 - DNA, 203 bp, Homo sapiens
ggcgcgccagtcctttcttgtaaatgggtccacatattatttgttgcccccattaggtttgctacctaaaaaacgtaaacgttttccatatttttttgcagatggcaatgtggaagcctagtgacaacaaggtatacctgcctcctgcccctgtgtccaaggtcctcagcaccgacgcctatgtatcccgactcggaccgatg

SEQ ID NO: 4005 - DNA, 203 bp, Homo sapiens
ggcgcgccagtcctacctacacaacctacagaaccagcacagcaagcatatagggtggtaacaagttgttgtaggtgttgctgtacagtaaggctggtggtggagagtggacacgcagaaataagacaactccaggagcttctgttgggcgcactgcatatagtgtgtccgctctgcgcataactgctcgactcggaccgatg

SEQ ID NO: 4006 - DNA, 203 bp, Homo sapiens
ggcgcgccagtcctcgatcctccgtaggaagcgttggtgtcttggacattgccgagttgaaaccttggtttccggctggaaaccacgtcgctcttcgtcaaatgacgaaaggcaaaatgaaaaacgcgaataaaaagaaagcaaaaaactctaagaccaatcctggtcgaagtggcagaagtaatggacgactcggaccgatg

SEQ ID NO: 4007 - DNA, 203 bp, Homo sapiens
ggcgcgccagtcctagaaaaagaggctgcagaacactttctaaatgtgagtgacgacagtcaaaatgattatgagtaattaaaaaagtgggacaagtcaaaatgtcattccctgaaggaaaagatattcttttcatgggtaatgaagcggcaaaattggcagaagctttccaaaaatcattaagaaaacgactcggaccgatg

SEQ ID NO: 4008 - DNA, 203 bp, Homo sapiens
ggcgcgccagtcctggagaaacttttgcccacatactaacaacatcacaaccatctcaagaaaagaaactgggcaaaacagcatccaagagacaaatagcaatggatcctcttaatgaatccactgttaatgtctatctccctgattcgtaccttaaaggagtaatttcttttagtgaaactaatgcacgactcggaccgatg

SEQ ID NO: 4009 - DNA, 203 bp, Homo sapiens
ggcgcgccagtcctgtgtcatcattgattgggaagatcaaggaaacaatttgttccaataatatcgtacatcttgactaagtcgaacaaggggaagtcgatatggatcgtgggaccagaagaatctgggtgtcgcaaaatcaaggtgatactgatttagattatcataaaattttgacagctggccttcgactcggaccgatg

SEQ ID NO: 4010 - DNA, 203 bp, Homo sapiens
ggcgcgccagtcctaattttaatctccagattaagaaaaagatatacgatgaagattaaggcgacaacgagccgaaacttcatctcttttaaagatctaacattatctgttccaaagtcatacaaggacacattcaaatcagggattgtaagctgctatttcttacctccccaaattacctatacaaccgactcggaccgatg

SEQ ID NO: 4011 - DNA, 203 bp, Homo sapiens
ggcgcgccagtcctgaagccacgttggtggtgcttgcagctgagaacaactccagagattgtaggtagaaaggaccaacatttataggtaggggtcagaaagcaacaataaccataaaaggagagcctgacattgctatttaatatcctagaacctgatttctaggttctagctttaaaatccggatgcgactcggaccgatg

SEQ ID NO: 4012 - DNA, 203 bp, Homo sapiens
ggcgcgccagtcctgtattaaaaattgatagcgcttgcgtaagagtaagatctcaagatggatcctgtatctgtagtacatagcttcgctaggagtcaaggcctgccacttaactttgaaactgtgggttgtgagggtccaagtcacgacccacgctttgtaattgaatgtaaatttcttgatttccacgactcggaccgatg

SEQ ID NO: 4013 - DNA, 203 bp, Homo sapiens
ggcgcgccagtcctgtattaaaattcagcaattgtccaatttaggaaacattctgtttaagagttgacaaggtctcaatgaataatggacaagcaacaattacaagaaatggaggaaggttcgaaatcaggtgtcgtcacttggaccgtgactacaccatgccactaccaaatgctactagtaatgatcgactcggaccgatg

SEQ ID NO: 4014 - DNA, 203 bp, Homo sapiens
ggcgcgccagtcctgtatttaaaattcatgtttttgcatcatggcgtgggttacgcaagcgtatagttcgggattgtcacagaacagtatcattagtctaacagggaatgacaggactgttgctgatggcacttttaattccatgattatgccaagagctgtaattgctaatgagcgtgaacattttacgactcggaccgatg

SEQ ID NO: 4015 - DNA, 203 bp, Homo sapiens
ggcgcgccagtcctaacaatggctaacttggtgtaatgcacaaagctggagccactatgaaaactgggcaataaactacacatttgatttccctggaataaatgcagatgccctccacccagatctccaaaccacccccattgtcccagacaccagtatcagcagcagtggtggtgaaagctctgaagcgactcggaccgatg

SEQ ID NO: 4016 - DNA, 203 bp, Homo sapiens
ggcgcgccagtcctgttgtcatgtaggagcctctaacccattttctgtgttaacttgtaaaaaatgtgcttacctgtctggattacaaagttttgtagattatgagtaaaaccactaacaaatggtgggaaagcagtgacaaatttgcccaggacgtgtataagcagtttgtgcaattttatgaaaaacgactcggaccgatg

SEQ ID NO: 4017 - DNA, 203 bp, Homo sapiens
ggcgcgccagtcctcattggacggtagcagatgaagaattgttaaaaaatataaaaaatgaaacagggtttcaagcacaagcagtaaaagattactttactttaaaaggtgcagctgcccctgtggcccattttcaaggaagtttaccggaagtgcccgcgtacaacgcctcagaaaaataccccagccgactcggaccgatg

SEQ ID NO: 4018 - DNA, 203 bp, Homo sapiens
ggcgcgccagtcctcacaaagtgggccaattggaggtattaaatccatgggaattactactttagttcaatatgctgtgggaataatgacagttaccatgacctttaaattgggacctcgaaaggctactggaaggtggaatccccagcctggcgtttatcctcctcatgcagctggtcatttaccatcgactcggaccgatg

SEQ ID NO: 4019 - DNA, 203 bp, Homo sapiens
ggcgcgccagtcctcgcaccgaggatcctaggcattaaggctatcttatttaattgtctttaattgcctcttgtgtcttctgtgcccctacgggaccctatcccatagcgaactgttgctctagcagaccacatgttctgagggttctgaacatcatacctgcagctaaacatggaggaagacatagccgactcggaccgatg

SEQ ID NO: 4020 - DNA, 203 bp, Homo sapiens
ggcgcgccagtcctatcaagatggccgttggcagccccacgaaatctagattagtccgaatgtcctattttgattaggtggtcagataggtcagaaactcacctgctaattttcaagaaacacaaatgacacatgaacaacaacaaattttaactttctcttctgaaggtatgaccccatccactagtcgactcggaccgatg

SEQ ID NO: 4021 - DNA, 203 bp, Homo sapiens
ggcgcgccagtccttctctgctctcactgccattctcaagtgttcacactgtccaagctcctttggttgttcgcttccacttgccactgtcaactcttgtcatggacccctcaaacttcaagctcttctccatctcccaccgcactgctaagcgctggtcgtggcgcagattccgtgtggagacacgtcgactcggaccgatg

SEQ ID NO: 4022 - DNA, 203 bp, Homo sapiens
ggcgcgccagtcctacaagccctatatttacttgttgcattttactcgtcagaagaaatcacagagtatcatttggatttgttactcacattaaggacaagatgggtatgcaaatgagtaagaacaccgctgggtctcacaccactgtgacccaagccagtggaggctcccacataaattacaccaaccgactcggaccgatg

SEQ ID NO: 4023 - DNA, 203 bp, Homo sapiens
ggcgcgccagtcctgagggactgtataagccctcgaaaaaagggatgcttcaagtgtggagatctaggacacataatgagaaattgcccaaagatggtgaattttttagggaataccccctggggcagtggcaaacccaggaacttcccggcgatgccattgaccccaacggcccctccaatgccaggcgactcggaccgatg

SEQ ID NO: 4024 - DNA, 203 bp, Homo sapiens
ggcgcgccagtcctatgcatagaacactggcatgacagacatcagagaagcttaagctatgcaaagtatagatacctgctgttgatgaataaagcaatgtttactcacatgcaacaagaatgtccttgtagaagtgggcatccgagaggacctcctcctccagggatggtctaacctctgtgttacagcgactcggaccgatg

SEQ ID NO: 4025 - DNA, 203 bp, Homo sapiens
ggcgcgccagtcctatccaaagtataaatatctgcatagtagaattaaagcatttgagtttgtaaataagtttccatttaaggacgatggcagtcccttgtttgaacttactgaccaaagctggaaatctttttttcaaaggctttggaggcaattagatctaagtgaccaagaagacgagggtgaggcgactcggaccgatg

SEQ ID NO: 4026 - DNA, 203 bp, Homo sapiens
ggcgcgccagtcctatatatattttgaagatgacgaaggcaactggcaaaagactgagggacatttggactatcatggtgcctattttatggatggattaaataaacaatactatatcagatttgctcaagacgcacgcagatttagtgaaactggagaatgggaagttaagtttaacaacgaaatttcgactcggaccgatg

SEQ ID NO: 4027 - DNA, 203 bp, Homo sapiens
ggcgcgccagtcctagagaaattggcagtttgtgcatcaggcattccttttgatagagttagaggagcttggaaggcagtgtgtaggttttgtacagagatatgattgggaaacaggctactataccagatattgtgctggatctgcaagaccttgtccagcccattgacctgcattgtgacgaagaccgactcggaccgatg

SEQ ID NO: 4028 - DNA, 203 bp, Homo sapiens
ggcgcgccagtcctcagaaaatcaggaggaggagcctgcacctcaaagaatagactacaagatagtttcctcgtgtggtggctgcggaattaagcttcgaatttttgcatcgtgtacccaatttggaattagaactctgcaagacctacttcttgaagaaatagcgttgctgtgtcctgactgcaaaacgactcggaccgatg

SEQ ID NO: 4029 - DNA, 203 bp, Homo sapiens
ggcgcgccagtcctaatttaaatatgttaataatgctgaagacaagtatttcgattattaacctctatatttctatataaagtatctgtgagtctcagtggacatcacagtaaggtcgcagttaacttgtaatcttttcattcctgtgtcggagcagtggtaatggagccggacgatttcgccaaaaccgactcggaccgatg

SEQ ID NO: 4030 - DNA, 203 bp, Homo sapiens
ggcgcgccagtcctagcagggttaataatcactcactgagtgacatcaacatcatggcgtcgcaaggcaccaaacgatcctatgaacagatggaaactggtggagaacgccagaatgccactgagatcagggcatctgttggaagaatggttggtggaattgggaggttttacgtacagatgtgcactcgactcggaccgatg

SEQ ID NO: 4031 - DNA, 203 bp, Homo sapiens
ggcgcgccagtcctggggaattccaaaagcaggtagatattgaaagatgagtcttctaaccgaggtcgaaacgtacgttctctctatcatcccatcaggccccctcaaagccgagatcgcgcagagacttgaggatgtttttgcagggaagaacacagatcttgaggctctcatggaatggctaaagacgactcggaccgatg

SEQ ID NO: 4032 - DNA, 203 bp, Homo sapiens
ggcgcgccagtcctaccacaaagatcaggtaattcgggttgttttgtttgtggacaacctggccatcgggctgcagtgtgccctcaaaaacaacaaaaccctgttaacactcctaatttgtgcccacgatgtaaaaaaggaaagcattgggcacgggattgccgttctaaaacggatgttcaaggtaacgactcggaccgatg

SEQ ID NO: 4033 - DNA, 203 bp, Homo sapiens
ggcgcgccagtccttttccttatacaggtgcattccttgtcagtgctggtcgcggcaggtggcgcccaacgtggggctcgacagttttcctcgccactactcttgtaaattggatagagtgagtatatgcgtgagtacgtaaattatattatagtggagtagtaaggtatattgttgagagtataaatcgactcggaccgatg

SEQ ID NO: 4034 - DNA, 203 bp, Homo sapiens
ggcgcgccagtcctgccccatctcccagttaatctatggggacgcgatatcttaagtaaaatgggtgtctatttatataatccttcacccaccgtaacagatttaatgttagatcaagggttactttcaaatcagggcttaggtaaacagcatcaaggtatcgtcttgccccttgatttaaaacctaacgactcggaccgatg

SEQ ID NO: 4035 - DNA, 203 bp, Homo sapiens
ggcgcgccagtccttttaatgttagatcaagggttactttcaaatcagggcttaggtaaacagcatcaaggtatcgtcttgccccttgatttaaaacctaatcaagaacgaagaggtttggggtgttttccctagggacctctgattctcctgtgacacatgccgaccccattgattggaaatctgggcgactcggaccgatg

SEQ ID NO: 4036 - DNA, 203 bp, Homo sapiens
ggcgcgccagtcctcatgtaaaaaaccacttgtacgatggaaggatccacttaccaatctgtggtatggaccagaccctgtattgatatggggacgagggcatgtttgtgtttttccacaggatgccgaagcaccgcgttggataccggaaaggctggtacgcgcggcagaggaattccctgacacatcgactcggaccgatg

SEQ ID NO: 4037 - DNA, 203 bp, Homo sapiens
ggcgcgccagtcctgcggcagggttggtggaaggaattgcccgcatcagccagtcgtgaacgtgttgagaaaaagacagcttaggagaacaagagctggggatggccgggaaggccattctgaaaggaaaggggggcggtccccctcgacgagtgtcgaaagagaccgctaagaagacgcgtcaacgccgactcggaccgatg

SEQ ID NO: 4038 - DNA, 203 bp, Homo sapiens
ggcgcgccagtcctcgcacatgtgatcctaggcgattcttgatcgcgcttattagctaaccaatttaatttggtgttgaagtgttgacacgctctctaacacatggggcagcttatcagcttctttcaggagattcctgtttttctacaggaagctctgaacatcgctttagtggctgttagtctcatcgactcggaccgatg

SEQ ID NO: 4039 - DNA, 203 bp, Homo sapiens
ggcgcgccagtcctgcacatgtgatcctaggcgattcttgatcgcgcttattagctaaccaatttaatttggtgttgaagtgttgacacgctctctaacacatggggcagcttatcagcttctttcaggagattcctgtttttctacaggaagctctgaacatcgctttagtggctgttagtctcatacgactcggaccgatg

SEQ ID NO: 4040 - DNA, 203 bp, Homo sapiens
ggcgcgccagtcctgcgcacagtggatcctaggcgtaactagatcaagttttgctgagtaaaattttaaacacattgagtatccgtgcaagacagcgcagagctccccacaatgggcaactgcaataagcctcccaagaggcctcccaacacacaaacatcatccaaccaaccctcagcagagttcagcgactcggaccgatg

SEQ ID NO: 4041 - DNA, 203 bp, Homo sapiens
ggcgcgccagtcctcgcacagtggatcctaggcggcacttgagcatggaggaatcagtaaatgaaataaaaagccttattagaaagcattttccagaaagacaggagctagcataccaaagggacatctttttatctcaacatcaccccagctctctgttgttggaagggttcaaacttctgtcaagtcgactcggaccgatg

SEQ ID NO: 4042 - DNA, 203 bp, Homo sapiens
ggcgcgccagtccttctacgtttctgctacacagtttggaattcgttctttagaagacttgctgctagaagaaccttctttgctgtgtcctgcttgcagaaatggcagataatagaggtattgatcctaaagaagggtgtagtaattggttttctcttgaagcagactgtagtgatttagatgatgatcgactcggaccgatg

SEQ ID NO: 4043 - DNA, 203 bp, Homo sapiens
ggcgcgccagtccttagaggttatttttgatgcagatcctgaaaatattatgttatacacatcctggcagttcatttactttgaagacactgatggacattggcaaaaaactgaagggcgtattgattatgctggtttatattatttggaagggcaattaagacattattacgtggaatttaaagtagcgactcggaccgatg

SEQ ID NO: 4044 - DNA, 203 bp, Homo sapiens
ggcgcgccagtccttggatattacatatcatatccagaaacaaggaatattccagaagttatatacactgagccagacacgactccaacaataataattcatacagaggatttcagtggtgattattatttacatccaagtttgagacgaagaaaaagaaaacgagcctatttgtaatttttttgcagcgactcggaccgatg

SEQ ID NO: 4045 - DNA, 203 bp, Homo sapiens
ggcgcgccagtccttgcgattgtaattattgtagttttgttgttatattttatggtggataatgttactaggctgcatgatgcttagaccataatctaaacatgtttttgatacttttaatttccttaccaacggcttttgctgttataggagatttaaagtgtacttcagatactagttatattaatcgactcggaccgatg

SEQ ID NO: 4046 - DNA, 203 bp, Homo sapiens
ggcgcgccagtccttaatagaggtaggcagttttatgagttttacaatgatgtaaaaccaccagtccttgatgtggatgacgtttaggtaatccaaacattatgagtagtaaaactacaccagcaccagtttatatctggactgctgatgaagctattaaattcctaaaggaatggaatttttctttgcgactcggaccgatg

SEQ ID NO: 4047 - DNA, 203 bp, Homo sapiens
ggcgcgccagtcctgctaaggttacacacctgtgcacatataagcgtggttttcttgacaggataagcgatactagtggttttgctgtttatgttaagtccaaagtcggtaattaccgactgccatcaacccaaaagggttctggcatggacaccgcattgttgagaaataatatctaaattttaaggcgactcggaccgatg

SEQ ID NO: 4048 - DNA, 203 bp, Homo sapiens
ggcgcgccagtcctggttttgagtttgattaagagtggtaggttgttgttacgcaataatggtcgttttggtggttttagtaatcatttagtctcaactaaatgaaacttttcttgattttgcttgttttgcccctggcctcttgctttttcacatgtaatagtaatgctaatctctctatgttacaacgactcggaccgatg

SEQ ID NO: 4049 - DNA, 203 bp, Homo sapiens
ggcgcgccagtcctgtgtaattgaaatttcgtcaagtttgtaaactggttaggcaagtgttgtattttctgtgtctaagcactggtgattctgttcactagtgcatacattgatatttaagtggtgttccgtcactgcttattgtggaagcaacgttctgtcgttgtggaaaccaataactgctaacccgactcggaccgatg

SEQ ID NO: 4050 - DNA, 203 bp, Homo sapiens
ggcgcgccagtcctgcgaacggagactacatgcaacaagtggtgaccccgacgtgatctgtctgctgagggtagctgcccggcatgcccgtgacgtggagaagagcctgtgaggtggcggcaggtcgcgcacggaagacgtattgcggttaagagcctgcgaggtggcggcaggtcgcatacgtaacacgactcggaccgatg

SEQ ID NO: 4051 - DNA, 203 bp, Homo sapiens
ggcgcgccagtcctgtccgagcacttttgcgtctgtaggcagaaataaacacgtcgcgagacctggtgtttgaccagcagggggaagacgcagtggtccgtcggtgtctgcgagagtacgttggcgactatatgagcagaatcatactctgttgcgaacagaacgagcgtcatcgtcgcgccggcacgcgactcggaccgatg

SEQ ID NO: 4052 - DNA, 203 bp, Homo sapiens
ggcgcgccagtcctctgaaaacgggagcgcggcagccgcgacagtaccagttgagagtcgattcggtcggttaacatcgtaagcatcgtggcggtggtgtgatggagtggaacacactagtattaggtcttttggttttatcggtagtggcaagttccaacaatacgtcgactgctagcacaccgcgtcgactcggaccgatg

SEQ ID NO: 4053 - DNA, 203 bp, Homo sapiens
ggcgcgccagtccttatcgggccctgtatacaagctcggtacacagccaaggtgcgggagactaggtcgtcttggaagccgatgcaacaacggtagatgagcagcaaaacgaccagaatcagcagtgagtacacgcaggcaaaccaaaccacaaggcagacggacggtgcggggtctcctcctctgtacgactcggaccgatg

SEQ ID NO: 4054 - DNA, 203 bp, Homo sapiens
ggcgcgccagtcctcagcaaaacgaccagaatcagcagtgagtacacgcaggcaaaccaaaccacaaggcagacggacggtgcggggtctcctcctctgtaatggggaaaaaagagatgataatggtgaaaggcattcctaaaattatgctcctgatctctataacgttcttgctcctttccctcatacgactcggaccgatg

SEQ ID NO: 4055 - DNA, 203 bp, Homo sapiens
ggcgcgccagtcctttcctgggatcctttctctccttctctcgggtgtaacgccaaccaccacctggatcacgccgctgaacccagcggcgcggccgcgctatgcggccaggcctcccctcctacctcatcatcctcgccgtctgtctcttcagccacctactttcgtcacgatatggcgcagaagcccgactcggaccgatg

SEQ ID NO: 4056 - DNA, 203 bp, Homo sapiens
ggcgcgccagtccttggactttgattttctgcgtctgccgcgcggtggcggtcaagtctggagcgtagtgcctagtttggttttttttcagcaaaaggccgatcgcccatctttttaccgggcttttcgctcgggccgtttcgacttgtgtaccgattctgttctggactatctgggacggcgtcaggcgactcggaccgatg

SEQ ID NO: 4057 - DNA, 203 bp, Homo sapiens
ggcgcgccagtcctatcgcccatctttttaccgggcttttcgctcgggccgtttcgacttgtgtaccgattctgttctggactatctgggacggcgtcaggatgagtctgttgcacaccttttggcggctacccgtcgccgtcttcttcgagccgcacgaggaaaacgtgctgcgctgccccgagcgccgactcggaccgatg

SEQ ID NO: 4058 - DNA, 203 bp, Homo sapiens
ggcgcgccagtcctttccaccacgtgtcgctcgctgcataaagggcgaacgtcctcggagagggtatattcgttcggcgagagcgggcggcggtggtgggtatgtccccttctgtggaggagactacctcagtcaccgagtccatcatgttcgctatcgtgagtttcaaacacatgggcccgttcgaacgactcggaccgatg

SEQ ID NO: 4059 - DNA, 203 bp, Homo sapiens
ggcgcgccagtcctcgcagtcaggccgccacgccggcggctggggcgcgcgttccctcttcgtccccgtcgcctccagtcgaaccgccatctcctgtacagccgcctgcgcttccagcgtcgccgtccgttcttcccgcggaatcaccgccgtcgctttctccctcggagccggcagaggcggcgtcccgactcggaccgatg

SEQ ID NO: 4060 - DNA, 203 bp, Homo sapiens
ggcgcgccagtcctacgcgcttaggacgactctataaaaacccacgtccactcagacacgcaacttttggccgccacacctgtcaccgctgctatatttgcgacagttgccggaacccttcccgacctcccacgaagacccgttcacctttgcgcatcccctgaccctccccccatcccgccttcgcacgactcggaccgatg

SEQ ID NO: 4061 - DNA, 203 bp, Homo sapiens
ggcgcgccagtcctgacagttgccggaacccttcccgacctcccacgaagacccgttcacctttgcgcatcccctgaccctccccccatcccgccttcgcaatgtctcaggcatcgtcctcgcccggtgagggaccctcgtcggaagcggccgcgatcagcgaggccgaagccgccagcggaagctttcgactcggaccgatg

SEQ ID NO: 4062 - DNA, 203 bp, Homo sapiens
ggcgcgccagtcctacggtggggctttgcctctttttttttgtaataaaaaaagacactcaataatccgcggttgtctctgtgtataacgtttttatttcgggttccgcgtttggtcgcctgcctatgtaaggcggcggccgcagagcgcgcgccgctcagtcgcctacacccgtacgcgcaggcagccgactcggaccgatg

SEQ ID NO: 4063 - DNA, 203 bp, Homo sapiens
ggcgcgccagtcctatttaactcgtgaggccgtccggtgaggaggacggcgacgaccgcaggttagcggcgagtcacctagacgcaaacgcgggcccggacgcgccacgctcgctctgacgccgcgcccggtgcagacgttgttcgtctccgcttctcctccgtcgcggccaggatttcaccgccgctcgactcggaccgatg

SEQ ID NO: 4064 - DNA, 203 bp, Homo sapiens
ggcgcgccagtcctgcgccacgctcgctctgacgccgcgcccggtgcagacgttgttcgtctccgcttctcctccgtcgcggccaggatttcaccgccgctatggcggccatggaggccaacatcttctgcactttcgaccacaagctcagcatcgccgacgtaggcaaactgaccaaactagtagcgcgactcggaccgatg

SEQ ID NO: 4065 - DNA, 203 bp, Homo sapiens
ggcgcgccagtcctcgaggcggcgcggcgcagcgccggccattctccgggtcgcgctgctttccccgagctccgacgcctcgcgctcacgccgccgccgcgatggagaactggtcggcgctcgagctcctgcctaaagtaggcattcccactgactttctgacgcacgtcaagaccagcgccggcgagcgactcggaccgatg

SEQ ID NO: 4066 - DNA, 203 bp, Homo sapiens
ggcgcgccagtcctgatccaccagacgttgtttcgattgtgctcggcggccgcagccacatcgggcctgtgttcatcccctcccccattgtgtgtgtcctcatcttcctccgtcccttctgtcccaacctccgtcagcgttgacggcagttctgaacccacgtcgccgcgagtgcggtttgcatcacgcgactcggaccgatg

SEQ ID NO: 4067 - DNA, 203 bp, Homo sapiens
ggcgcgccagtcctatcttcctccgtcccttctgtcccaacctccgtcagcgttgacggcagttctgaacccacgtcgccgcgagtgcggtttgcatcacgatgatggaagccgcggccgctgccgccgcggcgtttcgtccggaggagcgtccgacgccgggttggcacgacgcggcgttgttaatgcgactcggaccgatg

SEQ ID NO: 4068 - DNA, 203 bp, Homo sapiens
ggcgcgccagtcctgacgacaccactagggacgacgaagacgaacgagtgacggcgcccgtcccacaagccacgtccgcgacaacgtggttttcaggtggatcctccgtcgtcctcgcggacgccatctttttcctctcctctcgccgctgccgcctaacctccgctcgcaccaccgccgccgccatccgactcggaccgatg

SEQ ID NO: 4069 - DNA, 203 bp, Homo sapiens
ggcgcgccagtcctccgcttggaactggtcgcgtccgtgttcgagcacctgacggtggagtgcgtcaacgacatcctggacgcctgcagccacccggacgtgaacgtcgtggagacaagcaacacctgtcgtccctgcccttctcctgttccctccgcccccaaaactgtcagcgacgctcagacgtccgactcggaccgatg

SEQ ID NO: 4070 - DNA, 203 bp, Homo sapiens
ggcgcgccagtcctatagcacgttcctttttttttgtttttgcatcacttatcgccactatcagtgcaatattttgattgtgagactgaaagagtatcgttatgatgcttagaacgtggatatcattaccgatggtactgcttgacgcgtactgtttttgtatttttgtgagttgttcaatcagcacgcgactcggaccgatg

SEQ ID NO: 4071 - DNA, 203 bp, Homo sapiens
ggcgcgccagtcctgcctcgttgcacgagtgggccagcccgagttcggggtgcatcatctggtagcgcttgcggcacagcgccgccacattggtgaaggccgtggagatgcaggaggtggggtggctcttgcgcttctgcagctccgcgtagcgctcctggatcttggcggccgaatctccgcgcaaccgactcggaccgatg

SEQ ID NO: 4072 - DNA, 203 bp, Homo sapiens
ggcgcgccagtccttataacgcctttcggcgcaccaccagcataatctgcgaggaggaccttgacggtgactgccgtcaactgttccccgagtaacctggacgcggaacgtgacggttgccgaggggaaaggcgacagagaaggtacaaacccaccggcggggaaaatactgaggcgccgccatcatccgactcggaccgatg

SEQ ID NO: 4073 - DNA, 203 bp, Homo sapiens
ggcgcgccagtcctaagcgaactgggctgcgagttgctggccggcggtcgcgttttccactgcgaccacatcccgctcctgctcatcgtcacgcccgtggtctttgaccctcagtttacgcgccatgccgtctctaccgtgttagaccgttggagtcgcgacctgtcccgcaagacgaacctaccgatcgactcggaccgatg

SEQ ID NO: 4074 - DNA, 203 bp, Homo sapiens
ggcgcgccagtcctctttgaccctcagtttacgcgccatgccgtctctaccgtgttagaccgttggagtcgcgacctgtcccgcaagacgaacctaccgatatgggtgccgaactctgcaaacgaatatgttgtgagttcggtaccacgtccggtgagcccctgaaagatgctctgggtcgccaggtgcgactcggaccgatg

SEQ ID NO: 4075 - DNA, 203 bp, Homo sapiens
ggcgcgccagtccttcccatcgtagtatttaacgacccgcgagcctgtcgtcatccgcgcgcccccatcgcctcccgagcgagcgggccgccgctatcgccatggccccctcgcacgtggataaggtgaatacacggacatggagcgcttctatcgttttcatggtgctgacttttgtcaacgtcagccgactcggaccgatg

SEQ ID NO: 4076 - DNA, 203 bp, Homo sapiens
ggcgcgccagtcctgatagcggcggcccgctcgctcgggaggcgatgggcgcgcgccgatgacgacaggctcgcgggtcgttaaatactacgatgggagccgccgcggctcacgacgcggtttgagcacgtccgggcggtcggtgaaaaaagaccccgcgggccttcgcgactctcttctgtccgaggcgactcggaccgatg

SEQ ID NO: 4077 - DNA, 203 bp, Homo sapiens
ggcgcgccagtccttagaccgtctccgggacatcgcccgtcctctgaaataccgctatcaacgtcttgtcgctaccgtgtagctagttagccagctgtgtgtagttgtattttgcttttgcatatttgttttcagtcagagagtctgaaacggggtgggagggacttttgcgggtagtgcatgctaagcgactcggaccgatg

SEQ ID NO: 4078 - DNA, 203 bp, Homo sapiens
ggcgcgccagtccttagttgtattttgcttttgcatatttgttttcagtcagagagtctgaaacggggtgggagggacttttgcgggtagtgcatgctaagatgaacggatgggctggggtgtgcttgataactcactgtttgaatacgcgctcacgcacatatgtagcactcaacatgttagcttttcgactcggaccgatg

SEQ ID NO: 4079 - DNA, 203 bp, Homo sapiens
ggcgcgccagtcctcaggaacgcttgaaaggtccgcgccgcgccgcttgatcacggcagacgaggagcggcgcggcccagagcgtgtcggccgatttcgaaatggaggccctgatgatccgcggcgtgctggaggtccatacggatttcactagacagaatgtgatgatcatggagccgcaagtgctccgactcggaccgatg

SEQ ID NO: 4080 - DNA, 203 bp, Homo sapiens
ggcgcgccagtcctagcgcgcggaagggaaagaagggccaacggtcgacgcagggcacgcgcgtgccgccggcctcggacgaagcggcagcggcggcagaagaggagacggaggagtgaacggtcgccgttgccgcggcggtagttgcggcagaggggttgttatctgtcgttcgttcaacgcgactgcgactcggaccgatg

SEQ ID NO: 4081 - DNA, 203 bp, Homo sapiens
ggcgcgccagtccttcggccacgcgccgcaccgtgatggtgtcaaagagcgtcttgcacactccgtagagcagctgcttgcgcagcacgcacgggtcgcgcagcacctggtgcatgctctggccgcgacacgtccccagaaagccgtgcagcaaccgcaggaagctcatcgtctggcccgtggggaaacgactcggaccgatg

SEQ ID NO: 4082 - DNA, 203 bp, Homo sapiens
ggcgcgccagtcctaaaaaattgacaaaaacatcataacataaaggaccacctacctgggacgcgcagttgggcggcggattggggcggcatgctgcggcgatgctgtcggtgatggtctcttcctctctggtcctgatcgtcttttttctaggcgcttccgaggaggcgaagccggcaacgacgacgcgactcggaccgatg

SEQ ID NO: 4083 - DNA, 203 bp, Homo sapiens
ggcgcgccagtcctaacgtactgtttaaccacgttgcgtcgtgacgttgtttgtgggtgttgctaggcgggctggaaagatgatgtataaatagagtctgcgacggggttcggcgctctgccggctgcggcggcactcgctccacggcctccgacgagcgttgcgctcgcgctttgcgccgccgcgtccgactcggaccgatg

SEQ ID NO: 4084 - DNA, 203 bp, Homo sapiens
ggcgcgccagtcctcgctgctacgccacctagataaatactacgccggactgccgcccgagctgaagcagacgcgcgtcaacctgccggctcactcgcgctatggccctcaagcagtggatgctcgctaacattgctgataataaaggctctctgttaacccccgacgagcaggctcgcgtgttttgtcgactcggaccgatg

SEQ ID NO: 4085 - DNA, 203 bp, Homo sapiens
ggcgcgccagtccttaacgttttagggatcgaagacctgagtgccaacttttggcgccaactggctccttaccgtcacactctcatcgtgccgcagacttgatgtgccgccgcccggattgcggcttctctttctcacctggaccggtgatactgctgtggtgttgccttctgctgcccattgtttcccgactcggaccgatg

SEQ ID NO: 4086 - DNA, 203 bp, Homo sapiens
ggcgcgccagtcctggtctcgggcgccaccaagaaagacctgttcgacgccgtaaccctgtgcgcttccatcgtagaaaagcagccagacgtatttaatatcaacgtcagcttgttgacgtacccttcgatcgcggcgccccacttgccgctgtacaacgaattcaccagctttcgcctgcccacctccgactcggaccgatg

SEQ ID NO: 4087 - DNA, 203 bp, Homo sapiens
ggcgcgccagtcctcaacgtcagcttgttgacgtacccttcgatcgcggcgccccacttgccgctgtacaacgaattcaccagctttcgcctgcccacctcatgaagcggcggcggcgatggcggggctggttgcttttcctggccctgtgcttttgcttactgtgtgaagcggtggaaaccaacgcgcgactcggaccgatg

SEQ ID NO: 4088 - DNA, 203 bp, Homo sapiens
ggcgcgccagtccttgtgttgtttttatttcgctgacttctacggggtttcccctcagcctctgtgttcccaacccgtccccccgctgagcgttggcggcgatggtcatgttctcccaggaccacgtccagatcgtctacggctccacacgcatctgcaagtccctggccccggccaacaagagaaagcgactcggaccgatg

SEQ ID NO: 4089 - DNA, 203 bp, Homo sapiens
ggcgcgccagtccttggagctggacgtttaggcgtcacaagaggtgacgcgacctcctgccacatatagctcgtccacacgccgtctcgtcacacggcaacatgtgttccgtgctggcgatcgcgctcgtagttgcgctcttgggcgacatgcacccgggagtgaaaagtagcaccacaagcgccgtccgactcggaccgatg

SEQ ID NO: 4090 - DNA, 203 bp, Homo sapiens
ggcgcgccagtcctgtgatttcccgtgacagtattaacgtgtggtgagaatgctgtttaataaaagtagcttttttatacatctccgtctctggtctcctgatgtgggggtgcgggtggtcccggatacttgtccttctcctcctcatgtgtatggccctgatggcgagaggcacatacggggcttaccgactcggaccgatg

SEQ ID NO: 4091 - DNA, 203 bp, Homo sapiens
ggcgcgccagtcctaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactagcctgcgtcacgggaaataatcgactcggaccgatg

SEQ ID NO: 4092 - DNA, 203 bp, Homo sapiens
ggcgcgccagtcctgattcatcgtgcagtacctcaacacattgctgattacaatgatggcggcgatatgggctcgcgttttgataacctacctggtgtcgcggcgtcggtagaggcttgcggaaaccacgtcctcgtcacacgtcgttcgcggacatagcaagaaatccacgtcgccacgtctcgagacgactcggaccgatg

SEQ ID NO: 4093 - DNA, 203 bp, Homo sapiens
ggcgcgccagtcctggcgtcggtagaggcttgcggaaaccacgtcctcgtcacacgtcgttcgcggacatagcaagaaatccacgtcgccacgtctcgagaatgccggccccgcggggtccccttcgcgcaacattcctggccctggtcgcgttcgggttgctgcttcagatagacctcagcgacgttcgactcggaccgatg

SEQ ID NO: 4094 - DNA, 203 bp, Homo sapiens
ggcgcgccagtcctcgtcacttgtgtgatctgagacgtcatgctggtagcgtttatgagtcgggcggtggccggcacgccgcatttcctaacccgcgcagcatgttgcgcttgctgttcacgctcgtactgctggccctctagggaccgtctgtcgacgctagccgcgactatgtgcatgttcgactacgactcggaccgatg

SEQ ID NO: 4095 - DNA, 203 bp, Homo sapiens
ggcgcgccagtccttcacatcaaccggctattttttcggttagtcttagacgaggaacaacgcatttacgacgtagtgtctacaaatattgagttcggtgcctggccagtccctacggcctacaaagcctttctctggaaatacgccaagaaactgaattaccactactttagactgcgctggtgatccgactcggaccgatg

SEQ ID NO: 4096 - DNA, 203 bp, Homo sapiens
ggcgcgccagtccttcaaaatggctagacaaacgcaacgataacaggtggtataatgttaatgtaacaagacaaccggaacgagggccgggaaaaataactgtaaccctagtaggtctgaaggaataatatttagtatatattttaaacagacaagtttgttagagcagaaaatatcatgttttcaatcgactcggaccgatg

SEQ ID NO: 4097 - DNA, 203 bp, Homo sapiens
ggcgcgccagtccttactttttgccgacgtcaggaaaaataagctgtcgcctacataagagcccggtgctatcgtgctgtcactctttcttgttgccttcgatgtacggcgtcctggctcattactactccttcatcagtagtcccagcgttatggttaattttaagcatcataacgctgtgcagctgcgactcggaccgatg

SEQ ID NO: 4098 - DNA, 203 bp, Homo sapiens
ggcgcgccagtcctggctgactatcctgttctgtcctggaaaaactttcagcgtcgtaggtggactttgtagtatgcgggttagtgaagttatgtcatttatttacgtttacgatctcgtattacaaaccgcggagaggatgacaccgttcggccccatgagttatttttattcttccggtaggaggccgactcggaccgatg

SEQ ID NO: 4099 - DNA, 203 bp, Homo sapiens
ggcgcgccagtccttttacgtttacgatctcgtattacaaaccgcggagaggatgacaccgttcggccccatgagttatttttattcttccggtaggaggcatgaagcctctggtgatgctcatctgcttcggtgtgatattattgcagcttggggtgactaaagtgtgtcagcataatgaagtgcaacgactcggaccgatg

SEQ ID NO: 4100 - DNA, 203 bp, Homo sapiens
ggcgcgccagtcctagaggcagcaaaaaagacctgtaaaaaaaccggacgctcagttgcgggcatcccgggcgagaagctgcgtcgcacggtggtcaccaccacgccggcccgacgtttgagcggccgacacacggagcaggaacaggcgggcagcgtctctgcgaaaaagggaagaaaagaatcatccgactcggaccgatg

SEQ ID NO: 4101 - DNA, 203 bp, Homo sapiens
ggcgcgccagtcctcacgccggcccgacgtttgagcggccgacacacggagcaggaacaggcgggcagcgtctctgcgaaaaagggaagaaaagaatcatcatgtgccgccgggagtcgctccgaactctgccgtggctgttctgggtgctgttgagctgcccgcgactcctcgaatattcttcctctcgactcggaccgatg

SEQ ID NO: 4102 - DNA, 203 bp, Homo sapiens
ggcgcgccagtcctcggatatgttcggtttcaaactcactgtttgaatatagggacagtccctacggaacctgagaacatgtggaaatcacctgtggtagaatgctgttcaggtacattacctttcatcgcgaaaaggtactttacctaacggctgcatgcatctttggtgtctacatcagcctccaccgactcggaccgatg

SEQ ID NO: 4103 - DNA, 203 bp, Homo sapiens
ggcgcgccagtcctcctcgatggtcggacatcgaggaactcttggaaaaggcggtgcagagcgtcatgaaggacgccgagtcaatgcagatgacctgagaccgaaacagcgagcgcgtccgttgtacagttgtatagcagcacacgccttccctctttttcaccgcagctaagagagagaaagagagtcgactcggaccgatg

SEQ ID NO: 4104 - DNA, 203 bp, Homo sapiens
ggcgcgccagtcctcgaaacagcgagcgcgtccgttgtacagttgtatagcagcacacgccttccctctttttcaccgcagctaagagagagaaagagagtatgtcagtcaagggcgtggagatgccagaaatgacgtgggacttggacgttggaaataaatggcggcgtcgaaaggtcctgagtcgccgactcggaccgatg

SEQ ID NO: 4105 - DNA, 203 bp, Homo sapiens
ggcgcgccagtcctcgcccccggtgtgataaggaattttccgacttggctcacatctccttcctcagtgtttggacaataaacacattccttgccaaaaaatgacgtttccagaaatccaaggcataaatgtccgtacaccggcccttcccgacacggagtttgagattccaagcaggagagaagatccgactcggaccgatg

SEQ ID NO: 4106 - DNA, 203 bp, Homo sapiens
ggcgcgccagtcctgacggttcgtccacggagcaggagatctaccacacgcgactttaagtcacggaggaagttacgtgggtaggagggcaccgtgccccgaggcggcgacgggctagcgtataacaagccgcgcgacaacgggcgagcggcggtgagacacacgcgcgcacgtcggcggcgatagcccgactcggaccgatg

SEQ ID NO: 4107 - DNA, 203 bp, Homo sapiens
ggcgcgccagtcctccagcagcgcgcacgacgcgatcacggtaacccccatgactagacccacgcagatagccagccccgctagcgtatccagcgccatcccgttcgctcccgtcgtcgtctcctgaacaaagcaacaactccgcagtccccgttttcaaccgtttttgtttccttctccgcgagcaacgactcggaccgatg

SEQ ID NO: 4108 - DNA, 203 bp, Homo sapiens
ggcgcgccagtcctggggacgggggactcttgcggcggggacggggacgggggcctttcgcggcggacacggggaacacagacggcacgcacacgcagctcgcctcagcggtcgccctatcacaaccgccgctactctttattaacgtcttcatccccccgcttctacacgcaacgctgcatacagctcgactcggaccgatg

SEQ ID NO: 4109 - DNA, 203 bp, Homo sapiens
ggcgcgccagtcctgcctcagcggtcgccctatcacaaccgccgctactctttattaacgtcttcatccccccgcttctacacgcaacgctgcatacagctatgctcacactctatctcttcacagcgacatgttgcttcgtctgtgcactgccgcgacaagcacaagtggacaccgccatctgccaccgactcggaccgatg

SEQ ID NO: 4110 - DNA, 203 bp, Homo sapiens
ggcgcgccagtcctcgcgtgttattgtaggttcgttgccagatggcaagtgctgtcaacagcagacgttgtgggcggtcggtgtatttttgtgggttgcggtgagagtcggcactcggtgttttgtgagtgatctcaacagtttgtgttgcttttagcagcgtccaaaacagcgacgcgactttggggcgactcggaccgatg

SEQ ID NO: 4111 - DNA, 203 bp, Homo sapiens
ggcgcgccagtccttgagagtcggcactcggtgttttgtgagtgatctcaacagtttgtgttgcttttagcagcgtccaaaacagcgacgcgactttggggatggcctcgtgctcaccgccgcggagagtgtcgccggacctgctcgtcagcagcgagctacgcagacggaatatctggaggagagttcgactcggaccgatg

SEQ ID NO: 4112 - DNA, 203 bp, Homo sapiens
ggcgcgccagtcctcgacggagccgtccgcgtgtgtaaacggcgtggtcgctgacgcgggtttgcttcctatatagtggacgtcggaggtgtccggcggccatggcccagcgcaacggcatgtcgccgcgccccccgcccctcggtcgcggccgcggggccggagggccttcgggggttggttcctctcgactcggaccgatg

SEQ ID NO: 4113 - DNA, 203 bp, Homo sapiens
ggcgcgccagtcctaccgaaaggatccaagggggctttccaaagccgacgtccctgattcccttcataaagctgttgaccggccctagaaagaccaagagcatgctgtgggcccactgcggtcgcttcttgcgttatcatctgctcccgctgctactgtgtagactgccattcttactcttttttcagcgactcggaccgatg

SEQ ID NO: 4114 - DNA, 203 bp, Homo sapiens
ggcgcgccagtcctgttgagcggggtatgcgtgttcagttgggcggcaggggcatgcggccttagcggctcgggctggcgtgctgttttccgtgttgccgacggcggcggggtccgtcgagaccgggggaccgcggagcggaggaggtgacctggctgcttaatgacagcgacggagaggaagaagagcgactcggaccgatg

SEQ ID NO: 4115 - DNA, 203 bp, Homo sapiens
ggcgcgccagtcctcggcggcggggtccgtcgagaccgggggaccgcggagcggaggaggtgacctggctgcttaatgacagcgacggagaggaagaagagatggcgtccgggctcggtgacctctcggtcggcgtgtccagccttcccatgcgggaactggcctggcggcgggtagccgacgactcacgactcggaccgatg

SEQ ID NO: 4116 - DNA, 203 bp, Homo sapiens
ggcgcgccagtcctagtaccgtaacgcctcttttggcacgtagttgcctactacgtaggggaaacaacgtcaccaagaaacgctatatattcaaaaacaccgtgcagtccacacgctacttctcagcgaagcactgctgcagccagaccggagcggtgagcggagccgagcagcggaccttcggagcccgactcggaccgatg

SEQ ID NO: 4117 - DNA, 203 bp, Homo sapiens
ggcgcgccagtcctacgctctcgtcaggcttgtcatggtccgtaaaagctgcatgaaaaacacgacgaaagcgttcagtgttggatcagactcacgtcacacgttacatcatacaacgtagggcggtattgttgagaacatatataatcgccgtttcgtaagtacgtcgatatcgctccttcttcactcgactcggaccgatg

SEQ ID NO: 4118 - DNA, 203 bp, Homo sapiens
ggcgcgccagtcctcgttacatcatacaacgtagggcggtattgttgagaacatatataatcgccgtttcgtaagtacgtcgatatcgctccttcttcactatggacctcttgatccgtctcggttttctgttgatgtgtgcgttgccgacccccggtgagcggtcttcgcgtgacccgaaaacccttcgactcggaccgatg

SEQ ID NO: 4119 - DNA, 203 bp, Homo sapiens
ggcgcgccagtcctacgctgatgatggtggcagtgattcaagtgttttgggggctgtatgtgaaaggttggctgcaccgacattttccctggatgttttcggaccagtggtgatatatagactgaagcggagtgcatctcgagtcgctcggaaacgactcaccagactttttgctttaacccaaaacccgactcggaccgatg

SEQ ID NO: 4120 - DNA, 203 bp, Homo sapiens
ggcgcgccagtcctgaccagtggtgatatatagactgaagcggagtgcatctcgagtcgctcggaaacgactcaccagactttttgctttaacccaaaaccatgctacgccggggaagcctccggaaccctctggcgatctgcctgttgtggtggctgggagtggtggcggcagccacggaggagacgcgactcggaccgatg

SEQ ID NO: 4121 - DNA, 203 bp, Homo sapiens
ggcgcgccagtcctccccgtgacgtgcaagactacatgctataagatagccttacagcttttgagtctagacaggggaacagccttcccttgtaagacagaatgaatcttgtaatgcttattctagccctctgggccccggtcgcgggtagtatgcctgaattatccttgactcttttcgatgaacctcgactcggaccgatg

SEQ ID NO: 4122 - DNA, 203 bp, Homo sapiens
ggcgcgccagtccttgatcgtgctcagtcccaacctctggcgcctgccctggacgaccgtctttgccgccttcagatcctcgtattgcgaaggtggcggtggctcgtagccaccacccatcgtccccctttctctataaaacttgccgggtacctgaagccccgacgactgttcgtcgagcacccgtccgactcggaccgatg

SEQ ID NO: 4123 - DNA, 203 bp, Homo sapiens
ggcgcgccagtcctctacctggccaagctgggcacctatcatcattaccgggttgacaacggcacgctcagcgtcatcctcaacagcaccaccgcgacgttccagagcagggttgcttgagacccgctggtttataagaagactccaccgagacgctcacccgttcactcgggcgcatcacccgcctccgactcggaccgatg

SEQ ID NO: 4124 - DNA, 203 bp, Homo sapiens
ggcgcgccagtcctccagagcagggttgcttgagacccgctggtttataagaagactccaccgagacgctcacccgttcactcgggcgcatcacccgcctcatggacccgccgctgccgtcgctacattcgccgcaatgggcttccctcctgcagctgcaccacggccttatgtggctgcgccgttttcgactcggaccgatg

SEQ ID NO: 4125 - DNA, 203 bp, Homo sapiens
ggcgcgccagtcctgccgctggaacgcgcgcttttggcggccgtcaaggtgtttctcagcctggttttcactctgctgatggtgctgagaatcatgaccctgcgcacctttttgcaaacctacttttcctctgacaagctgtagcttcgagaccttgcggatacgccgccgggcgctgcggtcccgaccgactcggaccgatg

SEQ ID NO: 4126 - DNA, 203 bp, Homo sapiens
ggcgcgccagtcctgcgcacctttttgcaaacctacttttcctctgacaagctgtagcttcgagaccttgcggatacgccgccgggcgctgcggtcccgacatggagacagtttccacgcagcgggaaaccgcgtcgtcggaaacggagcgtaccagggaagccgcgtccgcggaaacgacggacgctcgactcggaccgatg

SEQ ID NO: 4127 - DNA, 203 bp, Homo sapiens
ggcgcgccagtcctaacgccgttgtccaccctctcgccctagattttcgttcggaactggttttcggacagagcagccgtttccagagaacgcagcgcaccatgagaagagaaaaagggtttcaagtacccaccgatggcacggtcatctacgtgccccccgggatccaagagacccggctggcgacccgactcggaccgatg

SEQ ID NO: 4128 - DNA, 203 bp, Homo sapiens
ggcgcgccagtcctacagaacaccgcaactcggtgttgtactcgtgttttttattcaacaataaagctttttcacgcttactcgagtgtgacgtgactttatgggggaacgccgtgtgggaatgacggtgattatattacactctataaacggtttctcatacgcgccttttgatagccaccgccgtccgactcggaccgatg

SEQ ID NO: 4129 - DNA, 203 bp, Homo sapiens
ggcgcgccagtcctgtaccatcttctgaggctctggttgtggagcccatgacgacgggtcggatacagggtgccgccacggtttgaccacactcgtgacgtcaatcaaatccgcggtaaccgggtgctgataagacggactgtttcatcgacgcctaccttagaccgacagcggtcgtaagcggcagccgactcggaccgatg

SEQ ID NO: 4130 - DNA, 203 bp, Homo sapiens
ggcgcgccagtcctacgggactttgacagccgccagtacgacggggaagtcctaatgcctataaaaccgcgcccgttttcacagcagccgcgcttgtcgccatgcttcatgtcgtcccgctagaatggaccgtcgaggaggtagtcccctacctagagaggctggcggtatggctgcgcgcctccgtccgactcggaccgatg

SEQ ID NO: 4131 - DNA, 203 bp, Homo sapiens
ggcgcgccagtcctctgctcagacgacggtcgctgcgacggtcgctgccacagcagcggcgtcgccccagttcgtctcctaatcgacgtgtccgcggcgtgaccacgtcaccgtgccccactcgctcgcttgtgtataagagaagggtaggtgcgccgcagcggctttgtgccgagaccgtcgccacccgactcggaccgatg

SEQ ID NO: 4132 - DNA, 203 bp, Homo sapiens
ggcgcgccagtcctcagccgcgattcgtctgacgctgctcctatattaagctttcgcgcagcgcgctttatccgactcgctgtcgagacggctttgccggcatgtccctactcaccaaagccgccgccgaagcctggggcacctatctccgacagcgcgacgagcgctgcgaagatgctatccgctgccgactcggaccgatg

SEQ ID NO: 4133 - DNA, 203 bp, Homo sapiens
ggcgcgccagtcctcggaggacgcggaataaaacgtgtcgcacaaagaactctctttctctgcttcttttctggggtgtctagctggcggcctcttttgacatgtggcgtacacgctgggaagacggagctcccacgtttacgcgaaacgatgaattcctctattgccacacgcgctacgaaacttttcgactcggaccgatg

SEQ ID NO: 4134 - DNA, 203 bp, Homo sapiens
ggcgcgccagtcctctttgcggtcgcacatgttccaaattacgtgagtctttgacgtcgatgtcagtcttttcgggtggtttacagaccggagctgccaaccgcagcccacgaacgacgtgaacaagccacgtcactgaagaaactccataaaataggctgccaagtgccgctccacgccgcggcacccgactcggaccgatg

SEQ ID NO: 4135 - DNA, 203 bp, Homo sapiens
ggcgcgccagtcctgccctgacctccctctgccacctgctgtgctactggtgttccgaatcgtaccggcgtctgaacaccgaagaggaaaacgaggcggcggaggaaactgccgcgggagaagcctctgcggtagcggcggcggccgtctctgaggaagagcagcagcgggagtaaacgaggagagcccgactcggaccgatg

SEQ ID NO: 4136 - DNA, 203 bp, Homo sapiens
ggcgcgccagtcctattataccgtaataaaaaagcgctacctcggccttttcatacaaaccccgtgtccgcccctcttttccccgtgcccgatatacacgatattaaacccacgaccatttccgtgcgattagcgaaccggaaaagtttatggggaaaaagacgtaggaaaggatcatgtagaaaaaccgactcggaccgatg

SEQ ID NO: 4137 - DNA, 203 bp, Homo sapiens
ggcgcgccagtcctggggcttcatgctgacgtaggtaccgactggggtcaaaagcctgggtacttatggggagcgcgcacaaaggaccgtcaggcgccggcatggagcgtcgccgaggtacggtaccgctgggatgggtgttttttgttctttgcttatctgcctcttccccgtgtgctgttgatctgcgactcggaccgatg

SEQ ID NO: 4138 - DNA, 203 bp, Homo sapiens
ggcgcgccagtccttagtgacggtacccacgctgctgttatatacgtcatccgacatcggtgacacagcttcagaaacaacgtgtgtggcgcacgctacttatggggaacccccggagcccgctcgatcgacggctacggttcaggaatgtaccgttcttaccgccccgaattgcggcatcgtcaacacgactcggaccgatg

SEQ ID NO: 4139 - DNA, 203 bp, Homo sapiens
ggcgcgccagtcctgctcctcctgcggttccctcgcagccccccgagtattcgtctgtgtttccgcctgtataaaaataaagagacgggaggctgatcgcggccttcagcgtctcatttgtctttactctcgagtgcggtcggtgtctcatcggtgagacgaggccgccgcccgacaagttcgatctccgactcggaccgatg

SEQ ID NO: 4140 - DNA, 203 bp, Homo sapiens
ggcgcgccagtcctgagagtaactgcagtctacgcacccacggcgtgtacacacggggtgaacaacactaatcgataagtcgcgtgtaggcgactggctacatcaaccggatatctgcggggatttaaaaagacgacccgttgtcatccggcttagagcaaaccgtccttttatcatcttccgtcgcccgactcggaccgatg

SEQ ID NO: 4141 - DNA, 203 bp, Homo sapiens
ggcgcgccagtcctccgtgacttggctgaacgttgaaacataaagccaaagcgccgtcggcacttggcttcagagcagcgcctcggggcgatgcgacggcgatgaacttagagcaactcatcaacgtccttggtctgctcgtctggattgccgctcgtgctgtcagccgcgttggtccgcatggctcccgactcggaccgatg

SEQ ID NO: 4142 - DNA, 203 bp, Homo sapiens
ggcgcgccagtcctgcgactgtgtcagcggctgcgcattcgcctgccgcatcgataccagcggttacgcaccgaggactgaacggataaccgcaaaggccacgtgcaacgttcacgctgctataagaaggccatgtcccccgtggacgggtctctttgacacgagcgcggcacgccgttgccacgagccgactcggaccgatg

SEQ ID NO: 4143 - DNA, 203 bp, Homo sapiens
ggcgcgccagtcctggtccctgatcacccgacagctaacaaacgctataacaccatgaccatcagcagtgtcctcctagccctgcttttatgcgctttgctattcgcgttcctgcactactttaccaccttgaaacaatacctacgtaacctggcctttgcgtggcgctatcgcaaggtccggtcgtccgactcggaccgatg

SEQ ID NO: 4144 - DNA, 203 bp, Homo sapiens
ggcgcgccagtcctattcgcgttcctgcactactttaccaccttgaaacaatacctacgtaacctggcctttgcgtggcgctatcgcaaggtccggtcgtcatgaccagcaacgccctgtatgagctgtttcgacgtcggttaccgcgtgcccccgtcaacacggtcatgtttctcacgcgacgcactcgactcggaccgatg

SEQ ID NO: 4145 - DNA, 203 bp, Homo sapiens
ggcgcgccagtcctcgggacgaaagacgacgtcaggggattcacggtatttagccatgcagcgtgcggcgcctctctcatggatccactgtcaccgtcgcgatgggaggtagccctgttccccagctcaccaccgtcactcaaggactcatgccatctgtgcgcatggactttcgggctcgccggccccgactcggaccgatg

SEQ ID NO: 4146 - DNA, 203 bp, Homo sapiens
ggcgcgccagtcctacatgacctcgagatgtcgtcacccaaggtatttaacggcacacagccagacgcgttcgtcagcagcgacgccgacaagacctcagcatggctcggaggctatggatcttgagcttactagccgtgaccttgacggtggctttggcggcaccttctcagaaatcgaagcgcaggcgactcggaccgatg

SEQ ID NO: 4147 - DNA, 203 bp, Homo sapiens
ggcgcgccagtcctgcgtgctcgtgaaaacgctgtcctccgcctcctcatccgccggcgtgtcctcgttgctcgaggggatataaatcaccgtcgagggttcgccagagcgacgtgacgagctgcgacgccgcgacgacatcctctcgtctgctgaggtgcgttcggctcagttgcttacctgcataccgactcggaccgatg

SEQ ID NO: 4148 - DNA, 203 bp, Homo sapiens
ggcgcgccagtcctcggccctcactatataacgtcccgcccgggtctcctccatgtatgcaggtaagcaactgagccgaacgcacctcagcagacgagaggatgtcgtcgcggcgtcgcagctcgtcacgtcgctctggcgaaccctcgacggtgatttatatcccctcgagcaacgaggacacgccgcgactcggaccgatg

SEQ ID NO: 4149 - DNA, 203 bp, Homo sapiens
ggcgcgccagtcctggcctcacgaggtcggaggtcacgccacatgaagccgcggcggcgcgttataagcaccgtggggtcatcgaccgacgaggcgcggcgatgacgagcaggcgcgcacccgacggcggtttgaatttagacgattttatgcgccgccagcgcggtcgccacctggatctgccctatcgactcggaccgatg

SEQ ID NO: 4150 - DNA, 203 bp, Homo sapiens
ggcgcgccagtcctctgtgatgactagctatatagccgctgtctggctttaccgccgtcgctccgcgtcgcttcgccgccaccttcttcttcctctcagtcatgaaccccgtggatcagccgccacctccaccgctaacccagcagccggaggagcaggctaaagaagaccatgacgacggtgacgagcgactcggaccgatg

SEQ ID NO: 4151 - DNA, 203 bp, Homo sapiens
ggcgcgccagtcctgtccgagacggtgtatataaaccgcgtcggcctcgccggcccgagcgcgccggggagaagaatctcttcccgggccctgcgttcaagacggcgtgccgtgacgctcgatgggtccgcttcatcagactgcgtacgctttggagcgtcagacccagggcgcatgtagccgacttgcgactcggaccgatg

SEQ ID NO: 4152 - DNA, 203 bp, Homo sapiens
ggcgcgccagtcctaagagattcttctccccggcgcgctcgggccggcgaggccgacgcggtttatatacaccgtctcggacggcgggacgccgagcccgcgccgcggccgctcatccggagacggcggaaaccgcggcgccggaggaaacggggaccggcaacgacggcggtggcggcgaccagattcgactcggaccgatg

SEQ ID NO: 4153 - DNA, 203 bp, Homo sapiens
ggcgcgccagtcctcagcggcgcccgggtgaaaaccgcgtatccgcctccgctattaaactaccccccctccctctaggtggggcgctcaccgtggtgttgtggatgatggtgtccatcgtggacgaatagcagaccgcgggcgcagtccggggcgacgacgcttccgggttctggagaaaagccagccgactcggaccgatg

SEQ ID NO: 4154 - DNA, 203 bp, Homo sapiens
ggcgcgccagtccttggatgatggtgtccatcgtggacgaatagcagaccgcgggcgcagtccggggcgacgacgcttccgggttctggagaaaagccagcatgagtttgcagtttatcggtctacagcggcgcgatgtggtagccctggtcaactttctgcgccatctcacgcaaaagcccgacgtgcgactcggaccgatg

SEQ ID NO: 4155 - DNA, 203 bp, Homo sapiens
ggcgcgccagtcctataaactgcaaactcatgctggcttttctccagaacccggaagcgtcgtcgccccggactgcgcccgcggtctgctattcgtccacgatggacaccatcatccacaacaccacggtgagcgccccacctagagggagggggggtagtttaatagcggaggcggatacgcggtttcgactcggaccgatg

SEQ ID NO: 4156 - DNA, 203 bp, Homo sapiens
ggcgcgccagtcctacgccgtccggcgcaacttctgtctcggcacggtacgataaaaacgacgtcccccgtcgacgttgttttctccgagcggtgatcgttcccgtccctctcctccctccgcggcccccacggcggcggcctgctcgcacggacctatactattaccgccccaccgccgtcgtcgtccgactcggaccgatg

SEQ ID NO: 4157 - DNA, 203 bp, Homo sapiens
ggcgcgccagtcctcccgtccctctcctccctccgcggcccccacggcggcggcctgctcgcacggacctatactattaccgccccaccgccgtcgtcgtcatgaacttcatcatcaccacccgagacttctccaacgacgattcagtcctgcgagccgccgagatgcgtgacaacgtggcaggctcgcgactcggaccgatg

SEQ ID NO: 4158 - DNA, 203 bp, Homo sapiens
ggcgcgccagtcctgaagttccagcacaaaaaacgacgttcattggatcgtctgacgtcaacgctgatagtgtctataaaggccgtgccgccgcgccgtagttctccgaaggcggacggaggagtctgtcgaccgcagcggtggctggagaagcgcagcgtcggcgagcgaaggtagaggagtccgtccgactcggaccgatg

SEQ ID NO: 4159 - DNA, 203 bp, Homo sapiens
ggcgcgccagtccttgcggaggcaccggttcctgtggcaacggcggcgacgagctcggctgctgcagcacaacggcccccagcagtctcaccagtaagcaggggtaaacaaaaaaaccacagactccgggatagtataagaagggactttaccgctattgctgctattcatagagaaggatagaaaggcgactcggaccgatg

SEQ ID NO: 4160 - DNA, 203 bp, Homo sapiens
ggcgcgccagtcctcatacgcaggggctggacgtggttaccggtcactggactcggtttcgctgtagctgtggttcaacctgaacatggctcccagagctgctaggaaccggtccagtcacattttttggtgggtggggggtactaaaaaagtatttaatattggggtttaatgataaaatccaggttcgactcggaccgatg

SEQ ID NO: 4161 - DNA, 203 bp, Homo sapiens
ggcgcgccagtcctcttgactgtaccatcattgctgctacggaataataactacgctacgacctggcctgtggtgtgtgttgttttttgtgcacgcacgacatgacactcttttgccgcaccgccaacagcaccgccggctacgtcgacatgaacgtctgcatcggcatgatcggcgtggtttgtttccgactcggaccgatg

SEQ ID NO: 4162 - DNA, 203 bp, Homo sapiens
ggcgcgccagtcctaaggggctctttgctcgaaggtgagccgcggacgccgtcggtaccgtctccaccacagttaccaccgtcgccgtcactgccaccgacatggagcccacgccgatgctccgcgaccgggatcacgacgacgcgccccccacctacgagcaggccatgggtctgtgcccgacgacgcgactcggaccgatg

SEQ ID NO: 4163 - DNA, 203 bp, Homo sapiens
ggcgcgccagtcctgaggaggaggcggcggtttggatcgcaactccggcaattacttcaacgacgcgaaagaggagagcgacagcgaggattctgtaacgttcgagttcgtccctaacaccaagaagcaaaagtgcggctagagcgtgggccgcgtgcctgggaacgtgcgcacggcgcggtcccgcgcgactcggaccgatg

SEQ ID NO: 4164 - DNA, 203 bp, Homo sapiens
ggcgcgccagtcctcagcgttcccggtcgtcgtgtgtgctctctataaaactttcgctcgctcgcgcccgctccttagtcgagacttgcacgctgtccgggatggatcgcaagacgcgcctctcggagccgccgacgctggcgctgcggctgaagccgtacaagacggctatccagcagctgcgatctcgactcggaccgatg

SEQ ID NO: 4165 - DNA, 203 bp, Homo sapiens
ggcgcgccagtccttcgaattgggagactttcgagaattcgtctgagcggcgctgacagcatacggggaggagacacagaagaaaaaaacacatcgcacacagactttataaaccgtagttgtcggcgccatctagactcactttattgaaatctacctgatttctttgttattttcctcgtaaacttcgactcggaccgatg

SEQ ID NO: 4166 - DNA, 203 bp, Homo sapiens
ggcgcgccagtcctagactttataaaccgtagttgtcggcgccatctagactcactttattgaaatctacctgatttctttgttattttcctcgtaaacttatgaatccggctgacgcggacgaggaacagcgggtgtcctcggtgcccgcacatcggtgccggccaggtaggattccaagccgcagccgactcggaccgatg

SEQ ID NO: 4167 - DNA, 203 bp, Homo sapiens
ggcgcgccagtccttgcctgggaacgctatggctataacgggaaagaaccggtttggcaacattccattgtggggggggggtacttatagcgtgcctagctatgacgttgatatatgtggatgcggataatactcgtaatgagctaaaagcgacgactgggagtaattttaccattacgcataggaaacgactcggaccgatg

SEQ ID NO: 4168 - DNA, 203 bp, Homo sapiens
ggcgcgccagtcctaactctaccaggccctcgggcacgaagaaacgcgccgtgagcgcctggtgatcggcgtggtagagatagcgaaccgatatagtatttacctcgcgtttggctttgagcgccgtcactagttcattgtcctcgtcggccgggtcgcgcggccgtttggccaccgcgcgcgcgtcccgactcggaccgatg

SEQ ID NO: 4169 - DNA, 203 bp, Homo sapiens
ggcgcgccagtcctccccgtaagccaggcgcagcaggacatcttgtcttcgatcgacccgcccgccggctcgacatcggtgtccctgccgccggcctcgccatgaaagtcacacaggccagctgccaccagggcgacatcgctcgctttggagcgcgagcgggcaatcaatgcgtctgcaacggcatccgactcggaccgatg

SEQ ID NO: 4170 - DNA, 203 bp, Homo sapiens
ggcgcgccagtcctgtcagacgggcgagtaccgcgacagctgtttggaaagcgaagacggcgccccgctgtgtcgaggctgcgcgctggttaaacagaccgcctgccacgtcggcggccacattgtgcagcaggcgcgcggcggtttagcagcgacgtcctcctcgtcctccccccacggcctgcccccgactcggaccgatg

SEQ ID NO: 4171 - DNA, 203 bp, Homo sapiens
ggcgcgccagtcctcgtgcacgccgtccttggagcggactggttatcgttgggcaccgtcatcgtggtggcgagcgcgctccgggccatcgcgaccgcagtctgggccgtggctgcccgcgcgctttgcgactctgggcccgctggtgctggctcttctgctggtgctggctctgctgtggcggggtccgactcggaccgatg

SEQ ID NO: 4172 - DNA, 203 bp, Homo sapiens
ggcgcgccagtcctctgggccgtggctgcccgcgcgctttgcgactctgggcccgctggtgctggctcttctgctggtgctggctctgctgtggcgcggtcatggccaatcgtcgtctccgacacgctccgcacaccgcgactgatgagttccaccaggctctgcgccgtctcttcgcgcccctctgccgactcggaccgatg

SEQ ID NO: 4173 - DNA, 203 bp, Homo sapiens
ggcgcgccagtcctgccttcctcaagtacgtgcacggcgactgcgcgacctgcagtcacggagagatcctccgtgagaagacgcaactattaacggcgatcgtcagcaagctcatggacattaacggaatcctggagggaaaagacgagccggcgccgggtaaataaatcggcggtggcgtcggtgcgcgactcggaccgatg

SEQ ID NO: 4174 - DNA, 203 bp, Homo sapiens
ggcgcgccagtcctgtcagcaagctcatggacattaacggaatcctggagggaaaagacgagccggcgccgggtaaataaatcggcggtggcgtcggtgcgatggagatgaacaaggttctccatcaggatctggtgcaggccacgcggcgtatcctcaagttgggtcctagcgagctgcgcgtcacccgactcggaccgatg

SEQ ID NO: 4175 - DNA, 203 bp, Homo sapiens
ggcgcgccagtccttgagggggagtcgttgggccgttactgctcacgtgggtactcggattcatggcgatcggcgccgctgattgaggacgcggaaaaagaatgtcctgggctaagcagcgggtgccgtttctggacgatgacgacggagaggaggaaaacgacgtgcaggatgacgtggattctccgcgactcggaccgatg

SEQ ID NO: 4176 - DNA, 203 bp, Homo sapiens
ggcgcgccagtcctccagccgcgggctccgcgtcctcgtcgatcaccagcggtcgcgtcggcaccggagaatccacgtcatcctgcacgtcgttttcctcctctccgtcgtcatcgtccagaaacggcacccgctgcttagcccaggacattctttttccgcgtcctcaatcagcggcgccgatcgcccgactcggaccgatg

SEQ ID NO: 4177 - DNA, 203 bp, Homo sapiens
ggcgcgccagtccttaagtcgacttccgcgacgtgtgtggctctgcatcacactcttcaaggcctttcagattacaaaacgcacctacaaaggcaaagtgcacctggcggactttatgcgcgatttcacgcagctgttggagaattgcgacatcaagctggtggaccccacgtacgtgatagacaagtcgactcggaccgatg

SEQ ID NO: 4178 - DNA, 203 bp, Homo sapiens
ggcgcgccagtcctacggcggctcttggattcggcattggtgcgccgcgtcttggcctgcatgatcatcgtcatcatgatcgccattagcatctggatcctgacctacgtgctgtttctctaataagaaccccggcccctgacggtaattttcctttcttctccgtttctcctcagctgccgtacgtgcgactcggaccgatg

SEQ ID NO: 4179 - DNA, 203 bp, Homo sapiens
ggcgcgccagtcctgacctacgtgctgtttctctaataagaaccccggcccctgacggtaattttcctttcttctccgtttctcctcagctgccgtacgtgatgcctcacggccatctccgacaggccctctccccgacctcctggacatgtgagggcttgttgctcctcctgggattgctggtgctccgactcggaccgatg

SEQ ID NO: 4180 - DNA, 203 bp, Homo sapiens
ggcgcgccagtcctcctccaccctgacggccgccgcggccgtctcgggtgccttcagggagcgggaccgaccttggctgccaagtccgtacccctcctcctcgaccgcgggcgtttcccggagggtccgcgcaacacgcaagagaccacgacgcgcctcatcgctgctggatttggcccgcgacgaaccgactcggaccgatg

SEQ ID NO: 4181 - DNA, 203 bp, Homo sapiens
ggcgcgccagtcctcttccggttcccatgtcctaatcataacaaaacaccgtgtcactgtccatctccctgtcttttcgcgccgccggtcccccccaaaccatgtctctagatgccgccagccaccaaccggcggcacggcggctcttggattcggcattggtgcgccgcgtcttggcctgcatgatccgactcggaccgatg

SEQ ID NO: 4182 - DNA, 203 bp, Homo sapiens
ggcgcgccagtcctacgtgagggagatcatgtcatgggcgggctgaagaccgtgcgggaaggattgacgtgtgcggtgcttgtggaacacggtgttttaatatgtatccgcgtgtaatgcacgcggtgtgctttttagcactcggtttgataagctacgtggccgtttgcgccgaaaacacggttacccgactcggaccgatg

SEQ ID NO: 4183 - DNA, 203 bp, Homo sapiens
ggcgcgccagtcctgaattgctgggatcgttgcggttgtcgcctttggtggtccgcaaccgcagccagaccgcagtggtggccacggtggtgtctcagacgtcgtgcgtcaaacatgacgtgctgaacttttccttggtataaaattcactcagtggcggcgtagccattgtcttccgttcatccacccgactcggaccgatg

SEQ ID NO: 4184 - DNA, 203 bp, Homo sapiens
ggcgcgccagtccttcgtgcgtcaaacatgacgtgctgaacttttccttggtataaaattcactcagtggcggcgtagccattgtcttccgttcatccaccatgagccacgaggaactaaccgcgctagcgccggtggggcccgcggcttttctctacttcagcaggttgaacgcagaaacgcaggagcgactcggaccgatg

SEQ ID NO: 4185 - DNA, 203 bp, Homo sapiens
ggcgcgccagtcctcacgcaaaaagctggaacaacacgcggctaaaaagcagaacatctacgaacggattccataccggccctccagacagaacgacaactccccgttgatcgaaccgacgggcacagacgacgaagaggacgaggacgacgacgtctgataaggaaggcgagaacgtcttttgcacccgactcggaccgatg

SEQ ID NO: 4186 - DNA, 203 bp, Homo sapiens
ggcgcgccagtcctccccgttgatcgaaccgacgggcacagacgacgaagaggacgaggacgacgacgtctgataaggaaggcgagaacgtcttttgcaccatgcagacctacagcacccccctcacgcttatcatagtcacgtcgctgtttttgttcacaactcagggaagttcatcgaacgccgtccgactcggaccgatg

SEQ ID NO: 4187 - DNA, 203 bp, Homo sapiens
ggcgcgccagtccttccggcctctcactccattgcgcctgggtttcgggactgatgatctttgttggtgcactggtcatctgctttctgcggtcgcaacgaatcggggaacaggacgctgaacagctgcggacggacctggatacggaacctctgttgttgacggtggacggagatttggaataaaagcgactcggaccgatg

SEQ ID NO: 4188 - DNA, 203 bp, Homo sapiens
ggcgcgccagtcctaacgccaaaaacgtccacatttccatcaaaatcagaccgcccgacgcgcccatgccgccggcgaccgccgtctgagcctcactttccacggcgccggtgacccgccccccggcagcggtctcatctatatatacatcagcgtgccagaacgtgaccttcctagcgacggcggcccgactcggaccgatg

SEQ ID NO: 4189 - DNA, 203 bp, Homo sapiens
ggcgcgccagtcctatgtcttttctattgacaatagcaaaggaatacaaaagactatgccaagatgctaaggcagctcaaatgatgacagtaggaactgtatcaaactacactacgttcaagaaatggactacatcaaggaaggaaaagaatccttcactaagaatgagatgggcaatgagcagcaaacgactcggaccgatg

SEQ ID NO: 4190 - DNA, 203 bp, Homo sapiens
ggcgcgccagtcctatattatgtaatcacacttttggaagtaatataatgagaccccacttggaaaaagcaataaaaggagttgaaggcagagttggagagatgggacgaatggcaatgaaatggttagttgttataatatgtttctctataacaagtcaacctgcttctgcttgcaatctaaagacccgactcggaccgatg

SEQ ID NO: 4191 - DNA, 203 bp, Homo sapiens
ggcgcgccagtcctcgcacagtggatcctaggcagaaccgtaacttaaacttctggcagtcatgcaagaccccctcttaggaaccctgtctgaattaaaggatttggttagaaaaaccataccagatgtaattgagcttgcatatcaaaaggacgcattactttcacaagtgcatccaagatcagtgtcgactcggaccgatg

SEQ ID NO: 4192 - DNA, 203 bp, Homo sapiens
ggcgcgccagtcctgcgcacagtggatcctaggcattgctttcacgctttgaggtgaaccacctcactggagcaccagatttcatctaatgggtaactccaagtcaaaatcaaagctgtctgctaaccagtatgaacagcaaacagtcaatagcaccaaacaggtagccattttaaagagacaggctgcgactcggaccgatg

SEQ ID NO: 4193 - DNA, 203 bp, Homo sapiens
ggcgcgccagtcctaccttcatctttttaccataatcttgttctcagtaccatttgataagggtacacttgccaatacgcccccatcctaagggtctcgcaatggggggtcttagcctactccaattgcccagggacaaatttcggaaaagctctttctttgtttgggtcatcatcttattccaaaagcgactcggaccgatg

SEQ ID NO: 4194 - DNA, 203 bp, Homo sapiens
ggcgcgccagtcctcgaggcggcaattcagttaatttcatatcaagataacatccatttccaagaccacagataactatattattaatctttaccacaaatatggagaggggtcgtgagcgcgggagatcaaggaattcacgtgccgaccagcaaaattcaacaggtcctcaatttaggacaagatcccgactcggaccgatg

SEQ ID NO: 4195 - DNA, 203 bp, Homo sapiens
ggcgcgccagtcctgtatggtggtcatcatgattttgttatcaaaacatctcatgatgattagaatctcttgtcagatctcattaaatctaaactttatttatggacgtttggagacctagctacacacattctcttgttattagagaatttggtgttacaaaccttgaagatttgtgtctaaagtatcgactcggaccgatg

SEQ ID NO: 4196 - DNA, 203 bp, Homo sapiens
ggcgcgccagtcctttggcaaatttgcttctcactttacattacgtagtcacgatatttcccatagtaataattttggtgttgtaactagttttactacttatggtaatactgtttctgaggctgtgtctagattagttgaatcagcttctgaatttattgtttggcgtgcagaggcacttaataagtcgactcggaccgatg

SEQ ID NO: 4197 - DNA, 203 bp, Homo sapiens
ggcgcgccagtcctatggtaatactgtttctgaggctgtgtctagattagttgaatcagcttctgaatttattgtttggcgtgcagaggcacttaataagtatggttgatttatttttcaatgatactgcttggtacataggacagattttagttttagttttattttgtcttatttctttaatctttcgactcggaccgatg

SEQ ID NO: 4198 - DNA, 203 bp, Homo sapiens
ggcgcgccagtcctgtacctataaacgtgcctttttagataagttagatgttaatagtggttttgctgtttttgttaagtctaaagttggtaactatcgtttaccgtctagtaaacctagtggtatggatactgccttgttaagagcttaaatctaaactattaggatgtcttatactcccggtcattcgactcggaccgatg

SEQ ID NO: 4199 - DNA, 203 bp, Homo sapiens
ggcgcgccagtcctaggaaaaagcataaaagaggtactcttccaacaacaagcccgaaacaagaggggacgtcaaaggtcaggaaattcgggttgttttgtttgtggccagcctggacatcgggctgcagtatgccctcaaaaacaacaaagtcctgttaacactcctaatttgtgcccgcgctgtaacgactcggaccgatg

SEQ ID NO: 4200 - DNA, 203 bp, Homo sapiens
ggcgcgccagtccttctccttatacaggtgtaacttttgtccgtgctggctgcggcaagtggcgcccaacgtggggctcgacagctttcctcgtcactactcttattatttgaacaaagtgagtatttgaatgaataagtgatttacattaaagaggagtagtaaggtatatagttgagagtataaatcgactcggaccgatg

SEQ ID NO: 4201 - DNA, 203 bp, Homo sapiens
ggcgcgccagtcctgtaaaattttcgaattttataataattaagaaaggagtttaatagtttatcacaacttaaaagtgaaatttatttaagaaaggaggactacttatgcaagtagcccctaatgtatggagtaaatattttaatattccaaatccaggattacgtgcttactttagcaatgtagtgcgactcggaccgatg

SEQ ID NO: 4202 - DNA, 203 bp, Homo sapiens
ggcgcgccagtcctttttcgaattttataataattaagaaaggagtttaatagtttatcacaacttaaaagtgaaatttatttaagaaaggaggactacttatgcaagtagcccctaatgtatggagtaaatattttaatattccaaatccaggattacgtgcttactttagcaatgtagtgtctggacgactcggaccgatg

SEQ ID NO: 4203 - DNA, 203 bp, Homo sapiens
ggcgcgccagtcctagcaaaagcaggagtaaagatgaatccaaatcaaaagataataacgattggctctgtttctctcaccatttccacaatatgcttcttcatgcaaattgccatcctgataaccactgtaacattgcatttcaagcaatatgaattcaactcccccccaaacaaccaagtgatgctcgactcggaccgatg

SEQ ID NO: 4204 - DNA, 203 bp, Homo sapiens
ggcgcgccagtccttcaatccgactctactgttcctaaaggttccagcgcaaaatgccataagcaccacattcccttatactggagatcctccatacagccatggaacaggaacaggatacaccatggacacagtcaacagaacacaccaatattcagagaaggggaagtggacgacaaatacagaaacgactcggaccgatg

SEQ ID NO: 4205 - DNA, 203 bp, Homo sapiens
ggcgcgccagtcctatggcgtcccaaggcaccaaacggtcttatgaacagatggaaactgatggggaacgccagaatgcaactgagatcagagcatccgtcgggaagatgattgatggaattggacgattctacatccaaatgtgcaccgaacttaaactcagtgattatgaggggcgactgatccagcgactcggaccgatg

SEQ ID NO: 4206 - DNA, 203 bp, Homo sapiens
ggcgcgccagtcctctccagcaagtcctccaaactcacctgcgagctctgtaagtactattactttctttaacacttggcacgcacagccacgtgacgaagatgagctcagggaatatgaaagacaagcatcgctcctacaaaagaaaagggagtccagaaagaggggagaggaagagacactggcagcgactcggaccgatg

SEQ ID NO: 4207 - DNA, 203 bp, Homo sapiens
ggcgcgccagtcctgacacttagctaatgtttcctcacagacagaagcagacgagataactgacgaggaaatgctttctgctgctgaaagcatggaagcagatgcctccaattaagagacagcctagagggtgggtgctgcctggatacagatatcttgggccatttaatccacttgataacggtgaacgactcggaccgatg

SEQ ID NO: 4208 - DNA, 203 bp, Homo sapiens
ggcgcgccagtcctggcttttaaattgcacgtcggtcccagctgatcactggtgccatggccgagctagcctgtttcgtttccttctcactgactgaagataaagtagtatggtatccaattaataaaaaagcagtacaaaccatgttgtgtgctaaagtggaaaaagatcagaggagtaattattatcgactcggaccgatg

SEQ ID NO: 4209 - DNA, 203 bp, Homo sapiens
ggcgcgccagtcctggctttaaaaattgcgacaatgtctgattttggaattaatcttgatgccatttgcgacaatgtaaaaaaaggccaaacagaatcaagaactggttctcaattatcaaatcggagttcacgaagaatggattttgttgatgatgaagagttaagtacttactttaactcaaaagccgactcggaccgatg

SEQ ID NO: 4210 - DNA, 203 bp, Homo sapiens
ggcgcgccagtcctgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctgggtccgacgactcggaccgatg

SEQ ID NO: 4211 - DNA, 203 bp, Homo sapiens
ggcgcgccagtcctacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgcgactcggaccgatg

SEQ ID NO: 4212 - DNA, 203 bp, Homo sapiens
ggcgcgccagtccttaaacgctcagtataaaaggccggtggacacgtatgatccttgcctaattctaacgggagaggcagaaagatatatggtggacgctgtgggaaattaccgggaagcctccactggaactaccgtactctaccccacgtatgatctgggctccatagttgcggacatggtgacttcgactcggaccgatg

SEQ ID NO: 4213 - DNA, 203 bp, Homo sapiens
ggcgcgccagtccttgggaaattaccgggaagcctccactggaactaccgtactctaccccacgtatgatctgggctccatagttgcggacatggtgacttatgaagatgagtagttctaagcgagatctggtggcccagcaactaagagcctcggtagaaaagagagcggctgtgagcgcacgtgaccgactcggaccgatg

SEQ ID NO: 4214 - DNA, 203 bp, Homo sapiens
ggcgcgccagtccttataaattactggcgtgaattgtgcccaccagagggtgagcccacctgtctgacttggcccctgtgtacataatactcggggtctcggcacccaggcagccttgcgtggtgctgtcctgctgaagggcgtttcttaggttctcggtcagacggccgcgctgcgaggcatacagccgactcggaccgatg

SEQ ID NO: 4215 - DNA, 203 bp, Homo sapiens
ggcgcgccagtcctcgggtgggctggttggggctgcttcccagctagtagcccttggaactgacgggcactgcgtccacctggccaccacatcggacgggcaggcatttttggtgctgcctgggggctttgttattaaaggccaattggcactcacccccgaggagaggggatatattctggcacgtccgactcggaccgatg

SEQ ID NO: 4216 - DNA, 203 bp, Homo sapiens
ggcgcgccagtcctaactggtcaggggcagctggaggcatgaaacggaagcaatgtcgtgttgaccggctcagggaccgctcattccctgcatacctcgaggaggtcatgtatgtgatggttcagtagagtattgggtgtggagactagctataaaagaggccgggaggccttctgcgtccagacgcgcgactcggaccgatg

SEQ ID NO: 4217 - DNA, 203 bp, Homo sapiens
ggcgcgccagtcctgaggtcatgtatgtgatggttcagtagagtattgggtgtggagactagctataaaagaggccgggaggccttctgcgtccagacgcgatggcacacgccagagacaaggcaggcgctgttatggccatgatactcatctgtgagacaagccttatttggacatctagtggcagtcgactcggaccgatg

SEQ ID NO: 4218 - DNA, 203 bp, Homo sapiens
ggcgcgccagtcctcccggatagacctggatgacctgtcagtggcggatgatttatcacgcatgcgtgtgatgatgacctacctacagtctttggcatcactatttaatttggggcctcgcttggccacagcggcatactctcaagagaccctgacggccacttgctggttaagataaagggggtacccgactcggaccgatg

SEQ ID NO: 4219 - DNA, 203 bp, Homo sapiens
ggcgcgccagtcctgaggcattccccgcactctcagcctcctcccgggcactcatcgatgagtttatgtctgtcaaacagacccacgcccccatccattacggacactatataattgaagaggtggcgccggtacgaagaatattaaagtttggaaataaggtggttttttgataattgtcaataaagcgactcggaccgatg

SEQ ID NO: 4220 - DNA, 203 bp, Homo sapiens
ggcgcgccagtcctggacactatataattgaagaggtggcgccggtacgaagaatattaaagtttggaaataaggtggttttttgataattgtcaataaagatggatttgaaagtggtagtgtctctctcctctcgtctgtataccgatgagattgccaagatgcaacagaggattggctgcatcttacgactcggaccgatg

SEQ ID NO: 4221 - DNA, 203 bp, Homo sapiens
ggcgcgccagtcctcgacacgcgtaaaaggtggcctccctgcccagggccgtgtccaaccatttgattagaagggtagcatcctcgggaagtgtgggtgggctgcggttgcaggccagggcgtaaaagagacccagctgtgaagagaagccctcgagacctccccccatctccctcttaccttgtgtccgactcggaccgatg

SEQ ID NO: 4222 - DNA, 203 bp, Homo sapiens
ggcgcgccagtcctctgcggttgcaggccagggcgtaaaagagacccagctgtgaagagaagccctcgagacctccccccatctccctcttaccttgtgtcatggcctcaaatgagggtgtggaaaacagacccttcccctatctgacggtggatgccgacctgctctcgaacctgcggcagtcagcgcgactcggaccgatg

SEQ ID NO: 4223 - DNA, 203 bp, Homo sapiens
ggcgcgccagtccttagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggcccgactcggaccgatg

SEQ ID NO: 4224 - DNA, 203 bp, Homo sapiens
ggcgcgccagtcctgccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgccgactcggaccgatg

SEQ ID NO: 4225 - DNA, 203 bp, Homo sapiens
ggcgcgccagtcctgctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgcgactcggaccgatg

SEQ ID NO: 4226 - DNA, 203 bp, Homo sapiens
ggcgcgccagtcctcctaccttcagtttgtgcttgtggacctctcagagtttcaggacgatttacctggatgctggacggagatttacatgcaggcattgaagaatccggcaatacgatctcagtttttcgattgggctggtctgagcaaggtgatctctgattttgagaggggaaatcgggactaggcgactcggaccgatg

SEQ ID NO: 4227 - DNA, 203 bp, Homo sapiens
ggcgcgccagtcctggtcccgggggcagagacaaaaaagaggccagttgctcccagctcttaagagagagcagcttggagtaacaccgaaggtgcgctcgcttacctgccgcctttctagccgggggaagactgtgaaattttgccaggtcgtgtgtggagagggcacacagaccccgggtgggatcccgactcggaccgatg

SEQ ID NO: 4228 - DNA, 203 bp, Homo sapiens
ggcgcgccagtccttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtcgactcggaccgatg

SEQ ID NO: 4229 - DNA, 203 bp, Homo sapiens
ggcgcgccagtcctttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggcgactcggaccgatg

SEQ ID NO: 4230 - DNA, 203 bp, Homo sapiens
ggcgcgccagtcctcgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgccgactcggaccgatg

SEQ ID NO: 4231 - DNA, 203 bp, Homo sapiens
ggcgcgccagtcctccgaccggagcatccggcaggtgttccaccgtgagtggcaagggcttcttcagagggagctggctcttgacggtgaggggatccaggtgaaggcaggcgtccttgggtggggcgtccgggcgctccacgaagccgcagacgtatacagacggtgcctgcaccattgtgcccgctcgactcggaccgatg

SEQ ID NO: 4232 - DNA, 203 bp, Homo sapiens
ggcgcgccagtcctttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacacgactcggaccgatg

SEQ ID NO: 4233 - DNA, 203 bp, Homo sapiens
ggcgcgccagtcctagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatccccgactcggaccgatg

SEQ ID NO: 4234 - DNA, 203 bp, Homo sapiens
ggcgcgccagtccttatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaaccgactcggaccgatg

SEQ ID NO: 4235 - DNA, 203 bp, Homo sapiens
ggcgcgccagtccttgaattaaccaatgagaagccccccactcctgagcaaaccttaaggtattgcacagagaccccaaaaagaggataaaagaaggcgagctggcccggctcgccagcgtcgtccagacgctcggggggtgcacacctcccagccggcccggcgtccttgcggcggcctcccccccccgactcggaccgatg

SEQ ID NO: 4236 - DNA, 203 bp, Homo sapiens
ggcgcgccagtcctgctgcacatcggccccagcaccagacttggacttgcgctcttctggccggccgagcgaagtgacaacctagacgccgggcggatattctaccagctaacgagcggagagttgtattggggccgcaccgtcgcccgccccccgactctcaccttgcccgtcgacgagctccggcccgactcggaccgatg

SEQ ID NO: 4237 - DNA, 203 bp, Homo sapiens
ggcgcgccagtcctctaccagctaacgagcggagagttgtattggggccgcaccgtcgcccgccccccgactctcaccttgcccgtcgacgagctccggccatggccgaagcttaccccggaggagcccatgcagcactagcgtcccggcgctcgtcgttcaggaacagcctccgccgcctgcggccccgactcggaccgatg

SEQ ID NO: 4238 - DNA, 203 bp, Homo sapiens
ggcgcgccagtcctccattttatggactctctcaagaaccaggtgacagtcaccgccagatacttcagaagggtgcctagccagtccacctgagtgcgaggatggccctgcaaactgacacacaggcctggcgggtggagatagggaccagaggactaatgttctctaactgtgtcccactccacctgcgactcggaccgatg

SEQ ID NO: 4239 - DNA, 203 bp, Homo sapiens
ggcgcgccagtcctgtgggccgcaggcggcggaggctgttcctgaacgacgagcgccgggacgctagtgctgcatgggctcctccggggtaagcttcggccatggccggagctcgtcgacgggcaaggtgagagtcggggggcgggcgacggtgcggccccaatacaactctccgctcgttagctggtcgactcggaccgatg

SEQ ID NO: 4240 - DNA, 203 bp, Homo sapiens
ggcgcgccagtcctaactcacagtttattttctccaaatcgctccttgcaacaatggacacgcaagggcgaatgcagaaaatagtctggaagtccaccaggcagggaggtggcatgcaaaataactgactgcctgggcaagttcctcttttgctgcagacaccacccagtctggctctgaccagcaagcgactcggaccgatg

SEQ ID NO: 4241 - DNA, 203 bp, Homo sapiens
ggcgcgccagtcctcagggaggtggcatgcaaaataactgactgcctgggcaagttcctcttttgctgcagacaccacccagtctggctctgaccagcaagatgctctccaccatggcccccgggtccaccgtggggaccctggtggccaacatgacttccgtcaatgcaacggaagatgcgtgcactcgactcggaccgatg

SEQ ID NO: 4242 - DNA, 203 bp, Homo sapiens
ggcgcgccagtcctccgttttccaggcctacgcagaagacgctatcacgatccagagaccgccgccgcactgcttggggaggcagagactgagttttaaccatgtctgggggactcttctataaccctttcctaagacctaataaaggccttctgaaaaagcctgacaaggagtacctgcgtctcattcgactcggaccgatg

SEQ ID NO: 4243 - DNA, 203 bp, Homo sapiens
ggcgcgccagtcctggcggtccttgatcctgcgccgggcggacgcggtcagccccggccaggccctgcccccggatgggctttacctcacgtacgactctgaccgccccctaattcttctgtataagggcagggggtgggtatttaaggatctatatgcccttctctacctgcacctccaaatgagagcgactcggaccgatg

SEQ ID NO: 4244 - DNA, 203 bp, Homo sapiens
ggcgcgccagtcctaccgccccctaattcttctgtataagggcagggggtgggtatttaaggatctatatgcccttctctacctgcacctccaaatgagagatgactcggcgtagggtgctaagcgtggtcgtgctgctagccgccctggcgtgccgtctcggtgcgcagaccccagagcagcccgcacgactcggaccgatg

SEQ ID NO: 4245 - DNA, 203 bp, Homo sapiens
ggcgcgccagtcctaggagggcagggctccgggggcagacgcaagcgccgtctggccaccgttctccccggactcgaggtctagagacccctggggcggcgatgtcggggctgctggcggcggcgtacagccaggtgtacgccctggcggttgagctgagcgtgtgcacccggctggacccccggagtcgactcggaccgatg

SEQ ID NO: 4246 - DNA, 203 bp, Homo sapiens
ggcgcgccagtcctgcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgacgactcggaccgatg

SEQ ID NO: 4247 - DNA, 203 bp, Homo sapiens
ggcgcgccagtcctccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgactcggaccgatg

SEQ ID NO: 4248 - DNA, 203 bp, Homo sapiens
ggcgcgccagtcctaggctgggcggcatgccaagatcgctgagacgtcagttccccgtgacgtgggccctggccagcctgactgacttcctgaaatctttgtaaatgaataaacagtgggtgttgcgtgatgagtaaagtgtaacatttaatgtgggactgggaggccggggcgataccttgggcatccgactcggaccgatg

SEQ ID NO: 4249 - DNA, 203 bp, Homo sapiens
ggcgcgccagtccttaaatgaataaacagtgggtgttgcgtgatgagtaaagtgtaacatttaatgtgggactgggaggccggggcgataccttgggcatcatgcagggtgcacagactagcgaggataatctgggcagccagagccagccgggtccgtgcggctacatctacttttaccccctggcccgactcggaccgatg

SEQ ID NO: 4250 - DNA, 203 bp, Homo sapiens
ggcgcgccagtcctaagaaagcggtgacagcctggccggcggccacacaggaggccaacaggaggagctgagcgatgaacctggccattgctctggactctcctcacccaggcctcgcgtcttatactattctgccacgcccattttatcatataagcctgaagcccgtgagctggcctgacgagacccgactcggaccgatg

SEQ ID NO: 4251 - DNA, 203 bp, Homo sapiens
ggcgcgccagtcctggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcacgactcggaccgatg

SEQ ID NO: 4252 - DNA, 203 bp, Homo sapiens
ggcgcgccagtcctgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctcgactcggaccgatg

SEQ ID NO: 4253 - DNA, 203 bp, Homo sapiens
ggcgcgccagtcctccagacgtcagcagactaagactactcctggtggtactctgtgtcctgtttggacttttatgcctgctcctcatctaagaagccaccatgcgaccgggtagaccactggctggattctacgctactctccgccgttccttcagaagaatgtccaaaaggtcaaagaacaaggcccgactcggaccgatg

SEQ ID NO: 4254 - DNA, 203 bp, Homo sapiens
ggcgcgccagtcctttgctctcatgcttataattataattttgatcatctttatcttcagaagagaccttctctgtccacttggagccctttgtatactcctactgatgagtaagtattacaccctttgccccacaccccctttcccttactcttccttctctaacgcactttctcctctttccccagcgactcggaccgatg

SEQ ID NO: 4255 - DNA, 203 bp, Homo sapiens
ggcgcgccagtccttactgatgagtaagtattacaccctttgccccacaccccctttcccttactcttccttctctaacgcactttctcctctttccccagtcaccctcctgctcatcgctctctggaatttgcacggacaggcattgttccttggaattgtgctgttcatcttcgggtgcttacttgcgactcggaccgatg

SEQ ID NO: 4256 - DNA, 203 bp, Homo sapiens
ggcgcgccagtccttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggcgactcggaccgatg

SEQ ID NO: 4257 - DNA, 203 bp, Homo sapiens
ggcgcgccagtcctagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcacgactcggaccgatg

SEQ ID NO: 4258 - DNA, 203 bp, Homo sapiens
ggcgcgccagtcctcgggcccctggtggctcggccgcggtcctcccccgtgaacggggcgcgctgggccgcggctgccccctggacccctaggcctgtgccatggggaccccctgccagtcggcgcggggtcccaggaccacgcccctccctcactgcccccccccctgccttccaggtgcacgggaccgactcggaccgatg

SEQ ID NO: 4259 - DNA, 203 bp, Homo sapiens
ggcgcgccagtcctaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagcgactcggaccgatg

SEQ ID NO: 4260 - DNA, 203 bp, Homo sapiens
ggcgcgccagtcctgtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttgcgactcggaccgatg

SEQ ID NO: 4261 - DNA, 203 bp, Homo sapiens
ggcgcgccagtcctgaactggacgtggtcctgcgcatccacggccttgacctggtacagtcctatcaaacttcccaggtctacgtgtgaaaagtaaacccgatggccccggtcaccccagatgccgtgaatgcacgccaacagcgaccggcagatcccgcattgcgccgcctaatgcatccgcaccaccgactcggaccgatg

SEQ ID NO: 4262 - DNA, 203 bp, Homo sapiens
ggcgcgccagtcctccttgtccttgtggcggtgtcccagaaactggtgccgaccccggtattaaaaacccagaagacctcaccttgccacccagatgtgtcatggctcacaaagtcacgagcgcaaacgagccaaaccccctgaccggaaaaagactgtccagctgccccctcacgaggagtggcgtacgactcggaccgatg

SEQ ID NO: 4263 - DNA, 203 bp, Homo sapiens
ggcgcgccagtcctgttacgccactcctcgtgagggggcagctggacagtctttttccggtcagggggtttggctcgtttgcgctcgtgactttgtgagccatgacacatctgggtggcaaggtgaggtcttctgggtttttaataccggggtcggcaccagtttctgggacaccgccacaaggacaacgactcggaccgatg

SEQ ID NO: 4264 - DNA, 203 bp, Homo sapiens
ggcgcgccagtccttccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagccgactcggaccgatg

SEQ ID NO: 4265 - DNA, 203 bp, Homo sapiens
ggcgcgccagtcctgacacgcgagactcgccgtatgcgcgggagccattcacgggtggaacacgtgccccccgagacccgggagacggtggtggggggagcatggcgttattcttcgcgcgccacaccttatctggcacgggtgctggctgtcacggccgtggccctgctcctgatgtttctgaggtgcgactcggaccgatg

SEQ ID NO: 4266 - DNA, 203 bp, Homo sapiens
ggcgcgccagtcctggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttcgactcggaccgatg

SEQ ID NO: 4267 - DNA, 203 bp, Homo sapiens
ggcgcgccagtcctatctctcggcggctgccgccgccagccgcgtaagaccccggaccagaaggggggcgacaaggcgtcctccccgccccaccgccgaagatgagtaacggcgactgggggcaaagccagcgcacccggggaaccggccccgtgcgcggaatcaggaccatggatgtgaatgccccccgactcggaccgatg

SEQ ID NO: 4268 - DNA, 203 bp, Homo sapiens
ggcgcgccagtcctagaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccgactcggaccgatg

SEQ ID NO: 4269 - DNA, 203 bp, Homo sapiens
ggcgcgccagtcctcgccagacggccgccgcactcagcgaggaggcctgcgcgtgttcctcaaccagcccacgaacgtcccgcgtgaattcggacccccgggaaatatttagacgccgggccggagggggcagcagccccgcgattcggcgttgcagacggcggcgatcgacggacccctggaccttccgactcggaccgatg

SEQ ID NO: 4270 - DNA, 203 bp, Homo sapiens
ggcgcgccagtcctccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgcccgactcggaccgatg

SEQ ID NO: 4271 - DNA, 203 bp, Homo sapiens
ggcgcgccagtcctttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagccgactcggaccgatg

SEQ ID NO: 4272 - DNA, 203 bp, Homo sapiens
ggcgcgccagtcctggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctcgactcggaccgatg

SEQ ID NO: 4273 - DNA, 203 bp, Homo sapiens
ggcgcgccagtcctcgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcaccgactcggaccgatg

SEQ ID NO: 4274 - DNA, 203 bp, Homo sapiens
ggcgcgccagtcctacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatccgactcggaccgatg

SEQ ID NO: 4275 - DNA, 203 bp, Homo sapiens
ggcgcgccagtcctgtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacacccgactcggaccgatg

SEQ ID NO: 4276 - DNA, 203 bp, Homo sapiens
ggcgcgccagtcctcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttcgactcggaccgatg

SEQ ID NO: 4277 - DNA, 203 bp, Homo sapiens
ggcgcgccagtcctcatcacaggccatcacggtcaccttcatgagtcagtgcttcgccggtcgctgtggggccaatcaaccgaccgcccatttctccatcagcgtgcccgcctccagaatcataaatagggctgaggccagtcaagacagcactacatcccagctagcccgtcgtagagacagacaagcgactcggaccgatg

SEQ ID NO: 4278 - DNA, 203 bp, Homo sapiens
ggcgcgccagtcctgagccagagcccgcagcacgaccagtctgggagatagaaggccatcgttctgtttagcccgccgttggggcctcccggtcttaaataatgtccgcccccgtcgtcatcaaggcccttgtggcctcaaacactgacattgcggaggccatcctcgatgccatcctctcgcggcctcgactcggaccgatg

SEQ ID NO: 4279 - DNA, 203 bp, Homo sapiens
ggcgcgccagtcctgggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgcgactcggaccgatg

SEQ ID NO: 4280 - DNA, 203 bp, Homo sapiens
ggcgcgccagtcctagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagcgactcggaccgatg

SEQ ID NO: 4281 - DNA, 203 bp, Homo sapiens
ggcgcgccagtcctacataacttcaagttcaacctcttccatgtcactgagacccagttcaaacccagagacactcagcccctccaccagtgacaattcaacgtcacatatgcctttactaacctccgctcacccaacaggtggtgaaaatataacacaggtgacaccagcctctatcagcacacatccgactcggaccgatg

SEQ ID NO: 4282 - DNA, 203 bp, Homo sapiens
ggcgcgccagtcctgacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccacccgactcggaccgatg

SEQ ID NO: 4283 - DNA, 203 bp, Homo sapiens
ggcgcgccagtcctggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcgactcggaccgatg

SEQ ID NO: 4284 - DNA, 203 bp, Homo sapiens
ggcgcgccagtccttatgcatgagccacaggcattgctaatgtacctcatagacacacctaaatttagcacgtcccaaaccatgacatcacagaggaggctggtgccttggctttaaaggggagatgttagacaggtaactcactaaacattgcaccttgccggccacctttgctatctttgctgaagcgactcggaccgatg

SEQ ID NO: 4285 - DNA, 203 bp, Homo sapiens
ggcgcgccagtcctggtgccttggctttaaaggggagatgttagacaggtaactcactaaacattgcaccttgccggccacctttgctatctttgctgaagatgatggacccaaactcgacttctgaagatgtaaaatttacacctgacccataccaggtgccttttgtacaagcttttgaccaagctcgactcggaccgatg

SEQ ID NO: 4286 - DNA, 203 bp, Homo sapiens
ggcgcgccagtcctgcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctccgactcggaccgatg

SEQ ID NO: 4287 - DNA, 203 bp, Homo sapiens
ggcgcgccagtcctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtcgactcggaccgatg

SEQ ID NO: 4288 - DNA, 203 bp, Homo sapiens
ggcgcgccagtcctattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtcgactcggaccgatg

SEQ ID NO: 4289 - DNA, 203 bp, Homo sapiens
ggcgcgccagtcctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgccgactcggaccgatg

SEQ ID NO: 4290 - DNA, 203 bp, Homo sapiens
ggcgcgccagtcctccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactcgactcggaccgatg

SEQ ID NO: 4291 - DNA, 203 bp, Homo sapiens
ggcgcgccagtcctgagtgagtatgggttttgtgtaaatttattgctaaaatttcattaagcagtgaagtaaaggaattgtgggaattctattgactgtgaatgcaatgtaatgtaacaaattgtatgattatttgggatactattcatagatgtcggcagcgtccgaatgaggaatagatccagtatcgactcggaccgatg

SEQ ID NO: 4292 - DNA, 203 bp, Homo sapiens
ggcgcgccagtcctgtgaaggaagttacttcacactcagtccaggtcaaaggtaaatcaggcgcaccttggcaccacctgacacattgtacaccagcaccagcacctgacagaacgctgacagaagtcagaagcgacttgatcgcctccaatttggctataaattctgagagccccgacaactgaagacgactcggaccgatg

SEQ ID NO: 4293 - DNA, 203 bp, Homo sapiens
ggcgcgccagtcctgcacctgacagaacgctgacagaagtcagaagcgacttgatcgcctccaatttggctataaattctgagagccccgacaactgaagaatgtggagacgactccattcctcagatgtccgggagggtcacccatggtccaggcgatgcagaacgccatggggtcgactgggatgtcgactcggaccgatg

SEQ ID NO: 4294 - DNA, 203 bp, Homo sapiens
ggcgcgccagtcctgccgtcataaaggagctgagctgactctgctggtggcctcgcgtaccactgtggccaggcggtagctgggacgtgcagcccaccaccatggggagcagcaagagcaagcccaaggaccccagccagcgccggcgcagcctggagccacccgacagcacccaccacgggggattccgactcggaccgatg

SEQ ID NO: 4295 - DNA, 203 bp, Homo sapiens
ggcgcgccagtccttaaagcaaaaacactattatgtgcattttaccaaggaagcagtaaaatatggacaaaaagggatgtggcaagtgaggactggaactgatgtattatttggtccttcttctatcgctagcacttcgacgggggccgagcaaggtgacaccaccgcacaagtcacccgaagcgccacgactcggaccgatg

SEQ ID NO: 4296 - DNA, 203 bp, Homo sapiens
ggcgcgccagtcctatatagactgggaaggaaataaacatttctatgtgcggtttgcagatgaggcaacacaatttgatgcagcaaatgaatggcaagtacgaactgaaagtgaaataatatctaattctgttaccagcacccccccacggagcgacccgaggcctactggatcttctgccatcacctcgactcggaccgatg

SEQ ID NO: 4297 - DNA, 203 bp, Homo sapiens
ggcgcgccagtcctgaactgaaagtgaaataatatctaattctgttaccagcacccccccacggagcgacccgaggcctactggatcttctgccatcacctatgaaacttccagacacgacacgaggaggactaggagatctactaaaagaccccgaccgtcccccagcccatccgcgacatcggcgacgactcggaccgatg

SEQ ID NO: 4298 - DNA, 203 bp, Homo sapiens
ggcgcgccagtcctctcgattgttacttacacctcaggcagttcctgctgttcaggtccctcctttggttcgtgtcctgacacttcctccaggcacagccctacaaatcttactctcagatgtagggggtcttgtacctttttctgtgccttctgtacatcctgttattcctggcactgtgtttccagcgactcggaccgatg

SEQ ID NO: 4299 - DNA, 203 bp, Homo sapiens
ggcgcgccagtccttacaaatcttactctcagatgtagggggtcttgtacctttttctgtgccttctgtacatcctgttattcctggcactgtgtttccagatgtgtctgaacctcctattgttgtggatggttttgatgcatttgatacattttatttgcatccaagtcacagacgcaaacgcaagccgactcggaccgatg

SEQ ID NO: 4300 - DNA, 203 bp, Homo sapiens
ggcgcgccagtcctagtatattctgcgtgctaatcgttcaacgttagtccgtggagtgagcttctgttaagttgttaacacgtttgaataatttctactgaaagggtagagaaaaggagttttgcttctcatggcaacaagaggagcaagcaagtctcgggtcacgacccggggcgtcaatatggtgacgactcggaccgatg

SEQ ID NO: 4301 - DNA, 203 bp, Homo sapiens
ggcgcgccagtcctttagtccgtggagtgagcttctgttaagttgttaacacgtttgaataatttctactgaaagggtagagaaaaggagttttgcttctcatggcaacaagaggagcaagcaagtctcgggtcacgacccggggcgtcaatatggtgacggccaaggccaagagtctggccgtcaaacgactcggaccgatg

SEQ ID NO: 4302 - DNA, 203 bp, Homo sapiens
ggcgcgccagtcctgaaatttccaataaactctggtgtaaggcttagagtgatggtcgaggtgccctatttagggtgaggagcctcggtggcagccccaccaaatcctctattggataggaacagctgtactgggcagttacagcagtcgtatggtaacacatgcggcgttccgaaataccatgcctgcgactcggaccgatg

SEQ ID NO: 4303 - DNA, 203 bp, Homo sapiens
ggcgcgccagtcctgcaacagtatttaaaaactgctctgttgtgctgctgtttaagagggcaggcaccggcagtcctcggagttgaaattccatcaacagctttgtctggtgaaggctcccgcctcccccactcaggcctttggtaagcttttcaagagcgtctgtgccgtccattgccggcgtggatcgactcggaccgatg

SEQ ID NO: 4304 - DNA, 203 bp, Homo sapiens
ggcgcgccagtccttttgtctggtgaaggctcccgcctcccccactcaggcctttggtaagcttttcaagagcgtctgtgccgtccattgccggcgtggatatgaaggtgcaggctgaaaatgcggctcgcctgggtaggcaagtgttgggtcttttacctccaccaactcaccgggtatccctcactcgactcggaccgatg

SEQ ID NO: 4305 - DNA, 203 bp, Homo sapiens
ggcgcgccagtcctccaaccgtgggtcgtgtggacgccgcatatttagagagtaaatcccgcacccccctggcaaactccggtcctctagtgagggatacccggtgagttggtggaggtaaaagacccaacacttgcctacccaggcgagccgcattttcagcctgcaccttcatatccacgccggcacgactcggaccgatg

SEQ ID NO: 4306 - DNA, 203 bp, Homo sapiens
ggcgcgccagtcctgtctgccttcgaggcaccggacgacgaactccgttttgtcccactgacgctggcaggcctccggaaactgtttgtcgaatagaggccatggcagcccagcctctgtacatggagggaatggcctccacccaccaagctaactgtatattcggagaacatgctggatcccagtgccgactcggaccgatg

SEQ ID NO: 4307 - DNA, 203 bp, Homo sapiens
ggcgcgccagtccttactaattttgaaaggcggggttctgccaggcatagtctttttttgtggcggcccttgtgtaaacctgtctttcagaccttgttggacatcccgtacaatcaagatgttcctgtatgttgtttgcagtctggcggtttgctttcgaggactattaagcctttctctgcaatcgtcgactcggaccgatg

SEQ ID NO: 4308 - DNA, 203 bp, Homo sapiens
ggcgcgccagtcctttgggcgggccaggggggtaggactgtgcggattctgggcgcctttcagtggagcttaggccgtgcggtcgcgctggtgagaaggtcatggccctggatcagcgctgggatcgctttcttgtgtcttggtttggtttggatgaggcccagctgacggcccaccgcgtgttcgagcgactcggaccgatg

SEQ ID NO: 4309 - DNA, 203 bp, Homo sapiens
ggcgcgccagtcctgccgtattctccgaggcgcgggcacggccctgattgactgcgggtgtcgcgctttgggggccttgccagccccaccccgctgtcgccatgagtgtcgttggtaagcgtgtagtggacgaactgtgtcgggtggtatcctcatacttgggacagtctggtcagtccctggatttgcgactcggaccgatg

SEQ ID NO: 4310 - DNA, 203 bp, Homo sapiens
ggcgcgccagtcctggtctttctctttaagggtctccaaaacgccagggtggggaaaaccacctcactagacattattcgggagctaaccgcacaactaaaaagacaccgcctagacctggcccacccctcacagacgtcacacttgtacgcttgagctggtcccgggccttcgcaccccatccaccgcgactcggaccgatg

SEQ ID NO: 4311 - DNA, 203 bp, Homo sapiens
ggcgcgccagtccttggtgccctcctccccgggaacctggtgccctcctccccgggaacctggtgccctcctccccgggaacctggtgccctcctccccgggaacctggtgccctcctccccgggaacctggtgccctcctccccgggaacctggtgccctcctccctcctcactccaatcccaatgccgactcggaccgatg

SEQ ID NO: 4312 - DNA, 203 bp, Homo sapiens
ggcgcgccagtccttgggatgcgatgtttccgttctacaggcggcagtggaacagatcctaacatctgtttcggactttgatctgcgcattctggacagctattaagcttgtgattttgtttagggcggaaaaataaattttcctttgtttttccacatcggtgccttcacatatacaagccggcacccgactcggaccgatg

SEQ ID NO: 4313 - DNA, 203 bp, Homo sapiens
ggcgcgccagtcctattaagcttgtgattttgtttagggcggaaaaataaattttcctttgtttttccacatcggtgccttcacatatacaagccggcaccatggccacttacgaggttctctgtgaggtggcgcggaaactgggcacggatgacagggaagtggtattgttcctcctaaacgtgttccgactcggaccgatg

SEQ ID NO: 4314 - DNA, 203 bp, Homo sapiens
ggcgcgccagtcctagtgtctgcgatctccatcctgtggccatgggcggtactgcagcctgctactgtgtgtaaccgcttaattgtctgagagctcccccttgtggtcactacgggtattgcataatgtgaatatactgccaccgcctccataattttactttggttgtcagaccagatttcccgaggcgactcggaccgatg

SEQ ID NO: 4315 - DNA, 203 bp, Homo sapiens
ggcgcgccagtccttcaagctactttctgattggtgccccaggcaggactgccataaaaactgaagaaggcgtgtctgctttgcagaatttaccccccactgtgctcccggttgctggcaccggttcagtggtccgacctgtcgtctgtgctcccccgtggacgacgccgagtgcctctcgggggtcccgactcggaccgatg

SEQ ID NO: 4316 - DNA, 203 bp, Homo sapiens
ggcgcgccagtcctctggcccaaacggaggatcctaggtgggtgtgcatttattagacgttggtgtgttgaaggacggatcaggcggggaggaggggtgggggagacttactgcagcactaggttaggttgaaagccggggtaaaaggcgtggctaaacaacacctatactacttgttattgtaggcccgactcggaccgatg

SEQ ID NO: 4317 - DNA, 203 bp, Homo sapiens
ggcgcgccagtcctgtttcctcttgcgctatgtgggacaactagagtccaacctggcaagcagtggagcaagacgccagacagccgatctcgaaaaaaataatgcagacagaggcaacgttcatcctaggtgactgggagataacggtgtctaactgccggtttacttgcagcagcctaacatgtggccgactcggaccgatg

SEQ ID NO: 4318 - DNA, 203 bp, Homo sapiens
ggcgcgccagtccttaaggcagccagccaggcaccatacagcttctacgactgcaaagaagagagctggcacgtggggctcttccagatcaaacacggacctggaggggtctgtacaccaccttgccacgtagcgattagggccgaccgccacgaggaacccatgcaatcgtgactgtccgagcacatcgactcggaccgatg

SEQ ID NO: 4319 - DNA, 203 bp, Homo sapiens
ggcgcgccagtcctaaggctggaccctcctctctagttgatatccttccacagggtttgcttgggggtggctatggttccatgggcgtgattaggaaacgttcggctgtttcgtctgcccttatgtttcattaaaagtatataagagcacactgtgtggttggtggtgtttacctataccctcgctgccgactcggaccgatg

SEQ ID NO: 4320 - DNA, 203 bp, Homo sapiens
ggcgcgccagtccttcggctgtttcgtctgcccttatgtttcattaaaagtatataagagcacactgtgtggttggtggtgtttacctataccctcgctgcatggatcctacactttactgtgtagttgcggttgataccaaactcgggatcggaaaaaacagatgtctcccgtggcctgcattgcggcgactcggaccgatg

SEQ ID NO: 4321 - DNA, 203 bp, Homo sapiens
ggcgcgccagtcctgaccccggttgcctggacgcgtgccctggtacggtcacttgttgcaggggttaatgccatgttttattgtgggttctctctcaggatatggaagatgaggatgttcctgtctgctggatttgcaacgaggagctcggaaatgagagatttagagcctgtggatgcacaggagagcgactcggaccgatg

SEQ ID NO: 4322 - DNA, 203 bp, Homo sapiens
ggcgcgccagtcctggattttttggggtgttggccttcgtaataaaagcccaggatcctggagtttacaggtaggcgtcgtagaaccagcactacatcacgtacgtgttttgaaccgagttgagctgtttaccgcgcctgacctaacatcgccgtttcgcatttacacgaggacacacgaggggagttcgactcggaccgatg

SEQ ID NO: 4323 - DNA, 203 bp, Homo sapiens
ggcgcgccagtcctcgcaatattttgggttatacataagttacatttggcaacgctggtctttatcgtcgcgtttggggaggaaaagcgcggcgacccctggtcgcctgggcttcaataatttataactaggctgggatttagggtaatgcacccctttgcgcatcatcgttgtggcgccagaactgtcgactcggaccgatg

SEQ ID NO: 4324 - DNA, 203 bp, Homo sapiens
ggcgcgccagtccttttccagggaaagcctggatgtaggaaaatagacacacatgtggcgtccgtgaatacgttagacatctgtcaaggcgggatagcgacagtagggcggacggcgggtcggagactaactgggcactctgctcacctcccctttccctttttcagacttccaccccagctgcagagcgactcggaccgatg

SEQ ID NO: 4325 - DNA, 203 bp, Homo sapiens
ggcgcgccagtcctagtagggcggacggcgggtcggagactaactgggcactctgctcacctcccctttccctttttcagacttccaccccagctgcagagatggcgtccaaggacgtagaagagggtgtagagggacccatctgctggatatgtagggaagaggtggggaacgagggcatacacccccgactcggaccgatg

SEQ ID NO: 4326 - DNA, 203 bp, Homo sapiens
ggcgcgccagtccttggattattaagggtcagcttgaaggatgatgttaatgacataaaggggcgtggcttccaaaaatgggtggctaacctgtccaaaatatgggaacactggagataaaaggggccagcttgagtcagtttagcactgggactgcccagtcaccttggctgccgcttcacctatggcgactcggaccgatg

SEQ ID NO: 4327 - DNA, 203 bp, Homo sapiens
ggcgcgccagtcctaagcagttgaggcgcattagatatataaaacttgggtacacacccttggtgctgtgcgcgtgctatgtgccctggtgaccgtccacaatggacgaggacgttttgcctggagaggtgttggccattgaagggatattcatggcctgtggattaaacgaacctgagtacctgtaccgactcggaccgatg

SEQ ID NO: 4328 - DNA, 203 bp, Homo sapiens
ggcgcgccagtcctttcgtcagtcccctggagaccttaatggcaaaagctatagatgccagcttcatacgggaccgcctcgacctattgaaaactgacagaggtgtggccagcatattgagcccggcgtatttaaaggccagccaattcccggtcggcatccaagccgtcacaccacccagaccagcccgactcggaccgatg

SEQ ID NO: 4329 - DNA, 203 bp, Homo sapiens
ggcgcgccagtcctggtgtggccagcatattgagcccggcgtatttaaaggccagccaattcccggtcggcatccaagccgtcacaccacccagaccagccatgaacagctctggtcaagaggatatcatatccatccccaaatccgccttcctgagcatgctacaaagcagcatcgatggaatgaagcgactcggaccgatg

SEQ ID NO: 4330 - DNA, 203 bp, Homo sapiens
ggcgcgccagtccttttccatatgaggccaagtgcattggctattttaggggcggtgaccacgcactatagtgcgcggtgtggcagaaaattcacaccgtatataaacaaggaaaggggactctgcgcgcttaagcgccaagccattatacacacgggttttttgttgtcttggccaatcgtgtctcccgactcggaccgatg

SEQ ID NO: 4331 - DNA, 203 bp, Homo sapiens
ggcgcgccagtccttataaacaaggaaaggggactctgcgcgcttaagcgccaagccattatacacacgggttttttgttgtcttggccaatcgtgtctccatggcgctaaagggaccacaaaccctcgaggaaaatattgggtctgcggcccccactggtccctgcgggtacctctatgcctatgtgcgactcggaccgatg

SEQ ID NO: 4332 - DNA, 203 bp, Homo sapiens
ggcgcgccagtcctacctgatccggatcgagatagagctcttgctccagcttggggcaggacacaacatctacaaaccctccgacgtacaggccctgtgccatgctcggaaaatacgtgtgtgagaccgagccgctgagcccggggcttaggaggctcatgtggcgctttttgcaaaataagaatttacgactcggaccgatg

SEQ ID NO: 4333 - DNA, 203 bp, Homo sapiens
ggcgcgccagtcctacagactttcccgttagtggtttcctctcctcagggaggtcgtccatatccgtgctggttgtggaggtgcttgattcgtcgtccgagctccccaagtcccacctgcctcccctagtcacagaggccttttctccgccgcgccccaccgagtccgctccaaaaccgccttctgcccgactcggaccgatg

SEQ ID NO: 4334 - DNA, 203 bp, Homo sapiens
ggcgcgccagtcctctccccaagtcccacctgcctcccctagtcacagaggccttttctccgccgcgccccaccgagtccgctccaaaaccgccttctgccatggtacgtccaaccgaggccgaggttaagaaatccctgagcaggcttccagcagcacgcaaaagagcaggtaaccgggcccacctgcgactcggaccgatg

SEQ ID NO: 4335 - DNA, 203 bp, Homo sapiens
ggcgcgccagtcctcactggcgccaccgaacggccgcgtccaacgagcagacaccgccagccgatccccgcgtacgttgcgtccgtccgctggtctaagctatgttacgagttccggacgtgaaggctagtctagtagagggcgccgcgcgcctgtcgacaggcgagcgcgtgtttcacgtcttgacccgactcggaccgatg

SEQ ID NO: 4336 - DNA, 203 bp, Homo sapiens
ggcgcgccagtcctttggtatatacgcccagtagcgcttcgaaacggacactgccttctctggcgtccttgccgagcaatagctgaaagctcttgaagagtccgtcggcagccgactccttaatctgcgttaggaggttggcctccgtggcgaggtacgggaaaggtcgttgctccaaggtcgcctcccgactcggaccgatg

SEQ ID NO: 4337 - DNA, 203 bp, Homo sapiens
ggcgcgccagtcctccgtcggcagccgactccttaatctgcgttaggaggttggcctccgtggcgaggtacgggaaaggtcgttgctccaaggtcgcctccatggcagcgctcgagggccccctactactgccaccgagcgcctccctgacgacgagtccgcagaccacgtgttatcaagcgacttggcgactcggaccgatg

SEQ ID NO: 4338 - DNA, 203 bp, Homo sapiens
ggcgcgccagtccttcattgaagaggtggcgccgatgaagagactattaaagctcggaaacaaggtggtgtattagctaacccttctagcgttggctagtcatggcactcgacaagagtatagtggttaacttcacctccagactcttcgctgatgaactggccgcccttcagtcaaaaatagggagccgactcggaccgatg

SEQ ID NO: 4339 - DNA, 203 bp, Homo sapiens
ggcgcgccagtcctgttgagcgtcccagatgacatcaccaggatgcgcgtcatgttctcctatcttcagagtctcagttctatatttaatcttggccccagactgcacgtgtatgcctactcggcagagactttggcggcctcctgttggtattccccacgctaacgatttgaagcgggggggggggtcgactcggaccgatg

SEQ ID NO: 4340 - DNA, 203 bp, Homo sapiens
ggcgcgccagtcctactgcacgtgtatgcctactcggcagagactttggcggcctcctgttggtattccccacgctaacgatttgaagcgggggggggggtatggcgtcatctgatattctgtcggttgcaaggacggatgacggctccgtctgtgaagtctccctgcgtggaggtaggaaaaaaactcgactcggaccgatg

SEQ ID NO: 4341 - DNA, 203 bp, Homo sapiens
ggcgcgccagtccttgaacaatttttcagtcaaccccttagggagcaagtggtcgcgggggtcagggcactcgacggcctcggtctcgctgactctctatgtcacaaaacagaaagactctgcctgctgatggacctggtgggcacggagtgctttgcgagggtgtgccgcctagacaccggtgcgaacgactcggaccgatg

SEQ ID NO: 4342 - DNA, 203 bp, Homo sapiens
ggcgcgccagtcctcggtgagtgtcttcccgtactgggggaggcccaaggcgggtacgccctggtctgtagcatgtatctgcacgttatcgtctccatctattcgacaaaaacggtgtacaacagtatgctatttaaatgcacaaagaataaaaagtacgactgcattgccaagcgggtgcggacaaacgactcggaccgatg

SEQ ID NO: 4343 - DNA, 203 bp, Homo sapiens
ggcgcgccagtcctactggttagagattttaaaacagcccgatgtgcaaaagacagtcagcgggagtcttgtggcatgcgtgatcgtcacacccgcattggaagcctggcttgtgttacctgggggttttgctattaaaggccgctatagggcgtcgaaggaggatctggtgttcattcgaggccgctcgactcggaccgatg

SEQ ID NO: 4344 - DNA, 203 bp, Homo sapiens
ggcgcgccagtcctaccgaactgtatgagtttattctgtgcaccacgccaataaaagggtgcgccatccgtgccgttttgggacagtgtcgcgtgaatgtcggggcactcagttcccacctctctccggcgtctttggcggtctcctgcaggttggcggcaaggcgctccctgtgacggctgagcagccgactcggaccgatg

SEQ ID NO: 4345 - DNA, 203 bp, Homo sapiens
ggcgcgccagtcctggggcactcagttcccacctctctccggcgtctttggcggtctcctgcaggttggcggcaaggcgctccctgtgacggctgagcagcatgtttgctttgagctcgctcgtgtccgagggtgacccggaggtgaccagtaggtacgtcaagggcgtacaacttgccctggaccttcgactcggaccgatg

SEQ ID NO: 4346 - DNA, 203 bp, Homo sapiens
ggcgcgccagtccttgaagcgcgaagccgagctcgggactctggtacgcaaggcgggccagaggtttgaggcgctgaaaagggaacggtcaattttgcgccagccgcgcgacctcccacgggtcgccgacattgacgccctggtcgacgccgtcgcggacctcaaagaagaggtggccgtgcgcctagcgactcggaccgatg

SEQ ID NO: 4347 - DNA, 203 bp, Homo sapiens
ggcgcgccagtcctagccgcgcgacctcccacgggtcgccgacattgacgccctggtcgacgccgtcgcggacctcaaagaagaggtggccgtgcgcctagatgcgctggaagagaatggagaggagacccccactcactcctcttcggagatcaaggacacaatcgtcaggtggaggcttgacgattcgactcggaccgatg

SEQ ID NO: 4348 - DNA, 203 bp, Homo sapiens
ggcgcgccagtccttcaggatcctgtcaactgtaccatcggtggcgatgctttagacccgcacgtggagattcctacgctgctaatcgtaacccccgtctactttccccgaggcgcaaagcatcgtctgcttcaccaagctgccaacttttggtcaagaagtgcgaaggacacctttccatatatcaacgactcggaccgatg

SEQ ID NO: 4349 - DNA, 203 bp, Homo sapiens
ggcgcgccagtccttttaaaagtcaaccgcgataggcagtggcatcagattggctctcccgccgcagcgccgcctggcgaaagttaaaaagaccgagaaacatgcgcgcttcaaagagcgaccgttttctcatgtcctcctgggtcaagctgttgtttgtggctgtaattatgtacatttgctctgcacgactcggaccgatg

SEQ ID NO: 4350 - DNA, 203 bp, Homo sapiens
ggcgcgccagtcctcggcctatttatatcagactagcagactctttgtgtatataaccgacgtgggacagaaatactgtctagttacaccacccttcgagaatgtccctggaaagggccctggcgagactgactggagtgccaatgagtactcatgccccgaagactcgcgagtcagaagaggcctgtcgactcggaccgatg

SEQ ID NO: 4351 - DNA, 203 bp, Homo sapiens
ggcgcgccagtcctttccccgctcctgcagtccccgttattacgtatgccgaaaacggcagaaaggggccttcgtcttccagtggatcgaactctaggtcataccagcccatctccgggggcgaggtagtgatatttgacaacctgtcaatctgttccactacgctcctgactttggcatccgatgtccgactcggaccgatg

SEQ ID NO: 4352 - DNA, 203 bp, Homo sapiens
ggcgcgccagtccttaccagcccatctccgggggcgaggtagtgatatttgacaacctgtcaatctgttccactacgctcctgactttggcatccgatgtcatgttgaggatgaacccggggctgggctcgtccatatcagtgcacccttccgagctgtccatctccctctttgagatcctgcaaggccgactcggaccgatg

SEQ ID NO: 4353 - DNA, 203 bp, Homo sapiens
ggcgcgccagtcctgactcgtatgtcctccagtcggacaagacgtggtcgtagctacagttggccaatgcattcttgtacaggtggataaatagctgtctgaaaaaaacacccgggtttcgcaggctgcagtgtagagtctgacctctgacataagaatacttgccttgcaggatctcaaagagggagcgactcggaccgatg

SEQ ID NO: 4354 - DNA, 203 bp, Homo sapiens
ggcgcgccagtcctaaaaaaacacccgggtttcgcaggctgcagtgtagagtctgacctctgacataagaatacttgccttgcaggatctcaaagagggagatggacagctcggaagggtgcactgatatggacgagcccagccccgggttcatcctcaacatgacatcggatgccaaagtcaggagccgactcggaccgatg

SEQ ID NO: 4355 - DNA, 203 bp, Homo sapiens
ggcgcgccagtccttagatgattgcgagttacagtttgtgggcccagaagagccttgccttatccaaggacagtcggtagtggaggagctttttccgtccccgggcgtcccaagcctgacagtgggtaaaaaacgaaaaatcgcatccctgctctctgacctggatttgtagttgtgtacccgtaacgcgactcggaccgatg

SEQ ID NO: 4356 - DNA, 203 bp, Homo sapiens
ggcgcgccagtcctgtggactggggcctgttggagcagtaaaggcaataactcgtgtgctttgtaaatttccgcccctagcggtcaaccccgtacaaggccatggcgatgtttgtgaggacctcgtctagcacacacgatgaagagagaatgcttccaattgaaggagcgcctcgcagacgacccccccgactcggaccgatg

SEQ ID NO: 4357 - DNA, 203 bp, Homo sapiens
ggcgcgccagtcctcgtgggaaatagacctcacccccgtgtcgcgaaaaggtcaatttcagtaattgtcctcattagtcgggactcgcgcatgcgtgaaccctcactatataaaacagatattacggaagggggctccctggggagcaccgaaccaggcaacacaagggtgaaacccggatttgcccccgactcggaccgatg

SEQ ID NO: 4358 - DNA, 203 bp, Homo sapiens
ggcgcgccagtcctccttgcggagtaaggttgactttttaaaggggacgtgtcattgccacccagctactggtttctgggcggggcttaatgagtcgccggtagctgcctggtatttagtggaggataagctgtagctgggtcctatgggggttgggtggggagaccctagcgtacatgtgactgaaccgactcggaccgatg

SEQ ID NO: 4359 - DNA, 203 bp, Homo sapiens
ggcgcgccagtccttagctgcctggtatttagtggaggataagctgtagctgggtcctatgggggttgggtggggagaccctagcgtacatgtgactgaacatggaggtgtgtatcccaattccgggtattggagatgaaaattgtgagagctggagggcacagattgtggcattcggtaccacatcgcgactcggaccgatg

SEQ ID NO: 4360 - DNA, 203 bp, Homo sapiens
ggcgcgccagtcctctatttgtgaaacaataatgattaaagggggtggtatttcctccgttgtcgactataacctggcgtgtaaacgtgtaaccctgccaaatgcccagaatgaaggacatacctactaagagttccccgggaacggacaattctgagaaagatgaagctgtcattgaggaagatctacgactcggaccgatg

SEQ ID NO: 4361 - DNA, 203 bp, Homo sapiens
ggcgcgccagtccttttgtcagtctgagtctggcttcatttgctctcgacgtcattctaaatttgcttgtttcgaacacatattccaccctgggtagaggggcagagtcggactgcattgcagagtgtatataagaggcgaacgcggaacgttggatagacggcttggagcctcggcggttgttcatacgactcggaccgatg

SEQ ID NO: 4362 - DNA, 203 bp, Homo sapiens
ggcgcgccagtcctgcagagtcggactgcattgcagagtgtatataagaggcgaacgcggaacgttggatagacggcttggagcctcggcggttgttcataatgacagcgtccacggtggccctggctttatttgtggcctcgatactaggtcactgctgggttacggccaactcgacaggtgtcgcacgactcggaccgatg

SEQ ID NO: 4363 - DNA, 203 bp, Homo sapiens
ggcgcgccagtcctgacagccttccagagggtcaccgaggcgcttgtaagcgtggttgccgcgtccaaaaaggtttataccgcaacacgtccaggtgtaccatggagacgacataccgccgcgaggcgctgacagtaagggttattttttgtacgagtggcgacagcgccgagacgatcgccgacgtccgactcggaccgatg

SEQ ID NO: 4364 - DNA, 203 bp, Homo sapiens
ggcgcgccagtcctcgctggtttttgactacccaggcaattctgcggctaggcccactaatatgtcagccacctagccgtgatatatagagagcctgtcgcctctctatatctgatggccggtggctccccggcatagctgtgcttaccactggacattgcggcgcgagctagtctggttgcgggacacgactcggaccgatg

SEQ ID NO: 4365 - DNA, 203 bp, Homo sapiens
ggcgcgccagtcctctctctatatctgatggccggtggctccccggcatagctgtgcttaccactggacattgcggcgcgagctagtctggttgcgggacaatggacccaggccaaagaccgaacccttttggggcgcctggggcgatacccaaaaaaccttgtttgtcacaagggtcaccgggaacacgactcggaccgatg

SEQ ID NO: 4366 - DNA, 203 bp, Homo sapiens
ggcgcgccagtcctttttttcatagcaagaaggggggcactataaggctcagtcgggactgtgcctcaaagacgaacgccgatcggtttctgtgtcggaccatgcctaaagccggtggctcagaatgggccacgttatggattattgatgcccttgaaaacaataagtttccctatttttcctggtttcgactcggaccgatg

SEQ ID NO: 4367 - DNA, 203 bp, Homo sapiens
ggcgcgccagtcctccttggtgttggtggataaaaaatatggctggatatttaaagacctgtacgcccttctgtaccaccacctgcaattgagcaaccacaatgactcccaggtctagattggccaccctggggactgtcatcctgttggtctgcttttgcgcaggcgcggcgcactcgaggggtgaccgactcggaccgatg

SEQ ID NO: 4368 - DNA, 203 bp, Homo sapiens
ggcgcgccagtcctgccagcgctggagaacacgattcatagtgagaaacacatgtgtctaatacaggcaatgctttttgacccgtgactgaaggttaaagctgcaggaagcatgttgtggtttgcgtagtagattacttctgttgaggtggggtaatgctcggaggcagaccattctgacaggtcaaccgactcggaccgatg

SEQ ID NO: 4369 - DNA, 203 bp, Homo sapiens
ggcgcgccagtccttgcaggaagcatgttgtggtttgcgtagtagattacttctgttgaggtggggtaatgctcggaggcagaccattctgacaggtcaacatggcgggacgcaggcttacctggatttctgagtttattgtaggtgctttggactctgataaatatcctttggtcaagtggctagatcgactcggaccgatg

SEQ ID NO: 4370 - DNA, 203 bp, Homo sapiens
ggcgcgccagtcctgtgccagtggggttggggtccagctagttgtggcgagaaagtcgcccacggaaaaggtgttttgtgtcgtggcttttgcctaaaaagatgcctcgctacacggagtcggaatggctcacggactttattatagatgctttagacagtggacgcttctggggggtagggtggttgcgactcggaccgatg

SEQ ID NO: 4371 - DNA, 203 bp, Homo sapiens
ggcgcgccagtcctggcctcacaagaggcgctcagactcgagccagtccagggatcgtgggaaggtgcccaaaaccacatttaaccccctgatttgacaccatgtgccgcctggacagtgagcgcgctctgtcgctcttcagttatctgagcgggacgttggcggcgaccccctttctgtggtgttttcgactcggaccgatg

SEQ ID NO: 4372 - DNA, 203 bp, Homo sapiens
ggcgcgccagtcctacgagctgtatataaatcggcttgtttttggggcggtttgtacgctgggcacagttccctttgattctcatccggtgcaccaaagtctgaacgtgaagggcacgtccttgcctgtactggtgtttgcgaactttgaggccgcgtgtggcccctggactgtgtttctgtaaggtccgactcggaccgatg

SEQ ID NO: 4373 - DNA, 203 bp, Homo sapiens
ggcgcgccagtccttctcagcaccgatttctaggcagcaccctctttaataggtgcaaggggggtgcggtgttggtgagtcacactttcgttgcagacaaaatggacaaggacaggccgggtctcccggccccggatgacaacatagaagaagtaccatctacctcgggtgttcaggaacgggcgtctcgactcggaccgatg

SEQ ID NO: 4374 - DNA, 203 bp, Homo sapiens
ggcgcgccagtcctgggacattgcagtttcttccccttcctcttctgaaacatcgaatgatgagtgatttcaaccacgtaacaagaactgggatgaaccctcgggcagtatcagactgcggggaggggcagtgataagtcatgacaattttagatgaggtagacattttgcatattttcagacccacccgactcggaccgatg

SEQ ID NO: 4375 - DNA, 203 bp, Homo sapiens
ggcgcgccagtcctcgggcagtatcagactgcggggaggggcagtgataagtcatgacaattttagatgaggtagacattttgcatattttcagacccaccatggaatcatttgaaggagagggggactctatacagtcacctgacaatgcgcggggagatgatgtacagaatactggtgagcatattcgactcggaccgatg

SEQ ID NO: 4376 - DNA, 203 bp, Homo sapiens
ggcgcgccagtcctaggaggtgtacaagcccggtaccgtggcaatcccccacccgttccaggtcggggaccaagtgcttgtcagacgccatcgacccggcagccttgagcctcggtggaaaggcccgtacctggtgttgctgaccaccccgaccgcggtaaaagtcgacggtatcgctgcctgggtcccgactcggaccgatg

SEQ ID NO: 4377 - DNA, 203 bp, Homo sapiens
ggcgcgccagtcctgggagctggaaaaagctgatcatcctcttaagctgcgtattcggcggcggcggaacgagtctgcaaaataaaaacccccaccagcctatgaccctcacctggcagggggaccccattcctgaggagctctataagatgctgagtggccactcgattcgctccttcgatgacctccgactcggaccgatg

SEQ ID NO: 4378 - DNA, 203 bp, Homo sapiens
ggcgcgccagtcctgggatcggagacccccacccagggaccaccgacccaccaacgggaggtaagctggccagcgatcgctctgtgtctcgcttctgtgtctaactccgtaactctgactgtccctctgagtgcgcgcattttggtttcagtttgttccgggctgatcgctctgtgagcgacgtgtgacgactcggaccgatg

SEQ ID NO: 4379 - DNA, 203 bp, Homo sapiens
ggcgcgccagtccttcggcagaggatcattgtgttctgatcccaccgccgcgtctagagaggcgcgctctgccatctgactctttctcttgcctctacgctactcgatctcgccgccgtttctggtttctttttgttttgtttctgataagcctctgtgtcggagtttctctcttcgaaatcttcgaacgactcggaccgatg

SEQ ID NO: 4380 - DNA, 203 bp, Homo sapiens
ggcgcgccagtcctctagagtggacacagcttggatacagacacctttagtattactgggtgttccagactagttcctgaggtaccaagttgtgaggggctatgggaaaacccctttgatccacactgcctgatagggtcgcggctggtcgagtcccatacactataataccagttgactttcatgcacgactcggaccgatg

SEQ ID NO: 4381 - DNA, 203 bp, Homo sapiens
ggcgcgccagtcctatgggaaaacccctttgatccacactgcctgatagggtcgcggctggtcgagtcccatacactataataccagttgactttcatgcaatggacactctaactaaaaacattgaagatgaaactgtcaagattattggatcctgtgccgagaaggcacaagaagcaatttctggtcgactcggaccgatg

SEQ ID NO: 4382 - DNA, 203 bp, Homo sapiens
ggcgcgccagtcctccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcacccgactcggaccgatg

SEQ ID NO: 4383 - DNA, 203 bp, Homo sapiens
ggcgcgccagtcctaatcatttatttgtttgttggttttatacctctgaactttaaagtgctaaagactctcaattttatattatatctcaacaaatcaggatgggcgcacaggtatccacgcagaagactggggcacacgagaccggtttgaacgccagtaataattcggttatacactatacaaatcgactcggaccgatg

SEQ ID NO: 4384 - DNA, 203 bp, Homo sapiens
ggcgcgccagtccttccccaaatccgtaggcaggcctcccctgccatctgaatctgaatactggccgcggctccttggttattgtctagtctgtgttgtctggtctgtgtcgacattgtagtcatctttgtgtatgtgtgtgtaagtgtgctggtgtggacgcgtggacaggacaggacgacacagcccgactcggaccgatg

SEQ ID NO: 4385 - DNA, 203 bp, Homo sapiens
ggcgcgccagtcctggtctgtgtcgacattgtagtcatctttgtgtatgtgtgtgtaagtgtgctggtgtggacgcgtggacaggacaggacgacacagccatgggacagacattgactactcctctaactttgactctgactcatttctcggacgtccaagcaagagctcacaatctttcccttgagcgactcggaccgatg

SEQ ID NO: 4386 - DNA, 203 bp, Homo sapiens
ggcgcgccagtcctgagtagcatggactcgaatcagaagagctggagctcgcttggtacggcacgtagcattgctttgcctaaagaccaagggggtatggctataggtgggggcctatagcttgtccagtgctggttgacagactcgtgctacgcgtctggttcgagtataagtagctgcaactcactcgactcggaccgatg

SEQ ID NO: 4387 - DNA, 203 bp, Homo sapiens
ggcgcgccagtcctgggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagacgactcggaccgatg

SEQ ID NO: 4388 - DNA, 203 bp, Homo sapiens
ggcgcgccagtccttactgctgaaagaactcgatttctaaattcagtgactttgccaaagggtacaacctacgcatttggttaccttgattcattgtaactatgtataaaaccagaagtaaacgtgacactgctgagaatttgtatagacactgtaaagctactggcaactgtcctccagatgtagaacgactcggaccgatg

SEQ ID NO: 4389 - DNA, 203 bp, Homo sapiens
ggcgcgccagtccttgaaaaattagattgtatctttaggggtgagtgtttccatcttgtgagaaacacttggaggggaacgtgcagaaattgttgtagaaaatgattgggaaggagccctcaattaatgatctagaaataaagctggaagaacatgtattgcctgctaaccttttaagcaacgaggttcgactcggaccgatg

SEQ ID NO: 4390 - DNA, 203 bp, Homo sapiens
ggcgcgccagtcctctactttgggtgtccgtgtttcttgtttttcatactgggtcgcttatggttacaactaattgttgtaatcattggcagtgcgcgctgaccacgcgattattgatatttccatttgttggatactccaatagtgtcaactcatatacacaacttttaccactgatcaagataaaacgactcggaccgatg

SEQ ID NO: 4391 - DNA, 203 bp, Homo sapiens
ggcgcgccagtccttcatcatatagctattggattggccatccggatattattcttgtgtttatttgtgtaatttgatataatttagaaccctgtataagaatgggagctcaagtttcaactcagaggactggctcgcatgaaaacgccaatatggcaatggatggttctaccattaattacaccacccgactcggaccgatg

SEQ ID NO: 4392 - DNA, 203 bp, Homo sapiens
ggcgcgccagtccttgccatatagcgattggattggccatccggatattgttttagacacttgtgtttgtgagtagatctcttctgacataggatataacaatgggtgcacaggtttcaacacagaaaactggatcacatgaaaacgccaacatggcagtaggaggctccaccatcaactacaccactcgactcggaccgatg

SEQ ID NO: 4393 - DNA, 203 bp, Homo sapiens
ggcgcgccagtcctacacttatcataagaggtgttagttcctaaggataatcaatacacaatattccacgacaattggcgcccaacgtggggctcgaatataagtcgggatatttataaaaatattaattttaatccctagggaccttcgtgcactgcggaaggtataattctactgccttaatagaacgactcggaccgatg

SEQ ID NO: 4394 - DNA, 203 bp, Homo sapiens
ggcgcgccagtcctatcctcggacagtgataattttggaccatcttggcaacagacgtactgtaagtgttgacaaccttaagttaacagcttatcaggataatggcacctccaatgactctggaacaatggctcttatggaagaagatgagtcaagcacatcaagcacttgaaaatgtaaccaccttgcgactcggaccgatg

SEQ ID NO: 4395 - DNA, 203 bp, Homo sapiens
ggcgcgccagtcctagcggtaagcctcctattctatgcaaaacctattttgataggaataggagttatactgcttattgcccttctttttaagataatatcatggcttcctgggaagcccaagaagaattgagagaacttctacatcatctaccagaggacgatccaccagcagatctaactcatctacgactcggaccgatg

SEQ ID NO: 4396 - DNA, 203 bp, Homo sapiens
ggcgcgccagtccttgatagtttgattgatataagagcgagagtggcctccaccggtcaataccccgaggtgtgtgacattcatccagctactggattagacgaatgcgaagctgaggaaatagtcagggttgggaaccttttgtcatacctttaggtcctcttttatcctcctttatagggaacctccgactcggaccgatg

SEQ ID NO: 4397 - DNA, 203 bp, Homo sapiens
ggcgcgccagtcctggggcgctgccggcggcgaggagtcctacttcgacatgggggcggacctgcattggcagccgagcccgcgcgccttggaggccgcctacggtccagaggacttggatgaggaagaggaagaggaggaggatgcacccgctgcggggtactgacgcctccgtgatgtgtttttagcgactcggaccgatg

SEQ ID NO: 4398 - DNA, 203 bp, Homo sapiens
ggcgcgccagtcctacggtccagaggacttggatgaggaagaggaagaggaggaggatgcacccgctgcggggtactgacgcctccgtgatgtgtttttagatgcagcaagccccggaccccgccataagggcggcgctgcaaagccagccgtccggtctagcatcggacgactgggaggccgcgatgcgactcggaccgatg

SEQ ID NO: 4399 - DNA, 203 bp, Homo sapiens
ggcgcgccagtccttcagtgaaaacgtgcctgctctcacagatcacgggacgctaccgctgcgcagcagtatccgcggagtccagcgagtgaccgtcactgacgcccgtcgccgcacctgtccctacgtctacaaggccctgggcatagtcgcgccgcgcgtgctttccagtcgcaccttctaaaaaacgactcggaccgatg

SEQ ID NO: 4400 - DNA, 203 bp, Homo sapiens
ggcgcgccagtcctcgactccgtcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggaccaccccaggcggaccagaaaccccgccgactcggaccgatg

SEQ ID NO: 4401 - DNA, 203 bp, Homo sapiens
ggcgcgccagtcctcttgaaacgccccaggaactagacgcagctgcgcttagtcatgtgtaaataaagttgtacaataaaagtctatgtgacgcatgcaaggtgtggtttatgactcatgggcggggcttagtcctatataagtggcaacacctgggcacttgggcacagaccttcagggagttcctgcgactcggaccgatg

SEQ ID NO: 4402 - DNA, 203 bp, Homo sapiens
ggcgcgccagtcctgcgccggggccgctcgctcgttctgcccaccgtgcgctaccaccccagcatcctttaattcgtgtgctgtgatactgttgcagagagatggctctcacttgccgcctgcgcatccccgtcccgaattaccgaggaagatcccgccgcaggagaggcatggcaggcagcggcctgcgactcggaccgatg

SEQ ID NO: 4403 - DNA, 203 bp, Homo sapiens
ggcgcgccagtcctgccgccgatgctattgaaagagaggaaagaggacactaaagggagagcttaacttgtatgtgccttaccgccagagaacgcgcgaagatggccaccccctcgatgatgccgcagtgggcgtacatgcacatcgccgggcaggacgcctcggagtacctgagcccgggtctggtgcgactcggaccgatg

SEQ ID NO: 4404 - DNA, 203 bp, Homo sapiens
ggcgcgccagtcctctcggcccacgcgctcgacatgaccttcgaggtggaccccatggatgagcccaccctcctctatcttctcttcgaagttttcgacgtggtcagagtgcaccagccgcaccgcggcgtcatcgaggccgtctacctgcgcacgcccttctccgccggcaacgccaccacctaagccgactcggaccgatg

SEQ ID NO: 4405 - DNA, 203 bp, Homo sapiens
ggcgcgccagtcctggtcagagtgcaccagccgcaccgcggcgtcatcgaggccgtctacctgcgcacgcccttctccgccggcaacgccaccacctaagcatgagcggctccagcgaacgagagctcgcggccatcgtgcgcgacctgggctgcgggccctactttttgggcacccacgacaagcgccgactcggaccgatg

SEQ ID NO: 4406 - DNA, 203 bp, Homo sapiens
ggcgcgccagtcctgacccgtggccccggggcggagtggcctctcgctccatgaaccggcgcacgtcctgactgccgccggccattgtttcctaggggaagatggaggagcagccgcgtaagcaggagcaggaggaggacttaaccacccacgagcaacccaaaatcgagcaggacctgggcttcgaacgactcggaccgatg

SEQ ID NO: 4407 - DNA, 203 bp, Homo sapiens
ggcgcgccagtcctaccaatcgcggccgcagcacgcggatctcacggcctgcgtcatcacccagggcgcgatcctcgcccaattgcacgccatccaaaaatcccgccaagagtttcttctgaaaaagggtagaggggtctacctggacccccagacgggcgaggtgctcaacacgggtctcccccagccgactcggaccgatg

SEQ ID NO: 4408 - DNA, 203 bp, Homo sapiens
ggcgcgccagtcctgctctgttccacaagtactgcgcgctcactcttaaagactaacgcgcgcccacccggaaaaaaggcgggaattacctcatcgccaccatgagcaaggagattcccaccccttacatgtggagctatcagccccagatgggcctggccgcgggcgcctcccaagactactccacacgactcggaccgatg

SEQ ID NO: 4409 - DNA, 203 bp, Homo sapiens
ggcgcgccagtcctgtggccccctaccaaggaaaacatggttgggttttctttggcttttgtgatcatggcctgctttatgtcaggtctgctggtaggagctctagtgtggttcctgaaacgcaagcccaggtatggaaatgaggagaaggaaaaattgctataaattctttttcttttcacagcacccgactcggaccgatg

SEQ ID NO: 4410 - DNA, 203 bp, Homo sapiens
ggcgcgccagtccttctagtgtggttcctgaaacgcaagcccaggtatggaaatgaggagaaggaaaaattgctataaattctttttcttttcacagcaccatgaatactttgaccagtgtcgtgctgctctctcttcttgtagcttttagtcaggcaggaattattaacttaaatgtatcatggggacgactcggaccgatg

SEQ ID NO: 4411 - DNA, 203 bp, Homo sapiens
ggcgcgccagtcctaattccctcagctactgtggcaatcgtggtgggagtgattgcgggctttgtaactctgatcattgtcttcatatgctacatctgctgccgcaagcgtcccaggtcatacaatcatatggtagacccactactcagcttctcttactgaaactcagtcactctcatttcagaacccgactcggaccgatg

SEQ ID NO: 4412 - DNA, 203 bp, Homo sapiens
ggcgcgccagtcctccgcaagcgtcccaggtcatacaatcatatggtagacccactactcagcttctcttactgaaactcagtcactctcatttcagaaccatgaaggctttcacagcttgcgttctgattagcatagtcacacttagttcagctgcaatgattaatgttaatgtcactagaggtggtcgactcggaccgatg

SEQ ID NO: 4413 - DNA, 203 bp, Homo sapiens
ggcgcgccagtcctccccacctacctcctctttgccctgctcacctgcacctgcgtctgcagcattgtctgcgtggtcatcaccttcctgcagctcatcgactggtgctgcgcgcgctataattatctccaccacagtcccgaatacagggacgagaacgtagccagaatcttaaggctcatctgacccgactcggaccgatg

SEQ ID NO: 4414 - DNA, 203 bp, Homo sapiens
ggcgcgccagtcctctggtgctgcgcgcgctataattatctccaccacagtcccgaatacagggacgagaacgtagccagaatcttaaggctcatctgaccatgcagactctgctcatgctgctatccctcctatcccctgccctcgccacttctgctgactctaaatgcaaattcgcggagatatggcgactcggaccgatg

SEQ ID NO: 4415 - DNA, 203 bp, Homo sapiens
ggcgcgccagtcctgaaatcagttcccactgattcagtacttagaagagccccctccccggcccccttccactgttagctactttcacataaccggcggcgatgactgaccaccacctggacctcgagatggacggccaggcctccgagcagcgcatcctgcaactgcgcgtccgtcagcagcaggagcgactcggaccgatg

SEQ ID NO: 4416 - DNA, 203 bp, Homo sapiens
ggcgcgccagtcctattctgattccgcgcgtagccataggggtagacggggttgaagtcatcttccacccggagcctctttgacatctgagagggaagacaatgaaaattgtggaccaggaatttgacatccctttcaaggtgtggaggaagttcgccgcccgccggggactggaataccagagctggcgactcggaccgatg

SEQ ID NO: 4417 - DNA, 203 bp, Homo sapiens
ggcgcgccagtcctaaaaatcacttacttgaaatctgaaagtatgtctctggtgtagttgttcagcagcacctcgttaccctcctcccagctctggtattccagtccccggcgggcggcgaacttcctccacaccttgaaagggatgtcaaattcctggtccacaattttcattgtcttccctctcagcgactcggaccgatg

SEQ ID NO: 4418 - DNA, 203 bp, Homo sapiens
ggcgcgccagtcctcgagctcagggcggagggcagaaccttattgaatcttgttgttttgaacacgctgcaggtggtggagcagcaggatctgtttctattatgaaggtctgcctgattatgaaagtggagggggcactgtgggagcttttccacatgtgcggagtggacttacaccaacaatttgtacgactcggaccgatg

SEQ ID NO: 4419 - DNA, 203 bp, Homo sapiens
ggcgcgccagtcctgcggagccagctccgagtaacgaatgctgtttctgccctccgtaggagccatataccgcggaggcacaaacggaacctccagggtcgcctgcgccatcacgctctcgtacgagggaggaggagaggaagacaccaccgcacgcctcatctctaacaaggaagagaacgcacgctcgactcggaccgatg

SEQ ID NO: 4420 - DNA, 203 bp, Homo sapiens
ggcgcgccagtccttttcgattgcggtgtttttttcgcgaatttccgcgtccgtgtcaaagtccggtgtttatgtcacagatcagctgatccgcagggtatttaaaccagtcgagtccgtcaagaggccactcttgagtgccagcgagtagagatttctctgagctccgctcccagagaccgagaaaacgactcggaccgatg

SEQ ID NO: 4421 - DNA, 203 bp, Homo sapiens
ggcgcgccagtcctcgcggtgtaccccggttcgagacttgtactcgagccggccggagccgcggctaacgtggtattggcactcccgtctcgacccagcctacaaaaatccaggatacggaatcgagtcgttttgctggtttccgaatggcagggaagtgagtcctattttttttttttgccgctcagcgactcggaccgatg

SEQ ID NO: 4422 - DNA, 203 bp, Homo sapiens
ggcgcgccagtcctacgccgcacctgtccctacgtgtacaaggcactgggcatagtcgcaccgcgcgtcctttcaagccgcactttctaaaaaaaaaaaaaatgtccattcttatctcgcccagtaataacaccggttggggtctgcgcgctccaagcaagatgtacggaggcgcacgcaaacgttctcgactcggaccgatg

SEQ ID NO: 4423 - DNA, 203 bp, Homo sapiens
ggcgcgccagtcctaggcaagcagccgctgtcgcagcggcgactattgccgacatggcccaatcgcgaagaggcaatgtatactgggtgcgtgacgctgccaccggtcaacgtgtacccgtgcgcacccgtccccctcgcacttagaagatactgagcagtctccgatgttgtgtcccagcggcgaggcgactcggaccgatg

SEQ ID NO: 4424 - DNA, 203 bp, Homo sapiens
ggcgcgccagtcctaataagtgttccatatccgtgtttacttaaggtgacgtcaatatttgtgtgacagtgcaatgtaataaaaatatgttaactgttcactggtttttattgctttttgggcggggactcaggtatataagtagaagcagacctgtgtggttagctcataggagctggctttcatcccgactcggaccgatg

SEQ ID NO: 4425 - DNA, 203 bp, Homo sapiens
ggcgcgccagtccttggtttttattgctttttgggcggggactcaggtatataagtagaagcagacctgtgtggttagctcataggagctggctttcatccatggaggtttgggccattttggaagaccttaggaagactaggcaactgttagagaacgcttcggacggagtctccggtttttggagacgactcggaccgatg

SEQ ID NO: 4426 - DNA, 203 bp, Homo sapiens
ggcgcgccagtcctgcaagacacctgcaaatcgcagtcgtcgccgtagacgcacaagcaaaccgactcccggcgccctggtgcggcaagtgtaccgcaatggtagtgcggaacctttgacactgccgcgtgcgcgttaccatccgagtatcatcacttaatcaatgttgccgctgcctccttgcagatcgactcggaccgatg

SEQ ID NO: 4427 - DNA, 203 bp, Homo sapiens
ggcgcgccagtccttatctgtgtatatgtgtcattacacgccgtcacagcagcagaggaaaaaaggaagaggtcgtgcgtcgacgctgagttactttcaagatggccaccccatcgatgctgccccaatgggcatacatgcacatcgccggacaggatgcttcggagtacctgagtccgggtctggtgcgactcggaccgatg

SEQ ID NO: 4428 - DNA, 203 bp, Homo sapiens
ggcgcgccagtccttaaagaaaaagttttatcagttttagacttttcaaccccaggtagaactgctgctgctgtggcttttcttacttttatattagataaatggatcccgcagactcatttcagcaggggatacgttttggatttcatagccacagcattgtggagaacatggaaggttcgcaagatcgactcggaccgatg

SEQ ID NO: 4429 - DNA, 203 bp, Homo sapiens
ggcgcgccagtccttgcgtcgacctccttatcttctagggtagaggtggtggcaggactgggcggtggaatgcttaagctctgctccttttcctcgtcgctgaggacgagatgtgatggcactcgtggcgatgttgacagcaatggctgagtttccatgtctgttgtttctctgcctaggagaacacacgactcggaccgatg

SEQ ID NO: 4430 - DNA, 203 bp, Homo sapiens
ggcgcgccagtcctgaggacgagatgtgatggcactcgtggcgatgttgacagcaatggctgagtttccatgtctgttgtttctctgcctaggagaacacaatggccagccgcgaaggaaatcagttaagcgaccgccacagggagcacacccccgaacgcggaaggggttctgccagtcatccgcctcgactcggaccgatg

SEQ ID NO: 4431 - DNA, 203 bp, Homo sapiens
ggcgcgccagtcctaccccctatttgattttggctggaatgctcccaatgcacatgatcatccacaagacccagaggaacacattcccctacaaaacatgcaacatccaatagcgctaatagattacgaaagtgaaccacaacccccactactccctgctattagttacttcaacctaaccggcggagcgactcggaccgatg

SEQ ID NO: 4432 - DNA, 203 bp, Homo sapiens
ggcgcgccagtccttcagaacgattagatgcgatggagttttgattacaactgaagccagcattcttttgaccaacttaagagtgtggttgtacttgaactatcacacggaacacgctaagcggcaggatagaaggcgaagaagagtgtgttctgccagggccgcgttttgctatacaaaatacgagacgactcggaccgatg

SEQ ID NO: 4433 - DNA, 203 bp, Homo sapiens
ggcgcgccagtccttgtacttttccctggtgacgcagtttcggggtgtgtgttgggtttggcgggattttttacactttactcccattacgtcagtttagggcttgtgtatatatatattgtggagaggttggagagtcactttagagcttgtgctttgtgtgcccgctgtactttgtctggtaagcccgactcggaccgatg

SEQ ID NO: 4434 - DNA, 203 bp, Homo sapiens
ggcgcgccagtccttgtagatgtgactgaagatctcagaccggatcatttggttattgcccgcactggagcagagttcggatccagtggagaagaaactgactaaggtgagtattgggaaaactttggggtgggattttcagatggacagattgagtaaaaatttgttttttctgtcttgcagctgtccgactcggaccgatg

SEQ ID NO: 4435 - DNA, 203 bp, Homo sapiens
ggcgcgccagtcctctaaggtgagtattgggaaaactttggggtgggattttcagatggacagattgagtaaaaatttgttttttctgtcttgcagctgtcatgagtggaaacgcttcttttaaggggggagtcttcagcccttatctgacagggcgtctcccatcctgggcaggagttcgtcagaatcgactcggaccgatg

SEQ ID NO: 4436 - DNA, 203 bp, Homo sapiens
ggcgcgccagtccttgactcttaaagagtagcccttgcccgcgctcattttgaaaacggcgggaatcacgtcacccttggcacctgtcctttgcccttgtcatgagtaaagagattcccacgccttacatgtggagctatcagccccaaatggggttggcagcaggcgcttcccaggactactccacccgactcggaccgatg

SEQ ID NO: 4437 - DNA, 203 bp, Homo sapiens
ggcgcgccagtcctttctcctatgattagtcgtccccatatggctctgaatgaaatctaagatctttttttttttctcttacagtatggtgaacatcaatcatgatccctagaaatttcttcttcaccatactcatctgtgcttttaatgtctgtgctactttcacagcagtagccactgcaagcccacgactcggaccgatg

SEQ ID NO: 4438 - DNA, 203 bp, Homo sapiens
ggcgcgccagtccttcctgctgacgcagtttcggggtgtgtgttgggcttggcggtatttttttttcactttactcccattacgtcagtttagggcttgtgtatatattgtggagaggttggagagtgtttttagagcttctttagagcttgtgctttgtgcgcccgctgtactttgcctggtaagcccgactcggaccgatg

SEQ ID NO: 4439 - DNA, 203 bp, Homo sapiens
ggcgcgccagtcctctgccgccagcgatcccacttgagttttatggcgaggtcataggcgatgttgacgagccgctggtctccagagagtttcatgaccagcatgaaggggattagctgcttgccaaaggaccccatccaggtgtaggtttccacatcgtaggtgagaaagagcctttctgtgcgaggcgactcggaccgatg

SEQ ID NO: 4440 - DNA, 203 bp, Homo sapiens
ggcgcgccagtcctactgtagctaggccttagcgtgccttggatactgcctgatagggcgacggcctagtcgtgtcggttctataggtagcacatacaaatatgcagaactctcatttttctttcgatacagcctctggcacctttgaagatgtaaccggaacaaaagtcaagatcgttgaatacccccgactcggaccgatg

SEQ ID NO: 4441 - DNA, 203 bp, Homo sapiens
ggcgcgccagtcctggcttttaaagcgctacagtgatgtctctcagtattgacgtgacgagtcttccttctattccttcaactatatataagaatgaatcgtcttcaacaacgtcaactctttctggaaaatctattggtaggagtgaacagtacatttcaccagatgcagaagcattcaataaataccgactcggaccgatg

SEQ ID NO: 4442 - DNA, 203 bp, Homo sapiens
ggcgcgccagtcctggctattaaagctgtacaatggggaagtacaatctaatcttgtcagaatatctatcatttatatataattcacaatctgcagttcaaattccaatatattactcttccaacagtgaattagaaaatagatgtattgaatttcattccaagtgtttagagaactcaaagaatgggcgactcggaccgatg

SEQ ID NO: 4443 - DNA, 203 bp, Homo sapiens
ggcgcgccagtcctggcttttaaagcagtaccagtagtgtgttttacctctgatggtgtaaacatgaaagtactagctttaagacacagtgtggctcaagtgtatgcagacactcaagtctacgttcatgatgatacaaaagatagttatgaaaacgcttttttaatctctaatcttacgacccataacgactcggaccgatg

SEQ ID NO: 4444 - DNA, 203 bp, Homo sapiens
ggcgcgccagtcctctgttttacgtatgtccatctgcccttccgaggacgaccagtaaccttaccatcatgcttaattgatattaataatcaatgggccattctaggccgagatgtcctccagcaatgccaaagttccctttaccttgcagaccaaccctctcgcgttctaccaatccagacacctagcgactcggaccgatg

SEQ ID NO: 4445 - DNA, 203 bp, Homo sapiens
ggcgcgccagtcctttccgtggcgtctcctgaaacgaggtgcatgcccaagacccggagacagcgtaaccaccgaatcaaaacacaaagaccttcaactccatgggtaagtctagtctctttatttgcctcttttgctcatacatggctagtctctttgtccctggcgaccccagtcggtgcacacttcgactcggaccgatg

SEQ ID NO: 4446 - DNA, 203 bp, Homo sapiens
ggcgcgccagtcctccttggcgaaatgctccgagcctgtcaggcttggacaccaaaggataagaccaaagttctagtagttcagccccgtaaaacccctccaacacaaccgtgcttccggtgtggaaaggtgggacactggagccgagactgcactcagcctcgcccccctccggggccctgccccctcgactcggaccgatg

SEQ ID NO: 4447 - DNA, 203 bp, Homo sapiens
ggcgcgccagtcctcttccgtagggctcccgtgtcccttccctcatgtctaattgacaccaagaatgagtggaccatcatcggccgggacgtcctgcagcaatgccagggggccctttacttaccggaggacctcccggccccgacccagttatccccggtgaccacccctgcagtcatcggcttagacgactcggaccgatg

SEQ ID NO: 4448 - DNA, 203 bp, Homo sapiens
ggcgcgccagtcctaccagcgatggaaagggcccgtacaatctctccaggaagcagcaggagcagctctccttcaagtcagtgacggctcgccccagtggatcccttggcggctcctgaagaagactgtatgcccaaaacccgacgaccccgaacccgcagggcacgtcgaaacagaccaccaacacccgactcggaccgatg

SEQ ID NO: 4449 - DNA, 203 bp, Homo sapiens
ggcgcgccagtccttcccttggcggctcctgaagaagactgtatgcccaaaacccgacgaccccgaacccgcagggcacgtcgaaacagaccaccaacaccatgggtaacgtactcttcttaactttattggccaccctgggcatcccagtacttcaggccagccggtgtacaatcacggtaggtatccgactcggaccgatg

SEQ ID NO: 4450 - DNA, 203 bp, Homo sapiens
ggcgcgccagtcctcagtaggcgcccgtccccccgggggaaacatacaagtgggggctcgtccgggatctgttccgctctcgccgttccccccctcccactatgggtcagacccacacatccagtcccgtccctaaggcccccagggggctctccacccaccactggcttaatttcctgcaggcggctcgactcggaccgatg

SEQ ID NO: 4451 - DNA, 203 bp, Homo sapiens
ggcgcgccagtccttaaccacatgccaataatgctgcctaactgtcccctgtaaatgtgtcccttccccaaaatattgttgtatatagttggaatagtaaaatggatgcacagccttctgcaaagcggcgcaaaagggacactgtagaaaatatatatagacattgtgtggggtcaggtacatgtccacgactcggaccgatg

SEQ ID NO: 4452 - DNA, 203 bp, Homo sapiens
ggcgcgccagtcctttgaaaaggaggagcaggaagagcaggataagtgtccttaccgggtggtgacagaatgtggggtttgtcataagggattgtgtatgtatgtgttggccacggacgaaggaatcagagggtttgagcaacagctgtgtggagaccttgacattgtgtgtcctgcctgtgccaagccgactcggaccgatg

SEQ ID NO: 4453 - DNA, 203 bp, Homo sapiens
ggcgcgccagtccttggctacgtatggggtgatcataaacacgcccaggaagtgacgtatgtcagccaatcagcatcgagcatataacctatataaaccgatgcacttccgcatttcgtcagactgcatccggtctccggcgagtgaacatctctgggaagagctccacacttgtggtgagtcaaattcgactcggaccgatg

SEQ ID NO: 4454 - DNA, 203 bp, Homo sapiens
ggcgcgccagtccttgcacttccgcatttcgtcagactgcatccggtctccggcgagtgaacatctctgggaagagctccacacttgtggtgagtcaaattatggctttcaatccacctgttattagagcattctcttcacctgcttttacttatgtcttcaaatttccatatccatcatggaaagaacgactcggaccgatg

SEQ ID NO: 4455 - DNA, 203 bp, Homo sapiens
ggcgcgccagtcctttcctgcaactccaccaaattctcctggcagctctgtgagtacttctgccttctttgataattggtgcgcacaaccgcgagacgaagatgagctcagggaatacgaaagacaagcatcgcgcctacaaaagaaaagggagtccagggagagacgagaggaaacgcccatggcaacgactcggaccgatg

SEQ ID NO: 4456 - DNA, 203 bp, Homo sapiens
ggcgcgccagtcctcaggtaacctgggggatacggacggagaggactccaagtcagaagcatcggaagtggattattgtccacccaagaaaaggcgtgtgatttcagcaactccaccaaacagtccagtaagtggtccaagcctttctacctttttagatacttggcaatcacaacctagagacgacgcgactcggaccgatg

SEQ ID NO: 4457 - DNA, 203 bp, Homo sapiens
ggcgcgccagtcctagtccgtggagtgagcttctattagagtcgttaacacgtttgaataatttctactgaaaggagtagaagaaaggagattcattcccaatggcaacaaaggggatgaataagtctcgggctcgatcccgaggcgtcaatatggtagcggctagagtgaagaacctagccgttaaacgactcggaccgatg

SEQ ID NO: 4458 - DNA, 203 bp, Homo sapiens
ggcgcgccagtcctctttgctcactcagcacaggatctgatcaggagatttgtctccggtgctttacaccggagcacaaatttaaaaattgcccaaggcctggcaaataacctaggggactaggttttcttttaatttacacgtctgtcaatatgggtgcaaacaatagcaaggagtctgtgtcaagccgactcggaccgatg

SEQ ID NO: 4459 - DNA, 203 bp, Homo sapiens
ggcgcgccagtcctgtggtgacccagcccctctgcttcggcaggggggctttcgctcgctcagcacgagatctgatcaggagcccctcccagtgtgctttacacctggcgaggggttaaaaattgcccaaggcctggcaaaacaacctaggggactaggttttccttttattaataatatctgtcattcgactcggaccgatg

SEQ ID NO: 4460 - DNA, 203 bp, Homo sapiens
ggcgcgccagtcctaggaatgcctcgagatgccatgtggacgagggcgtgcccacggtgtatcttaacccaggcgggggccgcttgggtgaaatagggttgttatacaagcctttgggagtacagcctgatagggtgttgcagagacctgctacaccactagtataaaaactctgctgtacatggcaccgactcggaccgatg

SEQ ID NO: 4461 - DNA, 203 bp, Homo sapiens
ggcgcgccagtcctctggagaagcattgccagggttacgtcgcggcagaacccggttcgcagacggccgcggcgagcgagcccccttttttcttttgccagatgcatcccgtcctgcgccaaatgcgtcccacccccccggcgaccaccgcaaccgcggccgtagcaggcgccggcgctgtacaacagcgactcggaccgatg

SEQ ID NO: 4462 - DNA, 203 bp, Homo sapiens
ggcgcgccagtcctggggcgccgccagcggcgaagagtcccactttgacatgggggcggacctgcattggcagccgagcccgcgcgccttggaggccgcctacggtccagaggacttggatgaggatgaggaagaggaggaggatgcacccgctgcggggtactgacgcctccgtgatgtgtttttagcgactcggaccgatg

SEQ ID NO: 4463 - DNA, 203 bp, Homo sapiens
ggcgcgccagtccttgcagcccagactggggcaacggatgttttgaatgcataaaataaaactcaccaaggccatagcgtgcgttctcttccttgttagagatgaggcgcgcggtggtgtcctctcctcctccctcgtacgagagcgtgatggcgcaggcaaccctggaggttccgtttgtgcctccgcgactcggaccgatg

SEQ ID NO: 4464 - DNA, 203 bp, Homo sapiens
ggcgcgccagtcctgacgcccgtcgccgcacctgtccctacgtctacaaggccctgggcatagtcgcgccgcgcgtgctctccagtcgcaccttctagaaaatgtccattctcatctcgcccagcaataacaccggctggggtcttactaggcccagcaccatgtacggaggagccaagaagcgctcccgactcggaccgatg

SEQ ID NO: 4465 - DNA, 203 bp, Homo sapiens
ggcgcgccagtcctgcgccagggccgctcgtttgttctgcccaccgtgcgctaccaccccagcatcctttaatccgtgtgctgtaatactgttgcagagagatggctctcacttgccgcctgcgcattcccgtcccgaattaccgaggaagatcccgccgcaggagaggcatggcaggcagcggcctacgactcggaccgatg

SEQ ID NO: 4466 - DNA, 203 bp, Homo sapiens
ggcgcgccagtccttatcgtgggcctgggagtgaaaagtctgaagcgccgccgatgctattaagagaggaaagaggacactaaagggagagcttaacttgtatgtgccttaccgccagagaacgcgcgaagatggccaccccctcgatgatgccgcagtgggcgtacatgcacatcgccgggcaggaccgactcggaccgatg

SEQ ID NO: 4467 - DNA, 203 bp, Homo sapiens
ggcgcgccagtccttagccatgctccagcccagcgttggtttccttctgttcatcctgtgggggttctagacgagccggctcttccaagcccaggtcctgcttgattttgggttgctcgtgggtggttaagttctcctcctcctgctcctgcttacgcggctgctcctccatcttcccctaggaaacacgactcggaccgatg

SEQ ID NO: 4468 - DNA, 203 bp, Homo sapiens
ggcgcgccagtcctaatcggtctctgcgctcgctcacccgcagttgcttgtaccacaaaaacgaagatcagctgcagcgcactcttgaagacgccgaggctttgttccacaagtactgcgcgcttactcttaaagactaacgcgcgcccacccggaaaaaaggcgggaattacctcatcgccagcacccgactcggaccgatg

SEQ ID NO: 4469 - DNA, 203 bp, Homo sapiens
ggcgcgccagtcctttgttccacaagtactgcgcgcttactcttaaagactaacgcgcgcccacccggaaaaaaggcgggaattacctcatcgccagcaccatgagcaaggagattcccacaccttacatgtggagctatcagccccagatgggcctagccgcgggcgcctcccaggactactccacccgactcggaccgatg

SEQ ID NO: 4470 - DNA, 203 bp, Homo sapiens
ggcgcgccagtcctcccttttcaggctccccaggcctctaccccgacgagttcataccgaacttcgacgcagttagagaagcggtcgacggctacgactgaatgtcctatggtgactcggctgagcttgctcggttaaggcatctggaccactgccgccgcctgcgctgctttgcccgggagagctgccgactcggaccgatg

SEQ ID NO: 4471 - DNA, 203 bp, Homo sapiens
ggcgcgccagtcctttcggaggtgagctaaggcttcccccttgtaaggagggggttagcccatacaaggtggtcgggtatttaattttaggggcggtcctgggtgggtgcatagcggtgctagcccaactgccttgctgggtggaaatcaatctttatctgctgggttagatattgcggggaggaacccgactcggaccgatg

SEQ ID NO: 4472 - DNA, 203 bp, Homo sapiens
ggcgcgccagtcctaggccagtaatcgggaatcctcagcctttccaagtggaagggggtctaaggaatcttcttttttctttttcagtatggtgatcagccatgattcctaggttcttcctatttaacatcctcttctgtctttttaacgtgtgcgctgcctttgcggccgtttcgcacacctcaccccgactcggaccgatg

SEQ ID NO: 4473 - DNA, 203 bp, Homo sapiens
ggcgcgccagtcctgccattccccacctaccttctctttgccctgctcacctgcacctgcgtctgcagcattgtctgcctggtcattaccttcctgcagcttatcgactggtgctgcgcgcgctacaattatcttcaccacagtcccgaatacagggacaagaacgtagccaaactcttaaggcttatcgactcggaccgatg

SEQ ID NO: 4474 - DNA, 203 bp, Homo sapiens
ggcgcgccagtcctcctgttttgatctcggctggaactctgttggggcatttacatacacactacaaaacagttcaccagccttcacaccgcctccccgcagaaatcagttccccctgattcagtacttagaagagccccctccccggcccccttccactgttagttactttcacataaccgccggcgcgactcggaccgatg

SEQ ID NO: 4475 - DNA, 203 bp, Homo sapiens
ggcgcgccagtcctctggatgtgaccgaggagctgcgaccagaccacctggtgatggcctgtaccgggaccgagttcagctccagtggggaggacacagattagaggtaggtttaagtagtgggcgtggctaaggtaagtataaaggcgggtgtcttacaagggtctttttgcttttctgcagacatccgactcggaccgatg

SEQ ID NO: 4476 - DNA, 203 bp, Homo sapiens
ggcgcgccagtcctaccgccgctgccgccaggagcgcgtccgcgacaccgcttctaaaagcgcaccgcggcacggtcgtggccccgcgcagctacgggctcatgcaatgcgtggacacggccaccaactcacccgtggagatcaagtaccatctgcatcttaagcacgccctctcccgcctctacgagcgactcggaccgatg

SEQ ID NO: 4477 - DNA, 203 bp, Homo sapiens
ggcgcgccagtccttattgtttacttgtttgttggtttcataccattaaattacaaggtcttagaaactctcaactttattttgacactcaatacagcaaaatgggagctcaagtatcaacgcagaagactggggcacatgagactagcttgaacgccaacgggagttcggtcattcactacaccaaccgactcggaccgatg

SEQ ID NO: 4478 - DNA, 203 bp, Homo sapiens
ggcgcgccagtccttgttataaaaccatttcctcgtgccttgacctttaacacatttgtgaacttctttaaatcccttttattagtccttaaatactaagaatgggtgcacaagtatccacacaaaaatccggatctcatgaaactggcacttatgccacaggtggatcaacaattaattacacaaatcgactcggaccgatg

SEQ ID NO: 4479 - DNA, 203 bp, Homo sapiens
ggcgcgccagtcctgtttacatccagatccaagatcaagagtggcttggaaataaggggcacttgttctttgtctcaaaggacttacaaaaacaagggtgatgaagattaagaaaaagcctccttcagttgcaaggagctaattcttaaaacttcatctagactaaggataaatcgattccaatcacgcgactcggaccgatg

SEQ ID NO: 4480 - DNA, 203 bp, Homo sapiens
ggcgcgccagtccttcttatgccacagcttatattaagaaaaagaacttgatgaagattaaggcaaccagtggtgctatcttcatctctttgatttgagtcttaagtgaatacacaggttctaatactgttcttctgtccaacggtataattcagccaggcctaagacagtagctaatcacagtcatccgactcggaccgatg

SEQ ID NO: 4481 - DNA, 203 bp, Homo sapiens
ggcgcgccagtcctcatgtaagtattgtctcaccccaagatgatccctggacaccaacaaccccctaacctccccaagttgtcattaagaaaaaatatatgatgaagattaaaaccttcatcagagctatttcttctacgcttggttaggaccagtattcacaaactattttacaatccctacccaatcgactcggaccgatg

SEQ ID NO: 4482 - DNA, 203 bp, Homo sapiens
ggcgcgccagtcctcccacatcccattacctcttccaccccctcccgtccaacgcccgcaccatcgtcgagcgtgaggctgactgggatggctgtgatctagaaaagaaatggctcgacctcgtcatagaggacgatgccaagttccttctggagaacggctctctcccgtttggctccacccttgcccgactcggaccgatg

SEQ ID NO: 4483 - DNA, 203 bp, Homo sapiens
ggcgcgccagtcctagtccctggaggttggctgactttcttcctatttctcttttcactgcgaattgtgtggattggtattctttagagcttgggagttgtctcatattgaattcatatattttactctatactacactcaaacacggctctctggtcagttaagaaaatcatttatagaataataaacgactcggaccgatg

SEQ ID NO: 4484 - DNA, 203 bp, Homo sapiens
ggcgcgccagtccttaacaacaaacataaagataaggggggatgttttaagtgtggaaaacggggtcattttgcaaaagactgtcgtgaacatataaataagcccgtagaagcaaaaactccaggactctgccctaggtgtaaaagaggaaagcattgggctaatgaatgtaaatctaaaactgacagcgactcggaccgatg

SEQ ID NO: 4485 - DNA, 203 bp, Homo sapiens
ggcgcgccagtcctacctgttaatctctggggccgcgacttactttctcaaatgaaactcatgatgtgtagtccaaatgatatagtcacggcacaaatgttagcacaaggttattgtcccggaaaaggactaggaaaaaaggaaaatggtattctgcagccccttcaaaatcaaggacaatgtgataacgactcggaccgatg

SEQ ID NO: 4486 - DNA, 203 bp, Homo sapiens
ggcgcgccagtcctgttgttgatcccgcgggacgggacatctggcgcccaacgtggggcttggatacgagggaatttgtgaggaagacggcgcagggaccggccggcgattaaaaagcgaaagtacattgtcttagccgccgcgggagcctgccgcgtcggactcagaggtaagtggtgcgctcggaacgactcggaccgatg

SEQ ID NO: 4487 - DNA, 203 bp, Homo sapiens
ggcgcgccagtcctggtggtgaaccaaccacttggtggtcgtaatgagcaattctgggacggaaccgactactttggggtgtccgtgtttcttttgttcatattaaactgttttatggtcacaacacaacttggtacgatttgtgattattcactgctcacttgtcacagtaaatatacacaatcatccgactcggaccgatg

SEQ ID NO: 4488 - DNA, 203 bp, Homo sapiens
ggcgcgccagtccttacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatcgactcggaccgatg

SEQ ID NO: 4489 - DNA, 203 bp, Homo sapiens
ggcgcgccagtcctaggggggcctctagtactagatctatactgcctgatagggtcgcggctggccgaccatgacctgtatagtcagttgatttgagcaatatggttttctttttcgcttctaccaagactaatgagactgctgaatccaaagacaaggtgcccaagcctcgcctcatgtcccaaggccgactcggaccgatg

SEQ ID NO: 4490 - DNA, 203 bp, Homo sapiens
ggcgcgccagtcctacctagccaggggcaatgggactgctttgcatatccctaatgaagtattgagatttctctgctcattacccggtgatggttgtgtggggggggccccatacactagatccatactgcctgatagggtcgcggctggccgaccataacctgtatagtcagttgaattcagccaagcgactcggaccgatg

SEQ ID NO: 4491 - DNA, 203 bp, Homo sapiens
ggcgcgccagtcctggggggccccatacactagatccatactgcctgatagggtcgcggctggccgaccataacctgtatagtcagttgaattcagccaagatgtgtttctttttccacacaaagaccaacgatattagcccaatgacaagaaagacttctgttgaacgcctcatgtccccagggcctcgactcggaccgatg

SEQ ID NO: 4492 - DNA, 203 bp, Homo sapiens
ggcgcgccagtccttcccacccagtgattgttgttgtgacaagaaaattacatagatcatgttttacaacagtattctcatggaatgtgtcggtctggaggatgttgtaccttcctgacggtcgggccatggtgggtcagccttttgtgtgggattttgtctgggtttgtcccgtgggtctcctgatgcgactcggaccgatg

SEQ ID NO: 4493 - DNA, 203 bp, Homo sapiens
ggcgcgccagtcctaacatcgatccgctcagatcggcacaaccgaacacggcccccgaagtcgggcatcccaaaaccagacaccaccgcaaagaggacctagacaaagggccaccacagttcaaggcctgcatcaggagacccacgggacaaacccagacaaaatcccacacaaaaggctgacccacccgactcggaccgatg

SEQ ID NO: 4494 - DNA, 203 bp, Homo sapiens
ggcgcgccagtccttcaactctcaagatccttcctcttcttactttgttccgctcctcgcctagtcccaacacagcaatcaccaaccagatcgaagaaaccgcggcaggtcgacccaactgagcaacatcgactgcaacttcacacaagcctccaactggcctccaacagataccgcaaagaacccaacgactcggaccgatg

SEQ ID NO: 4495 - DNA, 203 bp, Homo sapiens
ggcgcgccagtcctacggcatatcagccaatcaacacagcccaacacaaaggagacacccgacgggacacaaatccaagggtcaggtgatcccgccccaaacacaggactcaaagcccaccagaagggcacaccccagagactccacaggccatccctctccaaaagacccgagacgaactacacggccgactcggaccgatg

SEQ ID NO: 4496 - DNA, 203 bp, Homo sapiens
ggcgcgccagtcctcacaggactcaaagcccaccagaagggcacaccccagagactccacaggccatccctctccaaaagacccgagacgaactacacggcatggacaaagtgacggatgccatcatgactgggcgattatcactcgacacaatccctggctttcaatgctctgcgccgacctccaggcgactcggaccgatg

SEQ ID NO: 4497 - DNA, 203 bp, Homo sapiens
ggcgcgccagtcctttgctttaccaataacatcgagcttacatactcctcttgaaaatcaagagaggctgagttttgccacgggtgcagaaccgggacaagatggtgcccacctacccgtacagcagcctattagattggagaccaccaccaaacaccctaccatggatcctcaaccttgtggtctttcgactcggaccgatg

SEQ ID NO: 4498 - DNA, 203 bp, Homo sapiens
ggcgcgccagtccttaagcatcaatataacttatctgcatctaatccaatctgcttcccagtacttcttatatacttgaaataaagcaatgatgaatattaagaaaaaactaggctagtattgtatagtcttgaccttcttgaaacaaggtagcctagcttgcttaaccggctcttaaagggatcgagcgactcggaccgatg

SEQ ID NO: 4499 - DNA, 203 bp, Homo sapiens
ggcgcgccagtcctagaaaaaactaggctagtattgtatagtcttgaccttcttgaaacaaggtagcctagcttgcttaaccggctcttaaagggatcgagatggctgctggtccactaagagccaaagaatgggcaaggagacaattggacaatacaatcagtcatccagttggtccacggccttcgcgactcggaccgatg

SEQ ID NO: 4500 - DNA, 203 bp, Homo sapiens
ggcgcgccagtccttagacaatcctgaccgggcaataggactgcattgcatatccttaggtggtattgagaaacctctgccacccaccggcgtggatctctatggggggggccccatagactgggtctatactgcctgatagggtcgcggctggtcgaccactgactgtataaccagttgtactcaaccgactcggaccgatg

SEQ ID NO: 4501 - DNA, 203 bp, Homo sapiens
ggcgcgccagtcctgagggaatgggaaaccctccatggccgaatgcagggtgacagcctgccggcggatgcctgttgttagtataatccgttgtttgccacatggattccacagtctcttttccagcatacaccacctactttcctcaccgtatggcaagaatgcacagaatcgccactagtgtacagcgactcggaccgatg

SEQ ID NO: 4502 - DNA, 203 bp, Homo sapiens
ggcgcgccagtcctacatgtgtatccgtggaggatcgcccgggactggattccatatcccattgccatcccaacaaacggagggtatacccaccacgtgcgcgtttgcagtgggaatctgcaaatttagtcatactgcctgatagggtgtgggcctgcactttggggtactcaggctgttcatataatcgactcggaccgatg

SEQ ID NO: 4503 - DNA, 203 bp, Homo sapiens
ggcgcgccagtcctctactggattggtgattaccaatctgtactagtgttgtattaagacttgttgtgtggagaaaatggactctttcaagaagatttttgatgaagctgcaattgaatctggattttctggcattctcgacccccggctccgcgaaccctattccacttgcttttggcgtttctggtcgactcggaccgatg

SEQ ID NO: 4504 - DNA, 203 bp, Homo sapiens
ggcgcgccagtcctagagtagcttaaaacgtatatagacggcctacatattatagaatgcgtatccggaacgccaagcccggacaagtccctgatatatagatgcactgctacataagcctgcaggaggttccatatactatggagataataaaaacagtgtgtgcaagtgttcttaggaaaactccacgactcggaccgatg

SEQ ID NO: 4505 - DNA, 203 bp, Homo sapiens
ggcgcgccagtcctaaaccccagccttgagatgctacgtggacgagggcatgcccaagacacaccttaacctggacgggggtcgtccaggtgaaagtacccatctttgggtgctgggagtacagcctgatagggcgctgcagaggcccactgacaggctagtataaaaatctctgctgtacatggaaccgactcggaccgatg

SEQ ID NO: 4506 - DNA, 203 bp, Homo sapiens
ggcgcgccagtcctaggaccacgctccgtaatcgagcccaagtactcaaaccccagcacccctgggtcacgccctacgccgcccttttaacgcttcggctaatagggtctatccggcgggttgacaaagggcgcagggttacctggtactacgagcttgggtgtccctgggagtaatcccagggtgcccgactcggaccgatg

SEQ ID NO: 4507 - DNA, 203 bp, Homo sapiens
ggcgcgccagtcctatagggtctatccggcgggttgacaaagggcgcagggttacctggtactacgagcttgggtgtccctgggagtaatcccagggtgccatgctgcagcgcaggcgggcgagggtggtgcctcggcctaggggaagagcgcaagtgaccccgtgctgcataaatccccccccttttcgactcggaccgatg

SEQ ID NO: 4508 - DNA, 203 bp, Homo sapiens
ggcgcgccagtcctgccggggaccagctgattacttgtcctgcgagttcctcttgagactggccgaaaggcagccacggggccaccaaggcggcgcagcgctgcatgcggcaaggggaaaaatccttcgggtgacccctggtggcaatcccttcccttaggagcatgagtgtggtcgacacattcacccgactcggaccgatg

SEQ ID NO: 4509 - DNA, 203 bp, Homo sapiens
ggcgcgccagtcctttgatccagcaaaagataataaatggccatatttagaaagtagggtgacggtatttacatttccacatgcatttccatttgataaaaatggtaatccagtatatgaaataaatgataaaaattggaaatgtttttttgaaaggacatggtccagattagatttgcacgaggacgcgactcggaccgatg

SEQ ID NO: 4510 - DNA, 203 bp, Homo sapiens
ggcgcgccagtcctccttgaccatgccttctactgctgcatcctcttacagtaatgttacagtaccattaacatctgcatgggatgtacctatatatactggcccggacattatattgccatcccatactcctatgtggcctagtacatctcctaccaatgcttccaccaccacctatataggtattccgactcggaccgatg

SEQ ID NO: 4511 - DNA, 203 bp, Homo sapiens
ggcgcgccagtcctgcccggacattatattgccatcccatactcctatgtggcctagtacatctcctaccaatgcttccaccaccacctatataggtattcatggcacacaatattatttatggccatggtattattattttcctaaaaaacgtaaacgtattccctatttttttgcagatggctttgcgactcggaccgatg

SEQ ID NO: 4512 - DNA, 203 bp, Homo sapiens
ggcgcgccagtcctgtaaccacaaccgaaaccaacgatcatccggtgctggtgactcacgcgctgtcaataccgtgacacagagtgccacgtcctccacagatgaatcctcttcagctgttacagccgcttccggcggagatcaaagggactaaattgttagcccactgggattcaggggcaacaatacgactcggaccgatg

SEQ ID NO: 4513 - DNA, 203 bp, Homo sapiens
ggcgcgccagtcctttgttggccaattggtccaggagagggtggctaggcctgcttctttgagacctcgttggcataaaccgtctactgtacttaaggtgttgaatccaaggactgttgttattttggaccatcttggcaacaacagaactgtaagtatagataatttaaaacctacttctcatcagacgactcggaccgatg

SEQ ID NO: 4514 - DNA, 203 bp, Homo sapiens
ggcgcgccagtcctttgaaagggggcgctagggtctcacccctaacatgccaacgacagtccctgcattgcactccacacttacgttgtgcgtacgcggggcccgatggaccatcgttcacccacctacagctggactcacgacaccgcgtggccattttagctggattgtgcggacgaacaccgcttcgactcggaccgatg

SEQ ID NO: 4515 - DNA, 203 bp, Homo sapiens
ggcgcgccagtcctacccgaaacccgcctttcataagttttaccgtctgtcccgacgttaaagggaggtaaccacaagcatactgccgccttccccggcgttaacgggatgcaaccgtaagacacaccttcatccggaagtgaaacggctgcgtcacatagttttgcccgttttcacgagaaatgggacgactcggaccgatg

SEQ ID NO: 4516 - DNA, 203 bp, Homo sapiens
ggcgcgccagtcctcacactggtgacaggctaaggatgcccttcaggtaccccgaggtaacacgcgacactcgggatctgagaaggggactggggcttctataaaagcgctcggtttaaaaagcttctatgcctgaataggtgaccggaggtcggcacctttcctttacaattaatgaccctatgaatcgactcggaccgatg

SEQ ID NO: 4517 - DNA, 203 bp, Homo sapiens
ggcgcgccagtcctgtcctggtatttgttccatacgaccaagagccactcaatgaagggtggaaggccagcgttcagcgaaagctcaagggagctgggcaatccagcccagcgaccggttcacagaaccaatctggcaacactggcagcataattaacaactactatatgcagcagtaccaaaactcccgactcggaccgatg

SEQ ID NO: 4518 - DNA, 203 bp, Homo sapiens
ggcgcgccagtcctgcactttttgattgggttccttcacaaaattttggacacatgcacaaggttgttctgccccacgaaccaaaaggtgtttacgggggtctcgtcaagtcatacgcgtacatgcgcaatggctgggacgtcgaggtgaccgctgttggaaaccagttcaacggcggttgcctcctgcgactcggaccgatg

SEQ ID NO: 4519 - DNA, 203 bp, Homo sapiens
ggcgcgccagtcctgtcatggttgtcgcgccactcaccacaaacacagcaggtgcccaacagatcaaagtgtatgccaacatagccccaaccaacgtgcacgtggcgggtgagctcccctccaaggaggggatcttccccgttgcgtgttctgacggttacggcaacatggtgacaactgacccgaaacgactcggaccgatg

SEQ ID NO: 4520 - DNA, 203 bp, Homo sapiens
ggcgcgccagtcctgaggctgcccactgcatacacgcagaatgggacactggtctgaactccaagttcacgttttcaatcccgtacatctcggccgctgactacgcgtacaccgcgtcccacgaggctgaaacaacatgtgtacaggggtgggtctgtgtgtaccaaatcactcacggcaaggcagaccgactcggaccgatg

SEQ ID NO: 4521 - DNA, 203 bp, Homo sapiens
ggcgcgccagtcctgccgacgcgctcgtcgtctccgcatcagcggggaaagactttgagctccggctacctgtggacgctagacaacaaactacgaccactggtgaatctgctgaccccgtcaccactaccgttgagaactacggaggagagactcaggtccaacgtcgccaccacaccgacgttgcccgactcggaccgatg

SEQ ID NO: 4522 - DNA, 203 bp, Homo sapiens
ggcgcgccagtcctggtgcaccagtttctgcacttaacaacacaaccaatcccactgcctaccacaagggcccggtgactcgactggctctcccatacaccgcgccacaccgtgtgttggctacggcgtacactggcactacgacctacaccgccagtgcacgcggggatttggctcacctaacgacgcgactcggaccgatg

SEQ ID NO: 4523 - DNA, 203 bp, Homo sapiens
ggcgcgccagtcctacgcatgctcggcatttgccgacatcgttcaactttggtgcagttaaagcagaaacaatcactgagttgctcgtgcgcatgaagcgtgctgaactctattgtcctaggccgattcttccgattcagccaacgggcgatagacacaagcaaccgctcgtcgcacctgcaaaacaacgactcggaccgatg

SEQ ID NO: 4524 - DNA, 203 bp, Homo sapiens
ggcgcgccagtcctgaggaactggccagtggagtgaaagccatcaggaccggtctcgatgaggccaaaccctggtacaagcttattaagctcctgagccgcttgtcgtgcatggccgctgtagcagcgcggtcaaaggacccagtccttgtggccatcatgctggctgacaccggtctcgagattctgcgactcggaccgatg

SEQ ID NO: 4525 - DNA, 203 bp, Homo sapiens
ggcgcgccagtcctgacagcacgtttgtcgtgaagaagatctccgactcgctctccagtctctttcacgtgccggcccccgccttcagcttcggagccccgattctgttggccgggttggtcaaggtcgcctcgagtttcttccggtccacacccgaagaccttgagagagcagagaaacaactcaaacgactcggaccgatg

SEQ ID NO: 4526 - DNA, 203 bp, Homo sapiens
ggcgcgccagtcctgcacgtgacatcaacgacatcttcgccattctcaagaacggcgagtggctggtcaagctgatccttgccatccgcgactggattaaggcatggatcgcctcagaagagaagtttgtcaccatgacagacctggtgcctggtatccttgaaaaacagcgggacctcaacgacccacgactcggaccgatg

SEQ ID NO: 4527 - DNA, 203 bp, Homo sapiens
ggcgcgccagtcctcttgcgaacgtgcttgcacaagcaatctccacccacctcaccggcaggaccgattctgtttggtactgcccgcctgaccctgaccacttcgacggttacaaccagcagaccgttgttgtgatggacgatttgggccagaaccctgacggcaaggacttcaagtacttcgcccaacgactcggaccgatg

SEQ ID NO: 4528 - DNA, 203 bp, Homo sapiens
ggcgcgccagtcctgccaaggacgggtacaaaatcaacaacaaattggacatcatcaaagcacttgaagacacccacaccaatccagtggcaatgtttcagtacgactgtgcccttctcaacggcatggctgttgaaatgaagagattgcaacaggatatgttcaagcctcaaccacccctccagaaccgactcggaccgatg

SEQ ID NO: 4529 - DNA, 203 bp, Homo sapiens
ggcgcgccagtccttccattaaggaggaactccggcccctcatccaacaaacttcatttgtgaaacgtgcttttaagcgcctgaaggagaactttgaaattgttgcactgtgcctaacacttttggccaacattgtcatcatgatccgcgagactcacaagagacagaagatggtggatgatgcggtgcgactcggaccgatg

SEQ ID NO: 4530 - DNA, 203 bp, Homo sapiens
ggcgcgccagtcctcaaccgcaagctgaaggaccctacgccgggccactcgagcgtcagagacctctgaaagtgagagccaagctcccgcgacaagagggaccttacgcgggtccgatggagagacagaagccgctgaaagtgaaagcaagagccccggtcgtcaaggaaggaccttatgaaggaccgcgactcggaccgatg

SEQ ID NO: 4531 - DNA, 203 bp, Homo sapiens
ggcgcgccagtcctgtgaagaagcctgtcgctttgaaagtgaaagctaagaatttgattgtcactgagagtggtgcccccccgactgacctgcaaaagatggtcatgggcaacacgaagcctgttgagctcatcctcgacgggaagacagtagccatctgctgtgctactggagtgttcggcactgcccgactcggaccgatg

SEQ ID NO: 4532 - DNA, 203 bp, Homo sapiens
ggcgcgccagtcctgctaccaaggctggctactgtggaggagccgttcttgctaaggacggagctgacaccttcatcgttggcactcactctgctggaggcaatggagttgggtactgctcatgcgtgtccaggtccatgcttctcaaaatgaaggcacacatcgaccctgaaccgcaccacgaggggcgactcggaccgatg

SEQ ID NO: 4533 - DNA, 203 bp, Homo sapiens
ggcgcgccagtcctttgatcgttgataccagagatgtggaagagcgcgtccatgtaatgcgcaaaaccaagcttgcacccaccgtcgcgcacggtgtgttcaatcctgagttcgggcctgccgccttgtctaacaaggacccacgtctgaacgaaggtgttgtcctcgatgaagtcattttctccaagcgactcggaccgatg

SEQ ID NO: 4534 - DNA, 203 bp, Homo sapiens
ggcgcgccagtcctcataaaggagacacaaagatgtctgcggaggacaaagcgctgttccgccgctgcgctgctgactacgcgtcacgcctgcacagtgtgctgggtacggcaaatgccccactgagcatttacgaggcaatcaagggcgttgacggactcgacgccatggagccagacaccgcacctcgactcggaccgatg

SEQ ID NO: 4535 - DNA, 203 bp, Homo sapiens
ggcgcgccagtcctcccttccagggcctctttgagattccaagctacagatcactttacctgcgttgggtgaacgccgtgtgcggcgacgcataatcccccaaacatcacaattggcacaatgattttggggcgcgcgacgccgtgggagtgaaaagcccgaaagggctttcccggcttccttaatcccgactcggaccgatg

SEQ ID NO: 4536 - DNA, 203 bp, Homo sapiens
ggcgcgccagtcctaccacaaacactccagtttgttacactccgctaggaatgctcctggagcaccccccctagcagggcgtgggggatttcccctgcccgtctgcagaagggtggagccaaccaccttagtatgtaggcggcgggactcatgacgctcgcgtgatgacaagcgccaagcttgacttgcgactcggaccgatg

SEQ ID NO: 4537 - DNA, 203 bp, Homo sapiens
ggcgcgccagtccttcctgtgtccattaaaacatctgttgaaaggggacaacgagcaaagcgcaaagtccagcgcgatgctcggcctcgtaattacaaaattgctggtatccatgatggcttgcagacattggctcaggctgctttgccagctcatggttggggacgccaagaccctcgccataagtccgactcggaccgatg

SEQ ID NO: 4538 - DNA, 203 bp, Homo sapiens
ggcgcgccagtccttcgcaatcttggaatccttctggattaccctttggggtggattggtgatgttacaactcacacacctctagtaggcccgctggtggcaggagcggtcgttcgaccagtctgccagatagtacgcttgctggaggatggagtcaactgggctactggttggttcggtgtccacctcgactcggaccgatg

SEQ ID NO: 4539 - DNA, 203 bp, Homo sapiens
ggcgcgccagtcctttgttttgggcgcgcttctggttaccctttgcgtcctgtgctcccatcccagtcgtatctccaagctggctgggatgttttgtctaaagctcaagtagctccttttgctttgattttcttcatctgttgctatctccgctgcaggctacgttatgctgcccttttagggtttgtcgactcggaccgatg

SEQ ID NO: 4540 - DNA, 203 bp, Homo sapiens
ggcgcgccagtcctgcccatggctgcgggcttgcccctaactttctttgttgcagcagctgctgcccaaccagattatgactggtgggtgcgactgctagtggcagggttagttttgtgggccggccgtgaccgtggtcaccgcatagctctgcttgtaggtccttggcctctggtagcgcttttaaccgactcggaccgatg

SEQ ID NO: 4541 - DNA, 203 bp, Homo sapiens
ggcgcgccagtcctcctcttgcatttggttacgcctgcttcagcttttgacaccgagataattggagggctgacaataccacctgtagtagcattagttgtcatgtctcgttttggcttctttgctcacttgttacctcgctgtgctttagttaactcctatctttggcaacgttgggagaattggttcgactcggaccgatg

SEQ ID NO: 4542 - DNA, 203 bp, Homo sapiens
ggcgcgccagtcctggtgcgtctcggaaagtgccatgcttggtattctcattatgttcttaagtttttcctcttagtgtttggtgagaatggtgtgtttttctataagcacttgcatggtgatgtcttgcctaatgattttgcctcgaaactaccattgcaagagccatttttcccttttgaaggcaacgactcggaccgatg

SEQ ID NO: 4543 - DNA, 203 bp, Homo sapiens
ggcgcgccagtcctggcaagggtctataggaatgaaggaagacgcttggcgtgtggggacacggttgatggtttgcccgttgttgcgcgtctcggcgaccttgttttcgcagggttagctatgccgccagatgggtgggccattaccgcaccttttacgctgcagtgtctctctgaacgtggcacgctcgactcggaccgatg

SEQ ID NO: 4544 - DNA, 203 bp, Homo sapiens
ggcgcgccagtcctcccaataaccgttgacgcggctaatgaccaggacatctatcaaccaccatgtggagctgggtcccttactcggtgctcttgcggggagaccaaggggtatctggtaacacgactggggtcattggttgaggtcaataaatccgatgacccttattggtgtgtgtgcggggccctcgactcggaccgatg

SEQ ID NO: 4545 - DNA, 203 bp, Homo sapiens
ggcgcgccagtccttcccatggctgttgccaagggttcttcaggtgccccgattctgtgctcctccgggcatgttattgggatgttcaccgctgctagaaattctggcggttcagtcagccagattagggttaggccgttggtgtgtgctggataccatccccagtacacagcacatgccactcttgacgactcggaccgatg

SEQ ID NO: 4546 - DNA, 203 bp, Homo sapiens
ggcgcgccagtcctggacggcgctgacgcctgtcctggcccagagcccagcgaggtgaccagataccaaatgtgcttcactgaagtcaatacttctgggacagccgcactcgctgttggcgttggagtggctatggcttatctagccattgacacttttggcgccacttgtgtgcggcgttgctggtccgactcggaccgatg

SEQ ID NO: 4547 - DNA, 203 bp, Homo sapiens
ggcgcgccagtccttattacatcagtccctaccggtgctactgtcgccccagtggttgacgaagaagaaatcgtggaggagtgtgcatcattcattcccttggaggccatggttgctgcaattgacaagctgaagagtacaatcaccacaactagtcctttcacattggaaaccgcccttgaaaaactcgactcggaccgatg

SEQ ID NO: 4548 - DNA, 203 bp, Homo sapiens
ggcgcgccagtcctctttattgccactcgtgacatccgcaggaagatactgggcattctggaggcatctaccccctggagtgtcatatcagcttgcatccgttggctccacaccccgacggaggatgattgcggcctcattgcttggggtctagagatttggcagtacgtgtgcaatttctttgtgatcgactcggaccgatg

SEQ ID NO: 4549 - DNA, 203 bp, Homo sapiens
ggcgcgccagtcctttgctttaatgtccttaaagctggagttcagagcatggttaacattcctggttgtcctttctacagctgccagaaggggtacaagggcccctggattggatcaggtatgctccaagcacgctgtccatgcggtgctgaactcatcttttctgttgagaatggttttgcaaaactcgactcggaccgatg

SEQ ID NO: 4550 - DNA, 203 bp, Homo sapiens
ggcgcgccagtcctagtatcctctccaaatgtctgtttcacccaggtgcccccaaccttgagagctgcagtggccgtggacggcgtacaggttcagtgttatctaggtgagcccaaaactccttggacgacatctgcttgctgttacggtcctgacggtaagggtaaaactgttaagcttcccttccgcgactcggaccgatg

SEQ ID NO: 4551 - DNA, 203 bp, Homo sapiens
ggcgcgccagtcctcgttgacggtcacacacctggtgtgcgcatgcaacttaatttgcgtgatgcacttgagacaaatgactgtaattccacaaacaacactcctagtgatgaagccgcagtgtccgctcttgttttcaaacaggagttgcggcgtacaaaccaattgcttgaggcaatttcagctggcgactcggaccgatg

SEQ ID NO: 4552 - DNA, 203 bp, Homo sapiens
ggcgcgccagtccttgcttctaaagttctgtctgcaactcgggccatcactagtggtttcctcaaacaaagatcattggtgtatgtgactgagccgcgggatgcggagcttagaaaacaaaaagtcactattaatagacaacctctgttccccccatcataccacaagcaagtgagattggctaaggacgactcggaccgatg

SEQ ID NO: 4553 - DNA, 203 bp, Homo sapiens
ggcgcgccagtcctagatgcgtacgggtttgtagatccacgtacccgtgtcaagcgtctgttgtcgatgtggtcacccgatgcagtcggagccacatgcgatacagtgtgttttgacagtaccatcacacccgaggatatcatggtggagacagacatctactcagcagctaaactcagtgaccaacacgactcggaccgatg

SEQ ID NO: 4554 - DNA, 203 bp, Homo sapiens
ggcgcgccagtcctccgagctggcattcacaccattgcgaggcagttatacgctggaggaccgatgatcgcttatgatggccgagagatcggatatcgtaggtgtaggtcttccggcgtctatactacctcaagttccaacagtttgacctgctggctgaaggtaaatgctgcagccgaacaggctggcgactcggaccgatg

SEQ ID NO: 4555 - DNA, 203 bp, Homo sapiens
ggcgcgccagtcctcatgaagaaccctcgcttccttatttgcggcgatgattgcaccgtaatttggaaaagcgccggagcagatgcagacaaacaagcaatgcgtgtctttgctagctggatgaaggtgatgggtgcaccacaagattgtgtgcctcaacccaaatacagtttggaagaattaacatccgactcggaccgatg

SEQ ID NO: 4556 - DNA, 203 bp, Homo sapiens
ggcgcgccagtcctatgctcatcaaatgttacctctggaattaccaaaagtggcaagccttactactttcttacaagagatcctcgtatcccccttggcaggtgctctgccgagggtctgggatacaaccccagtgctgcgtggattgggtatctaatacatcactacccatgtttgtgggttagccgcgactcggaccgatg

SEQ ID NO: 4557 - DNA, 203 bp, Homo sapiens
ggcgcgccagtccttgtgttggctgtccatttcatggagcagatgctctttgaggacaaacttcccgagactgtgacctttgactggtatgggaaaaattatacggtgcctgtagaagatctgcccagcatcattgctggtgtgcacggtattgaggctttctcggtggtgcgctacaccaacgctgacgactcggaccgatg

SEQ ID NO: 4558 - DNA, 203 bp, Homo sapiens
ggcgcgccagtcctgcaggatttcactcaagacccgggcaagttcacagaaccagtaaaagatatcatgattaaatcactaccagctctcaactcccccacagtagaggagtgcggatacagtgacagggtgagatcaatcacattaggtaactccaccataacgactcaggaatgcgccaacgtggtcgactcggaccgatg

SEQ ID NO: 4559 - DNA, 203 bp, Homo sapiens
ggcgcgccagtcctagagaaggtcaactctatggaagcataccagatacctgtgagatccaatgaaggatctggaacgcaagtattcggctttccactgcaaccagggtactcgagtgtttttagtcggacgctcctaggagagatcttgaactattatacacattggtcaggcagcataaagcttaccgactcggaccgatg

SEQ ID NO: 4560 - DNA, 203 bp, Homo sapiens
ggcgcgccagtcctgcaaaactttttccagggcccagtggaagacgcgataacagccgctatagggagagttgcggataccgtgggtacagggccaaccaactcagaagctataccagcactcactgctgctgagacaggtcacacgtcacaagtagtgccgggtgacaccatgcagacacgccacgtcgactcggaccgatg

SEQ ID NO: 4561 - DNA, 203 bp, Homo sapiens
ggcgcgccagtcctgttcgacctggagctgacgtttgtcataacaagtactcaacagccctcaaccacacagaaccaagacgcacagatcctaacacaccaaattatgtacgtaccaccaggtggacctgtaccagataaagttgattcatacgtgtggcaaacatctacgaatcccagtgtgttttgcgactcggaccgatg

SEQ ID NO: 4562 - DNA, 203 bp, Homo sapiens
ggcgcgccagtcctgaccgagggaaacgccccgccgcgcatgtccataccgtttttgagcattggcaacgcctattcaaatttctatgacggatggtctgaattttccaggaacggagtttacggcatcaacacgctaaacaacatgggcacgctatatgcaagacatgtcaacgctggaagcacgggcgactcggaccgatg

SEQ ID NO: 4563 - DNA, 203 bp, Homo sapiens
ggcgcgccagtcctggtgtcacaatattacggaatccctatggctgaacgccaaaacaatagctggcttaagaaatttactgaaatgacgaatgcttgcaagggtatggaatggatagctgtcaaaattcagaaattcattgaatggctcaaagtaaaaattttgccagaggtcagggaaaaacacgacgactcggaccgatg

SEQ ID NO: 4564 - DNA, 203 bp, Homo sapiens
ggcgcgccagtcctattcctgaacagacttaaacaactccccttattagaaagtcagatcgccacaatcgagcagagcgcgccatcccaaagtgaccaggaacaattattttccaatgtccaatactttgcccactattgcagaaagtacgctcccctctacgcagctgaagcaaagagggtgttctccgactcggaccgatg

SEQ ID NO: 4565 - DNA, 203 bp, Homo sapiens
ggcgcgccagtcctcttagaactgacactactcaaattgaaccggaatgagaagttcagagacatcagaggcttcttagccaaggaggaagtggaggttaatgaggcagtgctagcaattaacaccagcaagtttcccaacatgtacattccagtaggacaggtcacagaatacggcttcttaaacctcgactcggaccgatg

SEQ ID NO: 4566 - DNA, 203 bp, Homo sapiens
ggcgcgccagtcctaggtggcacacccaccaagagaatgcttatgtacaacttccccacaagagcaggccagtgtggtggagtgctcatgtccaccggcaaggtactgggtatccatgttggtggaaatggccatcagggcttctcagcagcactcctcaaacactacttcaatgatgagcaaggtgacgactcggaccgatg

SEQ ID NO: 4567 - DNA, 203 bp, Homo sapiens
ggcgcgccagtccttggtaccagtattttcaactcaatgattaacaatatcataattaggacactaatgctaaaagtgtacaaagggattgacttggaccaattcaggatgatcgcatatggtgatgatgtgatcgcatcgtacccatggcctatagatgcatctttactcgctgaagctggtaagggcgactcggaccgatg

SEQ ID NO: 4568 - DNA, 203 bp, Homo sapiens
ggcgcgccagtcctaaagaacacccaagatcacgtgcgctcactgtgtctattagcttggcataacggggagcacgaatatgaggagttcatccgtaaaattagaagcgtcccagtcggacgttgtttgaccctccccgcgttttcaactctacgcaggaagtggttggactccttttagattagagacgactcggaccgatg

SEQ ID NO: 4569 - DNA, 203 bp, Homo sapiens
ggcgcgccagtcctagcgtcccagtcggacgttgtttgaccctccccgcgttttcaactctacgcaggaagtggttggactccttttagattagagacaatttgaaataatttagattggcttaaccctactgtgctaaccgaaccagataacggtacagtaggggtaaattctccgcattcggtgcgcgactcggaccgatg

SEQ ID NO: 4570 - DNA, 203 bp, Homo sapiens
ggcgcgccagtccttaagcagagccttaagcaggacccagacaagtttgcaaatcctgtcaaagacatcttcactgaaatggcagcgccattaaaatctccatctgccgaggcatgtggttacagcgatcgggtggcacaattaactattggcaattctaccatcactacgcaagaagcagcaaacatcgactcggaccgatg

SEQ ID NO: 4571 - DNA, 203 bp, Homo sapiens
ggcgcgccagtcctcatagttggctatggtgagtggccttcctactgttcggactctgatgctactgcagtggacaaaccaacgcgcccagatgtttcggtgaataggttttacacattggacacaaaattgtgggagaaatcatccaaggggtggtactggaaattcccggatgtgttaactgaaaccgactcggaccgatg

SEQ ID NO: 4572 - DNA, 203 bp, Homo sapiens
ggcgcgccagtccttatggctaccggcaagatgctcatagcatacacaccaccaggaggccccttacccaaggaccgggcgaccgccatgttgggcacggacgtcatctgggactttgggctgcaatcgtctgtcactcttgtaataccatggatcagcaacactcattacagagcgcacgctcgagacgactcggaccgatg

SEQ ID NO: 4573 - DNA, 203 bp, Homo sapiens
ggcgcgccagtccttggtgtgtttgactactacactacaggtttggttagcatatggtaccagacgaattatgtggttccaattggagcacccaatacagcctatataatagcattggcggcagcccagaagaacttcaccatgaagttgtgtaaggatgctagtgatatcctacagacaggcactatcgactcggaccgatg

SEQ ID NO: 4574 - DNA, 203 bp, Homo sapiens
ggcgcgccagtcctccagggagatagggtggcagatgtgattgagagttctataggggacagcgtgagcagagccctcacccgagctctaccggcacctaccggccaagacacacaggtaagcagccatcgattagatactggtaaaggtccagcactccaagccgctgaaattggagcatcatcaaacgactcggaccgatg

SEQ ID NO: 4575 - DNA, 203 bp, Homo sapiens
ggcgcgccagtccttgctagtgatgagagtatgattgagacacggtgtgttcttaattcacatagcacagctgagaccactcttgatagcttcttcagcagagcaggattagttggagagatagacctccctcttgaaggcacaaccaacccgaatgggtacgcaaactgggacatagacataacaggcgactcggaccgatg

SEQ ID NO: 4576 - DNA, 203 bp, Homo sapiens
ggcgcgccagtccttacgttctcagtgcggactgtaggcacctcgaagtccaagtgcccattggtgatcaggatttacatgaggatgaagcacgtcagggcgtggatacctcgcccaatgcgtaaccagaactatctattcaaagccaacccaaattatgctggtaattctattaaaccaactggtgccgactcggaccgatg

SEQ ID NO: 4577 - DNA, 203 bp, Homo sapiens
ggcgcgccagtcctcagtcgcacagcaattaccactctcgggaaatttggacagcagtccggagctatctacgtgggcaactttagagtggttaaccgccatcttgctactcataatgactgggcaaaccttgtttgggaagacagctcccgcgacttgctcgtatcatctaccactgctcaaggttgcgactcggaccgatg

SEQ ID NO: 4578 - DNA, 203 bp, Homo sapiens
ggcgcgccagtcctggattgcggtggcattcttagatgccaacatggcgtcgtagggatagtttccaccgggggaaatggcctggtggggttcgccgatgtgagggatcttctgtggttggatgatgaagccatggagcagggcgtgtctgattacattaaagggcttggagatgcttttggcatgggcgactcggaccgatg

SEQ ID NO: 4579 - DNA, 203 bp, Homo sapiens
ggcgcgccagtcctgtgccacgggagcccttgggcctgggttaagtcgaagacagcatcaattttgggcataccgatggctcagaagcagaatgcctcttggttaaagaaattcaacgatgcggcgaatgccgcgaaggggcttgagtggatctccaacaaaatcagtaaatttatcgattgggtcaacgactcggaccgatg

SEQ ID NO: 4580 - DNA, 203 bp, Homo sapiens
ggcgcgccagtccttatagatcttcacacaagtgcaggatatccatacagtgcactaggcatcaagaaaaaggacattttggatccaacaactcgcgatgtcagcaagatgaaattctacatggacaagtatgggttggatctaccgtactctacttatgttaaagatgaacttagggccatcgacaacgactcggaccgatg

SEQ ID NO: 4581 - DNA, 203 bp, Homo sapiens
ggcgcgccagtccttctggagttggcaagaacaggcaaggagtatggtctaactatgacccctgccgacaagtcaccctgctttaatgaggttacgtgggagaatgccactttcttgaagagaggattcttgcctgattatcaattcccgtttctcatccaccctacgatgccaatgagggagattcacgactcggaccgatg

SEQ ID NO: 4582 - DNA, 203 bp, Homo sapiens
ggcgcgccagtcctgtttccccggtgaggccgcatagactgttcccacggttgaaagtggccgatccgttatccgctcatgtacttcgagaagcctagtatcgctctggaatcttcgacgcgttgcgctcagcactcaaccccggagtgtagcttgggccgatgagtctggacagtccccactggcgacgactcggaccgatg

SEQ ID NO: 4583 - DNA, 203 bp, Homo sapiens
ggcgcgccagtcctgcaagattactcacaggatccatcaaaattcaccgagccactaaaggacgtgctcataaaaacagctccagcactcaattcaccaaatgtggaagcgtgtgggtatagtgatagagtgttgcaactcactttaggcaattccactattactacacaggaggcagcaaattcagtcgactcggaccgatg

SEQ ID NO: 4584 - DNA, 203 bp, Homo sapiens
ggcgcgccagtcctagtggcttacggacgttggcctgagtttattagagatgacgaagcaaacccggtggaccaaccaactgaaccagatgtggctacatgcagattctacacactagacactgtaatgtggggtaaggagtcgaaaggctggtggtggaagttacctgacgcactgagagacatgggcgactcggaccgatg

SEQ ID NO: 4585 - DNA, 203 bp, Homo sapiens
ggcgcgccagtcctcatgattcctctcaatttggagagcaccaagagaaacacaatggacatgtacagagttactctgagcgacagtgccgatctatcgcaaccaattttgtgcttgtcactatccccagcatctgatccgcgcttgtcacacaccatgcttggggaagtactgaactattatactcacgactcggaccgatg

SEQ ID NO: 4586 - DNA, 203 bp, Homo sapiens
ggcgcgccagtcctgcgagacaccactcacatttcacaatctgcgcttccacagggtattgaagatttgatttctgaagttgcacagggcgccctaactttgtcactcccgaagcaacaggatagcttacctgatactaaggccagtggcccggcgcattccaaggaggtacctgcactcactgcagtcgactcggaccgatg

SEQ ID NO: 4587 - DNA, 203 bp, Homo sapiens
ggcgcgccagtcctgaatagagacctcttggttgttgaatcaaaagctcaaggtaccgactcaatagcaaggtgcaattgcaatgcaggggtgtactattgtgagtccagaaggaaatactaccctgtgtcgtttgtgggacccaccttccaatacatggaggctaatgactactacccagctagatacgactcggaccgatg

SEQ ID NO: 4588 - DNA, 203 bp, Homo sapiens
ggcgcgccagtccttgtacgctggttgtccattcaatccaagagattcgctccattgtacgcacttgaggccaagagaatacaaaagttggaacacaccattaataattacatacagttcaagagcaaacaccgtattgagccagtatgtttgttagtgcatgggagcccaggtacaggaaaatcagtcgactcggaccgatg

SEQ ID NO: 4589 - DNA, 203 bp, Homo sapiens
ggcgcgccagtccttgcgactaacctaattgctagagccatagctgagaaagagaacacctccacctactcgctaccaccggacccgtctcactttgatggatacaaacaacaaggtgtggttatcatggacgacctaaaccaaaacccggatggggcagatatgaagctcttttgtcaaatggtgtccgactcggaccgatg

SEQ ID NO: 4590 - DNA, 203 bp, Homo sapiens
ggcgcgccagtcctcaatgtgcccaccattagagcagcaaaagtgcaagggcctgggtttgactatgcagtggctatggctaaaagaaacattgttacagcaactactagcaaaggggagttcacaatgctaggagtccacgacaacgtggccattttaccaactcatgcctcacctggtgagagtatcgactcggaccgatg

SEQ ID NO: 4591 - DNA, 203 bp, Homo sapiens
ggcgcgccagtccttgtaattgatggcaaagaggttgaaatcctagacgctaaagccctcgaagatcaggcaggcactaatctggaaatcaccataataaccctcaaaagaaatgaaaagttcagagatatcagacaacacatacccactcaaatcaccgagacgaatgatggagttctgattgtgaacgactcggaccgatg

SEQ ID NO: 4592 - DNA, 203 bp, Homo sapiens
ggcgcgccagtccttgggaatggttcacatgggtttgcagcggccctgaagcggtcatacttcactcagagccaaggtgaaatccagtggatgagaccatcaaaggaggcagggtatccaattataaacgccccaaccaagaccaagctcgagcccagcgctttccactatgtgtttgaaggagtaaacgactcggaccgatg

SEQ ID NO: 4593 - DNA, 203 bp, Homo sapiens
ggcgcgccagtcctggaaccagcagtcctcacaaagaatgatcccagacttaaaacagactttgaagaagcaatcttctctaagtatgtagggaacaagatcactgaggtggatgagtacatgaaagaggcagtggaccattatgctggacaacttatgtcgctggatatcagcacagagcaaatgtgcgactcggaccgatg

SEQ ID NO: 4594 - DNA, 203 bp, Homo sapiens
ggcgcgccagtcctagtgacatatgtcaaggacgagctgaggtccaaaacaaaagtggaacagggaaaatccagactgattgaagcttccagtctaaatgactcagtggccatgagaatggcatttggaaacctttatgcagcattccacaggaatccaggggtcgtcactggtagtgcagttggatgcgactcggaccgatg

SEQ ID NO: 4595 - DNA, 203 bp, Homo sapiens
ggcgcgccagtcctcgatccagacctattctggagcaagatcccagtgttgatggaagaaaagctatttgcctttgattacacaggatacgacgcatcacttagcccagcttggtttgaggcactcaagatggtgttagagaaaattggttttggagatagagtggattacatagactaccttaaccacgactcggaccgatg

SEQ ID NO: 4596 - DNA, 203 bp, Homo sapiens
ggcgcgccagtcctttcacaccacttgtacaaaaacaagatatattgtgttaagggcggcatgccatctggctgctccggcacttcaatttttaattcaatgattaacaatttgatcattaggacgcttttactgaaaacctacaagggcatagatttggaccacttaaaaatgattgcctatggtgacgactcggaccgatg

SEQ ID NO: 4597 - DNA, 203 bp, Homo sapiens
ggcgcgccagtcctgcggcgggccgtcaagcccgtgcgctgtatagcgccaggtaaccggacagcggcgtgctggattttcccggtgccattgctctggatggtgtcaccaagctgacaaatgcggagtgaacctcacaaagcgacacgcctgtggtagcgctgcccaaaagggagcggaactccccgcgactcggaccgatg

SEQ ID NO: 4598 - DNA, 203 bp, Homo sapiens
ggcgcgccagtcctccgaggcggtcctctctggccaaaagcccagcgttgatagcgccttttgggatgcaggaaccccacctgccaggtgtgaagtggagtgagcggatctccaatttggtctgttctgaactacaccatttactgctgtgaagaatgccctggaggcaagctggttacagccctgaccgactcggaccgatg

SEQ ID NO: 4599 - DNA, 203 bp, Homo sapiens
ggcgcgccagtcctcaggccctgcccgtgactctcgaccggcgcagggtcaaaaattgtctaagcagcagcaggaacgcgggagcgtttcttttccttttgtactgacatgatggcggcgtctaaggtgtatagagtttgcgagcagactctgctggcaggtgccgttcgcatgatggacaaattcttcgactcggaccgatg

SEQ ID NO: 4600 - DNA, 203 bp, Homo sapiens
ggcgcgccagtccttgtttcggcaaaaccgggacatgcagtattctaccttctcacaagcgagggttggatctgtgttgatgacaagaaaatatacccagaaacacccaaaacagaggatgtacttgtttttgcgccctatgactttgagtcactgggcaaggacccaccaaagctacaccagagatacgactcggaccgatg

SEQ ID NO: 4601 - DNA, 203 bp, Homo sapiens
ggcgcgccagtcctactcaagaagatgggcagttttcatgaggttgtcaaagcccaccacctggtcaagaacggctgggatgtggttgtgcaggtgaatccctcatttgctcactccgggccgctgtgtgtagcagcagtgccggagtacgaacacacacatgagaaagcactcaagtggtctgagctcgactcggaccgatg

SEQ ID NO: 4602 - DNA, 203 bp, Homo sapiens
ggcgcgccagtccttgaggaaccagcttacacataccaacaactttcagtttttccccaccagttgctaaatttgaggacaaattcatcagtgcatttggtgatgccctacattgggccaggccaaccaacaaatctgactttgcacaacccgtggaccattgttattttaattttgtctgaattgaccgactcggaccgatg

SEQ ID NO: 4603 - DNA, 203 bp, Homo sapiens
ggcgcgccagtcctcccaccgcgccaagttcctggccggtttacaaatttcattgatgtggcaaaacagacatattcattttgttccatttctggaaaaccttattttgaggttaccaacacctctggggacgagccactgtttcagatggatgtgtcgctcagtgcggcagagctacatggcacttacgactcggaccgatg

SEQ ID NO: 4604 - DNA, 203 bp, Homo sapiens
ggcgcgccagtccttgttggcttgaactcagctttttcttttaatgtaccttatccctcccctgctgacttcatggccgtttattctgcggaacggacggttgtgaatgtctctggatggcttcaagtttatgcactaacagctctaacttcaactgacattgccgtgaacagtaaaggccgtgtgctcgactcggaccgatg

SEQ ID NO: 4605 - DNA, 203 bp, Homo sapiens
ggcgcgccagtcctggttgctgtttccgccggcccagacttctcccttcgtcacccggcggacctgcccgacaagcaggttaccaatgtgggagaggatggtgaacccggtgagacagagcctcgtcatgctttgtcacccgtggacatgcacgtgcacacagatgtcagtttcttgcttgaccggttcgactcggaccgatg

SEQ ID NO: 4606 - DNA, 203 bp, Homo sapiens
ggcgcgccagtcctctttgatgttgagacacttgagctttcaaatttgacaggttctcctgccacacatgttctggatccgtttggctcgactgcccaactggcttgggcacgtctgctaaacacttgcacctacttcttttctgatttggaattgtcaatccagtttaaatttaccaccactccgtccgactcggaccgatg

SEQ ID NO: 4607 - DNA, 203 bp, Homo sapiens
ggcgcgccagtcctctctgttggagagggctttgtgtgggtgaagtggctccctgttggagcaccaaccaagaccacagatgcttggcagttagaaggaggtggaaattcagttagaattcaaaaattggccgttgcagggatgtgccccactgttgtgttcaagattgcaggctcccgttcacaagccgactcggaccgatg

SEQ ID NO: 4608 - DNA, 203 bp, Homo sapiens
ggcgcgccagtcctggtggttatgttgattgctgatttcggattggaggtctttgacactgggtttttcttttcctactttcaagagaagttgcagccttatatgaaaactattcctggtaagatttctgatttggtcactgatgcggctacggctgccgcccaaattccaaagggagtgtattctttcgactcggaccgatg

SEQ ID NO: 4609 - DNA, 203 bp, Homo sapiens
ggcgcgccagtcctgctctattcagaattggaaaaatatcccttgtacaagttaaaattgaaggaacctgatactcaagaggaagcgcgccagtggtttaaagacatgcagcagcgtgctctcgctgtgaaggacaaaggtctcttttccctcctgcaaattccattagttaacttgccccagagccgcgactcggaccgatg

SEQ ID NO: 4610 - DNA, 203 bp, Homo sapiens
ggcgcgccagtccttgttcagccaattgagctttaccttgacaatgaattggttactgactgctctgccttgggtgtttatgacaattcatatttggtgccccttcatttgtttgaatttgattttgataccattgtgcttggtggacgtcattacaagaaagctgagtgtgagaaggtagagtttgacgactcggaccgatg

SEQ ID NO: 4611 - DNA, 203 bp, Homo sapiens
ggcgcgccagtccttcaatcatttttgaaagatgagatccgcccacttgagaaagttagggctggaaagacccgcctgattgacgtgccgccgatgccccatgtggtggttggtaggcagctcttgggccggtttgtggcaaaatttcatgaagcaaatggatttgacattggctcagccattggatgcgactcggaccgatg

SEQ ID NO: 4612 - DNA, 203 bp, Homo sapiens
ggcgcgccagtcctcatttgctatggggacgactgcctcattgcttctgattttgaaattgatttccaacaactggtgcctgtcttttctagttttggacaggtaataactacagctgacaagactgatttttttaaactgacaacgctttcggaggtgaccttccttaagcgcgcttttgttctgaccgactcggaccgatg

SEQ ID NO: 4613 - DNA, 203 bp, Homo sapiens
ggcgcgccagtcctggccttttacaagccagtgatggatgtgaagacccttgaagcaatcttaagctttgttcgcccaggcacacaggctgaaaagctcctgtccgtggcgcagttggcaggccactgcgaaccggagcagtatgagcgcctgtttgagccctttgctgggatgtatttcgtccctaccgactcggaccgatg

SEQ ID NO: 4614 - DNA, 203 bp, Homo sapiens
ggcgcgccagtcctagtggatgcattgagtggattgactgtcagggctgtctttaggcttaattccagacctctctgtgcttagggcaaacatcatttggccttaaatgggattctgtgagaggggatccctccattgacagctggactgttctttggggccttatgtggtgtttgcctctgaggtaccgactcggaccgatg

SEQ ID NO: 4615 - DNA, 203 bp, Homo sapiens
ggcgcgccagtccttcaggggcatttaggtttttcctcattcttaaataataatgaacatgtctagacaaggtattttccagactgttgggagtggtcttgaccacatcctgtctttggcagacattgaggaagagcaaatgattcaatcagttgataggactgcagtgactggtgcttcttattttacgactcggaccgatg

SEQ ID NO: 4616 - DNA, 203 bp, Homo sapiens
ggcgcgccagtcctagttgtatagagggcctttagatctgacaattattattacaggagcaactgatgtagatggcatggcctggttcactccagtaggtcttgccgttgatactccttgggtagagaaggagtcagctttgtctattgactacaaaactgctcttggagctgtcagatttaacacaacgactcggaccgatg

SEQ ID NO: 4617 - DNA, 203 bp, Homo sapiens
ggcgcgccagtccttcacagaacaatcagagttttattttcccagagctccattgaactcaaatgccatgttatccactgaatcaatgatgagcagaattgcagctggagacttggagtcatcagtggatgatcctagatcagaggaagataaaagatttgagagtcatatagaatgcaggaagccatcgactcggaccgatg

SEQ ID NO: 4618 - DNA, 203 bp, Homo sapiens
ggcgcgccagtcctccaactggttaagagatatttgttctgggatcaccatttttaaaaacttcaaggatgcaatttattggctttatacaaaattaaaggacttttatgaagtgaattatggcaagaagaaggacattttaaatattcttaaagataaccaacaaaaaatagagaaagccattgaggcgactcggaccgatg

SEQ ID NO: 4619 - DNA, 203 bp, Homo sapiens
ggcgcgccagtcctttcctaagtttagagatattactcagcattttattaagaaaggggatgtgcctagagctttgaatcgcctggcaacattagtgacaactgtaaatggaacccctatgttaatttctgagggcccactaaagatggaagagaaagctacttatgttcataagaaaaatgatggtacgactcggaccgatg

SEQ ID NO: 4620 - DNA, 203 bp, Homo sapiens
ggcgcgccagtcctcaacagttgatttaactgtggatcaggcatggagaggaaaaggcgaaggtcttcctggaatgtgtggtggggccttggtttcatcgaatcaatctatacagaatgcaatcttgggcatccatgttgctggaggaaattcaattcttgttgcaaaattggttactcaagaaatgtcgactcggaccgatg

SEQ ID NO: 4621 - DNA, 203 bp, Homo sapiens
ggcgcgccagtccttccaaaatattgataagaaaattgaaagtcagagaattatgaaagtggagtttactcagtgttcaatgaatgtggtctccaaaacgctttttagaaagagtcccatttatcatcacattgataaaaccatgattaattttcctgcagctatgcccttttctaaagctgaaattgcgactcggaccgatg

SEQ ID NO: 4622 - DNA, 203 bp, Homo sapiens
ggcgcgccagtcctatccaatggctgtgatgttatctaagtattcattacctattgtagaagaaccagaggattataaagaggcttcaattttttatcaaaataaaatagtgggtaagactcagttagttgatgattttttagatcttgatatggccattacaggggccccaggaattgatgctatcacgactcggaccgatg

SEQ ID NO: 4623 - DNA, 203 bp, Homo sapiens
ggcgcgccagtcctctgatagacagtgggatgaattatttaaaacaatgataagattcggagatgttggtcttgatttagatttctctgcttttgatgctagtcttagtccatttatgattagagaagcaggtagaatcatgagtgaactatctggaactccatcccattttggcacagctcttatcacgactcggaccgatg

SEQ ID NO: 4624 - DNA, 203 bp, Homo sapiens
ggcgcgccagtcctatactatcatttattccaagcatttgctgtataactgttgttaccatgtctgtggttcaatgccctctgggtctccttgtacagctttgctaaattcaattattaataatgtcaatttgtattatgtgttttccaagatatttggaaagtctccagttttcttttgtcaggcttcgactcggaccgatg

SEQ ID NO: 4625 - DNA, 203 bp, Homo sapiens
ggcgcgccagtcctgttgagccccttgttgaagtgtttccctccatcgcgacgtggttggagatctaagtcaaccgactccgacgaaactaccatcatgcctccccgattatgtgatgctttctgccctgctgggtggagcaccctcgggttgagaaaaccttcttcctttttccttggactcgggtccgactcggaccgatg

SEQ ID NO: 4626 - DNA, 203 bp, Homo sapiens
ggcgcgccagtcctccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagacgactcggaccgatg

SEQ ID NO: 4627 - DNA, 203 bp, Homo sapiens
ggcgcgccagtcctaagcagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacactctacgactcggaccgatg

SEQ ID NO: 4628 - DNA, 203 bp, Homo sapiens
ggcgcgccagtcctacacgagcaatcaatctcaaacaatggactggactgacgtaccgctcatacgcgatattgtcatggaaccccagggaaactcctcgtcatctgacaagagtaactcccagtcctcaggaaatgaaggggttattattaacaacttctattccaatcaataccaaaactcaattgcgactcggaccgatg

SEQ ID NO: 4629 - DNA, 203 bp, Homo sapiens
ggcgcgccagtccttccttgaattgtgcaagctccccactttccttggtaaccccaacaccaacaacaagcgttacccctatttctctgccaccaattctgtaccagccacttccatggttgattaccaagttgctctctcatgctcttgtatggctaattcaatgcttgctgctgttgctcgtaattcgactcggaccgatg

SEQ ID NO: 4630 - DNA, 203 bp, Homo sapiens
ggcgcgccagtccttcacgctcaggatgccgatttcacccaccaagtgggttccacaaggagttgacaatgctgagaaaggtaaagtctccaacgatgatgcttcggttgactttgtcgccgaaccagtcaagctgcccgagaaccaaacccgggtggccttcttctatgacagagctgtccctatagcgactcggaccgatg

SEQ ID NO: 4631 - DNA, 203 bp, Homo sapiens
ggcgcgccagtcctgtatgttgaggcccggccaaaatatggaaaccacttttaactaccaagaaaatgattaccgcctcaattgtcttttgctaacccctctcccttccttttgtcctgacagttcttccgggccccaaaaaacaaaggctcccgttcaatggcgatgggtgcgatctggcggcgtcacgactcggaccgatg

SEQ ID NO: 4632 - DNA, 203 bp, Homo sapiens
ggcgcgccagtcctcccctaacgcagacttcgggcgtctctggatccagggcaatacctctgcctccgtccggatcaggtacaagaaaatgaaggtcttctgcccccgcccgaccctcttcttcccctggcctacgcccaccaccaccaagatcaatgctgacaacccagtccccattcttgaactcgcgactcggaccgatg

SEQ ID NO: 4633 - DNA, 203 bp, Homo sapiens
ggcgcgccagtcctagaatcccgctgctctctaccgcattgatctcttcatcaccttcactgatgagttcatcacctttgattacaaggttcacggacgtcctgtgcttaccttccggatcccaggcttcggcctgaccccggcaggtaggatgctcgtgtgcatgggcgaacaacccgcacatggtccgactcggaccgatg

SEQ ID NO: 4634 - DNA, 203 bp, Homo sapiens
ggcgcgccagtcctcgttcacctcctctagatccctctatcatgtcatttttactgctacttgctcttcctttagctttagtatctacaaggggcggtaccgctcctggaaaaagcccatccatgacgagcttgtggatcgtggttacaccactttcggcgagttcttcaaggctgtgcgcggatacccgactcggaccgatg

SEQ ID NO: 4635 - DNA, 203 bp, Homo sapiens
ggcgcgccagtcctatgctgactattacagacagagactcatacacgatgtggaaacaaatccaggccctgtgcagtcggtttttcagccacaaggtgcggtgctaactaaatccctagcaccccaggcaggaattcaaaacctccttctacgcctcctcggcatagacggtgactgttcagaagttacgactcggaccgatg

SEQ ID NO: 4636 - DNA, 203 bp, Homo sapiens
ggcgcgccagtccttgactggtgtggacctcctcaccaacgattctgtttttgattggctcaaacaaaaattgtcttccttctttcgcacccctcccccagcttgccccaatgttatgcagcctcagggacctctacgcgaggccaatgaaggcttcacctttgctaagaacattgagtgggctatgacgactcggaccgatg

SEQ ID NO: 4637 - DNA, 203 bp, Homo sapiens
ggcgcgccagtcctcgaatatggctcacctggaaagaaaaggcactccttttacctctagcttcattgttgctacaacaaatttgcccaaattccgccctgttacggttgcccactaccccgctgttgataggcgaatcacctttgattttactgttactgctggaccccactgcaaaacgcctgctgcgactcggaccgatg

SEQ ID NO: 4638 - DNA, 203 bp, Homo sapiens
ggcgcgccagtcctcccgcaagactgaaaatgtgaagaaaatgaatagcctggttgctcagtctccaccagactgggagcactttgagaacatcctcacctgtctccgtcagaacaacgccgctctccaggaccaactcgatgagttacaggaagcgtttgctcaagcgcgcgagcgctctgactttccgactcggaccgatg

SEQ ID NO: 4639 - DNA, 203 bp, Homo sapiens
ggcgcgccagtccttggttaaccgccacgttgcagagacagattggaccgctttcaaactcaaggatgtgagacacgagcgccacactgtcgcccttcgctccgtcaatagatcaggagccaagactgacctcacattcataaaagtcacaaagggacctctcttcaaagacaacgttaacaaattttcgactcggaccgatg

SEQ ID NO: 4640 - DNA, 203 bp, Homo sapiens
ggcgcgccagtcctgctccaacaaggacgacttcccagcaaggaacgacaccgtcactggaatcatgaacaccggcctggctttcgtgtactctggcaacttcttgattggcaaccaacctgttaacaccacaactggagcctgtttcaaccactgcctccactaccgggctcaaacccgacgtggttcgactcggaccgatg

SEQ ID NO: 4641 - DNA, 203 bp, Homo sapiens
ggcgcgccagtcctcaggatctgttgtacatgtccctagaaaaactaaattgaggaggacagtcgcccacgacgtcttccaacccaaattcgaacctgcagttctgtcccgttatgaccctgggaccgataaagatgtggatgttgtagccttctccaaacacactaccaacatggaaagcttgcccccgactcggaccgatg

SEQ ID NO: 4642 - DNA, 203 bp, Homo sapiens
ggcgcgccagtcctatcttctgaatttcatcactgctaaaatgacccctcaattggactacgctcattccaaattggtgatcggtgtttatgatgatgttgtttaccaatcatttttgaaagatgaaattcggcctatagaaaagatccatgaagcgaaaacccggatcgttgacgtacccccgtttgcgactcggaccgatg

SEQ ID NO: 4643 - DNA, 203 bp, Homo sapiens
ggcgcgccagtcctatgcttcccactccactgcgatgtttgaatgcttaattaacaatttctttacagagcaaaatggatttgacagacgcatcgccgagtatcttagatctctggctgtgtcacgacatgcctatgaggaccgccgtgtccttatacgtgggggcctgccctcgggctgtgctgccacgactcggaccgatg

SEQ ID NO: 4644 - DNA, 203 bp, Homo sapiens
ggcgcgccagtcctgacgtcagcctatccccaaggcacgtcggcccgagggcaggacctgggctcagcccgggtacccttggcccctctatggcaatgagggttgcgggtgggcgggatggctcctgtctccccgtggctctcggcctagctggggccccacagacccccggcgtaggtcgcgcaattcgactcggaccgatg

SEQ ID NO: 4645 - DNA, 203 bp, Homo sapiens
ggcgcgccagtccttccttctggccctgctctcttgcctgactgtgcccgcttcagcctaccaagtgcgcaattcctcggggctttaccatgtcaccaatgattgccctaactcgagtgttgtgtacgaggcggccgatgccatcctgcacactccggggtgtgtcccttgcgttcgcgagggtaacgcgactcggaccgatg

SEQ ID NO: 4646 - DNA, 203 bp, Homo sapiens
ggcgcgccagtcctcctcgaggtgttgggtggcggtgacccccacggtggccaccagggacggcaaactccccacaacgcagcttcgacgtcatatcgatctgcttgtcgggagcgccaccctctgctcggccctctacgtgggggacctgtgcgggtctgtctttcttgttggtcaactgtttacctcgactcggaccgatg

SEQ ID NO: 4647 - DNA, 203 bp, Homo sapiens
ggcgcgccagtcctcccactggggagtcctggcgggcataaagtatttctccatggtggggaactgggcgaaggtcctggtagtgctgctgctatttgccggcgtcgacgcggaaacccacgtcaccgggggaaatgccggccgcaccacggctgggcttgttggtctccttacaccaggcgccaagccgactcggaccgatg

SEQ ID NO: 4648 - DNA, 203 bp, Homo sapiens
ggcgcgccagtcctagaacatccaactgatcaacaccaacggcagttggcacatcaatagcacggccttgaactgcaatgaaagccttaacaccggctggttagcagggctcttctatcagcacaaattcaactcttcaggctgtcctgagaggttggccagctgccgacgccttaccgattttgccccgactcggaccgatg

SEQ ID NO: 4649 - DNA, 203 bp, Homo sapiens
ggcgcgccagtcctctacctacagctggggtgcaaatgatacggatgtcttcgtccttaacaacaccaggccaccgctgggcaattggttcggttgtacctggatgaactcaactggattcaccaaagtgtgcggagcgcccccttgtgtcatcggaggggtgggcaacaacaccttgctctgccccacgactcggaccgatg

SEQ ID NO: 4650 - DNA, 203 bp, Homo sapiens
ggcgcgccagtcctaagcggcctgcaactggacgcggggcgaacgctgtgatctggaagacagggacaggtccgagctcagcccgttgctgctgtccaccacacagtggcaggtccttccgtgttctttcacgaccctgccagccttgtccaccggcctcatccacctccaccagaacattgtggacgcgactcggaccgatg

SEQ ID NO: 4651 - DNA, 203 bp, Homo sapiens
ggcgcgccagtccttgcagtacttgtacggggtagggtcaagcatcgcgtcctgggccattaagtgggagtacgtcgttctcctgttccttctgcttgcagacgcgcgcgtctgttcctgcttgtggatgatgttactcatatcccaagcggaggcggctttggagaacctcgtaatactcaatgcagcgactcggaccgatg

SEQ ID NO: 4652 - DNA, 203 bp, Homo sapiens
ggcgcgccagtcctcatccctggccgggacgcatggtcttgtgtccttcctcgtgttcttctgctttgcgtggtatctgaagggtaggtgggtgcccggagcggtctacgccctctacgggatgtggcctctcctcctgctcctgctggcgttgcctcagcgggcatacgcactggacacggaggtggcgactcggaccgatg

SEQ ID NO: 4653 - DNA, 203 bp, Homo sapiens
ggcgcgccagtccttcatcttactcacgtgtgtagtacacccggccctggtatttgacatcaccaaactactcctggccatcttcggacccctttggattcttcaagccagtttgcttaaagtcccctacttcgtgcgcgttcaaggccttctccggatctgcgcgctagcgcggaagatagccggagcgactcggaccgatg

SEQ ID NO: 4654 - DNA, 203 bp, Homo sapiens
ggcgcgccagtcctgtcattacgtgcaaatggccatcatcaagttaggggcgcttactggcacctgtgtgtataaccatctcgctcctcttcgagactgggcgcacaacggcctgcgagatctggccgtggctgtggaaccagtcgtcttctcccgaatggagaccaagctcatcacgtggggggcagcgactcggaccgatg

SEQ ID NO: 4655 - DNA, 203 bp, Homo sapiens
ggcgcgccagtcctagagcttccaggtggcccacctgcatgctcccaccggcagcggtaagagcaccaaggtcccggctgcgtacgcagccaagggctacaaggtgttggtgctcaacccctctgttgctgcaacactgggctttggtgcttacatgtccaaggcccatggggttgatcctaatatcacgactcggaccgatg

SEQ ID NO: 4656 - DNA, 203 bp, Homo sapiens
ggcgcgccagtcctggaccggggtgagaacaattaccactggcagccccatcacgtactccacctacggcaagttccttgccgacgccgggtgctcaggaggtgcttatgacataataatttgtgacgagtgccactccacggatgccacatccatctcgggcatcggcactgtccttgaccaagcagcgactcggaccgatg

SEQ ID NO: 4657 - DNA, 203 bp, Homo sapiens
ggcgcgccagtcctagactgcgggggcgagactggttgtgctcgccactgctacccctccgggctccgtcactgtgtcccatcctaacatcgaggaggttgctctgtccaccaccggagagatccccttttacggcaaggctatccccctcgaggtgatcaaggggggaagacatctcatcttctgcccgactcggaccgatg

SEQ ID NO: 4658 - DNA, 203 bp, Homo sapiens
ggcgcgccagtcctactcaaagaagaagtgcgacgagctcgccgcgaagctggtcgcattgggcatcaatgccgtggcctactaccgcggtcttgacgtgtctgtcatcccgaccagcggcgatgttgtcgtcgtgtcgaccgatgctctcatgactggctttaccggcgacttcgactctgtgatagcgactcggaccgatg

SEQ ID NO: 4659 - DNA, 203 bp, Homo sapiens
ggcgcgccagtcctactgcaacacgtgtgtcactcagacagtcgattttagccttgaccctacctttaccattgagacaaccacgctcccccaggatgctgtctccaggactcaacgccggggcaggactggcagggggaagccaggcatctatagatttgtggcaccgggggagcgcccctccggcacgactcggaccgatg

SEQ ID NO: 4660 - DNA, 203 bp, Homo sapiens
ggcgcgccagtcctgactgggcgctgttcagaatgaagtcaccctgacgcacccaatcaccaaatacatcatgacatgcatgtcggccgacctggaggtcgtcacgagcacctgggtgctcgttggcggcgtcctggctgctctggccgcgtattgcctgtcaacaggctgcgtggtcatagtgggcacgactcggaccgatg

SEQ ID NO: 4661 - DNA, 203 bp, Homo sapiens
ggcgcgccagtcctaccggctaatagccttcgcctcccgggggaaccatgtttcccccacacactacgtgccggagagcgatgcagccgcccgcgtcactgccatactcagcagcctcactgtaacccagctcctgaggcgactgcatcagtggataagctcggagtgtaccactccatgctccggttcgactcggaccgatg

SEQ ID NO: 4662 - DNA, 203 bp, Homo sapiens
ggcgcgccagtcctcctggctaagggacatctgggactggatatgcgaggtgctgagcgactttaagacctggctgaaagccaagctcatgccacaactgcctgggattccctttgtgtcctgccagcgcgggtataggggggtctggcgaggagacggcattatgcacactcgctgccactgtggagcgactcggaccgatg

SEQ ID NO: 4663 - DNA, 203 bp, Homo sapiens
ggcgcgccagtcctctgagatcactggacatgtcaaaaacgggacgatgaggatcgtcggtcctaggacctgcaagaacatgtggagtgggacgttcttcattaatgcctacaccacgggcccctgtactccccttcctgcgccgaactataagttcgcgctgtggagggtgtctgcagaggaatacgcgactcggaccgatg

SEQ ID NO: 4664 - DNA, 203 bp, Homo sapiens
ggcgcgccagtccttggagataaggcgggtgggggacttccactacgtatcgggcatgactactgacaatctcaaatgcccgtgccagatcccatcgcccgaatttttcacagaattggacggggtgcgcctacataggtttgcgcccccttgcaagcccttgctgcgggaggaggtatcattcagagcgactcggaccgatg

SEQ ID NO: 4665 - DNA, 203 bp, Homo sapiens
ggcgcgccagtccttaggactccacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggctagccagctgtcgactcggaccgatg

SEQ ID NO: 4666 - DNA, 203 bp, Homo sapiens
ggcgcgccagtcctccgctccatctctcaaggcaacttgcaccgccaaccatgactcccctgacgccgagctcatagaggctaacctcctgtggaggcaggagatgggcggcaacatcaccagggttgagtcagagaacaaagtggtgattctggactccttcgatccgcttgtggcagaggaggatgcgactcggaccgatg

SEQ ID NO: 4667 - DNA, 203 bp, Homo sapiens
ggcgcgccagtcctagcgggaggtctccgtacccgcagaaattctgcggaagtctcggagattcgccccagccctgcccgtctgggcgcggccggactacaaccccctgctagtagagacgtggaaaaagcctgactacgaaccacctgtggtccatggctgcccgctaccacctccacggtcccctccgactcggaccgatg

SEQ ID NO: 4668 - DNA, 203 bp, Homo sapiens
ggcgcgccagtcctaagtgaaggctaacttgctatccgtagaggaagcttgcagcctggcgcccccacattcagccaaatccaagtttggctatggggcaaaagacgtccgttgccatgccagaaaggccgtagcccacatcaactccgtgtggaaagaccttctggaagacagtgtaacaccaatagcgactcggaccgatg

SEQ ID NO: 4669 - DNA, 203 bp, Homo sapiens
ggcgcgccagtcctacactaccatcatggccaagaacgaggttttctgcgttcagcctgagaaggggggtcgtaagccagctcgtctcatcgtgttccccgacctgggcgtgcgcgtgtgcgagaagatggccctgtacgacgtggttagcaagctccccttggccgtgatgggaagctcctacggatcgactcggaccgatg

SEQ ID NO: 4670 - DNA, 203 bp, Homo sapiens
ggcgcgccagtcctcctccaacgtgtcagtcgcccacgacggcgctggaaagagggtctactaccttacccgtgaccctacaacccccctcgcgagagccgcgtgggagacagcaagacacactccagtcaattcctggctaggcaacataatcatgtttgcccccacactgtgggcgaggatgataccgactcggaccgatg

SEQ ID NO: 4671 - DNA, 203 bp, Homo sapiens
ggcgcgccagtccttgatgacccacttctttagcgtcctcatagccagggatcagcttgaacaggctctcaactgcgagatctacggagcctgctactccatagaaccactggatctacctccaatcattcaaagactccatggcctcagcgcattttcactccacagttactctccaggtgaaattacgactcggaccgatg

SEQ ID NO: 4672 - DNA, 203 bp, Homo sapiens
ggcgcgccagtccttccggctggttcacggctggctacagcgggggagacatttatcacagcgtgtctcatgcccggccccgctggttctggttttgcctactcctgcttgctgcaggggtaggcatctacctcctccccaaccgatgaagattgggctaaccactccaggccaataggccattccctcgactcggaccgatg

SEQ ID NO: 4673 - DNA, 203 bp, Homo sapiens
ggcgcgccagtccttagtgggagtgaagagggtagtaatgaacttgctagatggcagagggccaatacggtttgtgttggctctcttagctttcttcaggtttacagcacttgccccgaccaaggccttgatgaggcgctggaagagcgtgaacaagacaacggccatgaaacatctgaccagttttacgactcggaccgatg

SEQ ID NO: 4674 - DNA, 203 bp, Homo sapiens
ggcgcgccagtcctagaaagaattaggaacactgattgatgtggtgaacaaaaggggcaaaaaacaaaagaaaagaggtggcagtgaaacatccgtgcttatgctcattttcatgctgattggatttgccgctgccttaaagctttccaccttccagggcaagataatgatgactgtgaacgctacggcgactcggaccgatg

SEQ ID NO: 4675 - DNA, 203 bp, Homo sapiens
ggcgcgccagtcctacattgctgatgtgatcgccattccaaccccgaagggacccaatcaatgctggattcgagccattgacattggatttatgtgtgatgacaccatcacttatgaatgcccgaaattggaaagtggaaatgaccctgaagacattgactgctggtgtgacaaacaagctgtgtacgcgactcggaccgatg

SEQ ID NO: 4676 - DNA, 203 bp, Homo sapiens
ggcgcgccagtccttggagggcgacagttgcatcaccatcatggccgctgacaaacccacccttgacataagaatgatgaacattgaagccaccaatcttgcactggttagaaattactgctatgcagctactgtgtcagacgtttctacggtgtcaaactgtcccactacaggggagtcacacaacacgactcggaccgatg

SEQ ID NO: 4677 - DNA, 203 bp, Homo sapiens
ggcgcgccagtcctcgaagcgggcagatcacaattacttgtgcaaacgaggtgtgaccgacagaggctggggtaatggatgtggcttgtttggtaaggggagcattgacacatgcgcaaagttcacctgctctaactcagctgcggggagacttatcttacctgaggacatcaaatatgaagttggggcgactcggaccgatg

SEQ ID NO: 4678 - DNA, 203 bp, Homo sapiens
ggcgcgccagtcctaggcctactacgtcatgaccattggaacgaaacactttctagtgcatcgtgagtggttcaatgatttgctcttgccatggacatcacctgcaagcacggaatggaggaatagagaaattctcgtggagtttgaagagccacatgccaccaaacaatcagtggttgccttgggttcgactcggaccgatg

SEQ ID NO: 4679 - DNA, 203 bp, Homo sapiens
ggcgcgccagtccttaacatccaccaggggttggcttaaactcagagaggaaaatacctcggagtgtgacagcaccattattgggaccgcagttaagggcaaccatgcagtacacagtgacctttcctactggattgagagtggactcaatgggacatggaaacttgagagagccatttttggagaggcgactcggaccgatg

SEQ ID NO: 4680 - DNA, 203 bp, Homo sapiens
ggcgcgccagtcctcaggccttatgatatgcaaccctaacaagaagagaggatggcccgccacagaggtgttaacagcagtgggactgatgttcgccattgttggaggactcgctgagctagacattgattctatgtcagtcccttttaccatagctggcctcatgttagtgtcctatgttatctcggcgactcggaccgatg

SEQ ID NO: 4681 - DNA, 203 bp, Homo sapiens
ggcgcgccagtccttaagcgtagctgccatcactccaagggccattttgccatccgcgtttgggtattggctgactctgaagtacacaaaacgagggggtgttttttgggatacgccttccccaaaagtgtatcccaagggggatacgacgccaggagtctaccgaataatggccagaggtatcctggcgactcggaccgatg

SEQ ID NO: 4682 - DNA, 203 bp, Homo sapiens
ggcgcgccagtcctgagagggaagagtcattctcagtgtgccgtcagccatcactagtgccagtgctgcccaacggagaggtagagtgggcaggaatccaagtcaaataggagatgagtaccactatggaggcggaaccagtgaggatgacaccatgctggcgcactggactgaagcaaaaattctttcgactcggaccgatg

SEQ ID NO: 4683 - DNA, 203 bp, Homo sapiens
ggcgcgccagtccttggacaacatccacctcccaaatggcctagtagctcagctgtacggtcccgaaagagataaaacttacaccatggatggagagtaccgactcagaggcgaagaacgcaagacattcctcgagctcataaaaacagccgatttgccggtgtggcttgcttacaaggtagcgtcaacgactcggaccgatg

SEQ ID NO: 4684 - DNA, 203 bp, Homo sapiens
ggcgcgccagtcctggaagtcactaattgaggaaaacgaggtccatatccctccctttgattttttcaccctggatttgaagcctgctactgcttgggctttgtacggaggaagcacagttgtgttgactccactgataaaacatctggtgacatcacagtatgttaccacctcattggcatcaataacgactcggaccgatg

SEQ ID NO: 4685 - DNA, 203 bp, Homo sapiens
ggcgcgccagtcctgagcctcggggaacatcgtgcacgcggtgaacatgaccagtcaggtgctcattggaagaatggacaagaagatttggaaaggcccaaaatatgaggaagatgtcaacctgggcagcggcacgagagcagtaggaaaaggtgtgcagcacacggattacaagaggatcaaatccacgactcggaccgatg

SEQ ID NO: 4686 - DNA, 203 bp, Homo sapiens
ggcgcgccagtcctctcggaagaggagtccctgccaacaatggagatgaagcccgtgtcagatcgcgaaagcgccacttcgccgaggagtgcaatctgtgaggccccaggaggactgggtaaacaaagccgtaaggcccccgcagcccgggccgggaggaggtgatgcaaaccccggcgaaggactagcgactcggaccgatg

SEQ ID NO: 4687 - DNA, 203 bp, Homo sapiens
ggcgcgccagtcctaggttagaggagaccctgcggaagaaatgagtggcccaagctcgccgaagctgtaaggcgggtggacggactagaggttagaggagaccccactctcaaaagcatcaaacaacagcatattgacacctgggaaaagactaggagatcttctgctctattccaacatcagtcacacgactcggaccgatg

SEQ ID NO: 4688 - DNA, 203 bp, Homo sapiens
ggcgcgccagtcctgtaaggcgggtggacggactagaggttagaggagaccccactctcaaaagcatcaaacaacagcatattgacacctgggaaaagactaggagatcttctgctctattccaacatcagtcacaaggcaccgagcgccgaacactgtgactgatgggggagaagaccacaggatctcgactcggaccgatg

SEQ ID NO: 4689 - DNA, 203 bp, Homo sapiens
ggcgcgccagtcctgcgccagtcctccgatagactgagtcgcccgggtacccgtgtatccaataaatcctcttgctgttgcatccgactcgtggtctcgctgttccttgggagggtctcctcagagtgattgactacccgtctcgggggtctttcatttgggggctcgtccgggatctggagacccctcgactcggaccgatg

SEQ ID NO: 4690 - DNA, 203 bp, Homo sapiens
ggcgcgccagtcctacctgggaagctatagcagtagacccccctccctgggtcagacccttcgtgcaccctaaacctcccctctctcttcccccttcagccccctctctcccacctgaacccccactctcgaccccgccccagtcctccctctatccggctctcacttctcctttaaacaccaaacctcgactcggaccgatg

SEQ ID NO: 4691 - DNA, 203 bp, Homo sapiens
ggcgcgccagtcctaggcctcaagtccttcctgatagcggaggaccactcattgatctactcacggaggaccctccgccttaccgggacccagggccaccctctcctgacgggaacggcgatagcggagaagtggcccctacagaaggagcccctgacccttccccaatggtatcccgcctgcggggacgactcggaccgatg

SEQ ID NO: 4692 - DNA, 203 bp, Homo sapiens
ggcgcgccagtcctagaaaagaaccccccgtggcggattctactacctctcaggcgttcccccttcgcctgggagggaatggacagtatcaatactggccattttcctcctctgacctctataactggaaaaataacaacccctctttctccgaggacccagctaaattgacagctttgatcgagtcccgactcggaccgatg

SEQ ID NO: 4693 - DNA, 203 bp, Homo sapiens
ggcgcgccagtcctcccgactgggactacaacacccaacgaggtaggaaccacctagtccactatcgccagttgctcctagcgggtctccaaaacgcgggcagaagccccaccaatttggccaaggtaaaagggataacccagggacctaatgagtctccctcagcctttttagagagactcaaggagcgactcggaccgatg

SEQ ID NO: 4694 - DNA, 203 bp, Homo sapiens
ggcgcgccagtcctaaacgagaaaccccggaagaaagagaggaacgtattaggagagaaacagaggaaaaggaagaacgccgtagggcagaggatgtgcagagagagaaggagagggaccgcagaagacatagagaaatgagtaagttgctggctactgtcgttagcgggcagagacaggatagacagcgactcggaccgatg

SEQ ID NO: 4695 - DNA, 203 bp, Homo sapiens
ggcgcgccagtccttcaggacaattaacctggaccagactcccgcagggtttcaaaaacagtcccaccctgtttgatgaagccctgcacagggacctcgcagacttccggatccagcacccagacctgattctgctccagtatgtagatgacttactgctggccgccacttctgagcttgactgtcaacgactcggaccgatg

SEQ ID NO: 4696 - DNA, 203 bp, Homo sapiens
ggcgcgccagtcctacccctcgacaactaagggagttcctagggacggcaggcttctgtcgcctctggatccctgggtttgcagaaatggcagcccccttgtaccctctcaccaaaacggggactctgtttgagtggggcccagaccagcaaaaggcctaccaagagatcaagcaggctctcttaactcgactcggaccgatg

SEQ ID NO: 4697 - DNA, 203 bp, Homo sapiens
ggcgcgccagtcctgcggaggcaaggggcaacaggatggccgaccaagcggcccgagaagtagccactagagaaactccagagacttccacacttctgatagaaaattcagccccctatactcatgaacattttcactatacggtgactgacataaaagatctgactaaactaggggccacttatgaccgactcggaccgatg

SEQ ID NO: 4698 - DNA, 203 bp, Homo sapiens
ggcgcgccagtcctgacatcactgagacttgccaagcctgtgcacaggtcaatgccagcaagtctgccgtcaaacaagggactagagttcgagggcaccgacccggcacccactgggaaattgatttcactgaggtaaaacctggcctgtatgggtataaatatcttttagttttcatagacactttccgactcggaccgatg

SEQ ID NO: 4699 - DNA, 203 bp, Homo sapiens
ggcgcgccagtccttctggatgggtagaagctttcccaaccaagaaagaaactgccaaagttgtaaccaagaagctactagaagaaatcttccccagattcggcatgccacaggtattgggaaccgacaatgggcctgccttcgtctccaaggtaagtcagacagtagccgatttactgggggttgatcgactcggaccgatg

SEQ ID NO: 4700 - DNA, 203 bp, Homo sapiens
ggcgcgccagtcctccggtagtgcctcaccctttccgagtcggtgacacagtgtgggtccgcagacaccaaactaaaaatctagaaccccgctggaaaggaccttataccgtcctactgactacccccaccgctctcaaagtggacggcattgcagcgtggatccacgctgcccacgtaaaggctgcccgactcggaccgatg

SEQ ID NO: 4701 - DNA, 203 bp, Homo sapiens
ggcgcgccagtcctgacaccaggattgagccaccatcggaatcgacatggcgtgttcaacgctctcaaaatcccctaaagataagattgacccgcgggacctcctaatccccttaattctcttcctgtctctcaaaggggccagatccgcagcacccggctccagccctcaccaggtctacaacattacgactcggaccgatg

SEQ ID NO: 4702 - DNA, 203 bp, Homo sapiens
ggcgcgccagtcctcctgggaagtgaccaatggggatcgggagacagtatgggcaatatcaggcaaccaccctctgtggacttggtggccagtcctcaccccagatttgtgtatgttagctctcagtgggccgccccactgggggctagagtatcaggccccctattcctcgcccccggggcccccttcgactcggaccgatg

SEQ ID NO: 4703 - DNA, 203 bp, Homo sapiens
ggcgcgccagtccttaggaacagtcccaaaaactcaccaggccctgtgcaacactacccttaaggcaggcaaagggtcttactatctagttgcccccacaggaactatgtgggcatgtaacactggactcactccatgcctatctgccaccgtgcttaatcgcaccactgactattgcgttctcgtggcgactcggaccgatg

SEQ ID NO: 4704 - DNA, 203 bp, Homo sapiens
ggcgcgccagtcctcccagcagtttcagcagctccatgctgccgtacaagatgatctcaaagaagtcgaaaagtcaattactaacctagaaaagtctcttacttcgttgtctgaggttgtactgcagaatcgacgaggcctagacctgttgttcctaaaagagggaggactgtgtgctgccctaaaagcgactcggaccgatg

SEQ ID NO: 4705 - DNA, 203 bp, Homo sapiens
ggcgcgccagtcctcattcaggaagtgcttccttctgctcggggtgatacatgagtatacagtagtttgaatcctgtgtgctggtgttgtcttctcggctttttgtgacatcataaataacacctagaagtaatatttttaagaggcttacacctcaggaaggagtgtggctaatgctggtaaggcaccgactcggaccgatg

SEQ ID NO: 4706 - DNA, 203 bp, Homo sapiens
ggcgcgccagtcctgactatctctaactcccggagattgtattacatgggactcagcagtcgctactctgttcattagaacatatggacaatatccattacatcagcttggaaatgtgttaaaaggaatagctgatcaagaaggagtagcaacagcatatactctagggatgatgctttctggacaaacgactcggaccgatg

SEQ ID NO: 4707 - DNA, 203 bp, Homo sapiens
ggcgcgccagtcctccccaaaatagcacaatgaatacacctgtttatcctgttcctaaaccagatggaaggtggagaatggttttagattatagagaagtaaataaaactatacctttaacagcggcccaaaaccaacattctgctggtatattggccactattgtaagacaaaaatataaaactactcgactcggaccgatg

SEQ ID NO: 4708 - DNA, 203 bp, Homo sapiens
ggcgcgccagtcctggtcgtggcctaacggatacttttaaaacaaaattattaaatgttacaccacccaaagatttaaaacaattacagagcatactgggattgttaaattttgctagaaattttatacctaattttgcagaattggtacaaacgttgtataatttaatagcttcatctaagggaaaacgactcggaccgatg

SEQ ID NO: 4709 - DNA, 203 bp, Homo sapiens
ggcgcgccagtcctaaaggatatcctaaacaatatacatattatttagaagatggcaaagtaaaagtttccagacctgaaggggttaaaataatacccccacagtcggatcgacaaaaaattgtacttcaagcccacaatttggctcataccggacgtgaagccactcttttaaaaattgccaatcttcgactcggaccgatg

SEQ ID NO: 4710 - DNA, 203 bp, Homo sapiens
ggcgcgccagtcctggatatctatatgttttagtaattgttgatggaatgacaggttttacatggttatacccaactaaggctccttctacaagcgcaactgttaaatctctcaatgtactcactagtattgcaattccaaaggtgattcactctgatcaaggtgcagcattcacttcttcaacctttcgactcggaccgatg

SEQ ID NO: 4711 - DNA, 203 bp, Homo sapiens
ggcgcgccagtcctaataatacttatagccctgtattaaaatatactccacatcaactcttatttggtatagattcaaatactccatttgcaaaccaagatacacttgatttgacgagagaagaagaactttctcttttacaggaaattcgtgcctctttataccaaccatccacccctcctgcctcccgactcggaccgatg

SEQ ID NO: 4712 - DNA, 203 bp, Homo sapiens
ggcgcgccagtccttcacgttcctggtctcctgttgtaggccaattggtccaggagagggtggctaggcctgcatccttgcgaccacgttggcataaaccttccactgttcttgaagtattgaatcctaggactgttgttattttggaccatcttggcaacaacagaactgtaagtattgacaatttacgactcggaccgatg

SEQ ID NO: 4713 - DNA, 203 bp, Homo sapiens
ggcgcgccagtcctcactcagagggctgtttatcaacccttgcaaaccagaaggattgcacgttctcttagaatgcaacacccagttccaaaatatatagaggtaaacatgaccagtatcccacaaggtgtatattatgaacctcatccagaacctatagtggtcacggagagggtcttaggtctttccgactcggaccgatg

SEQ ID NO: 4714 - DNA, 203 bp, Homo sapiens
ggcgcgccagtcctaaaatgctaccaagaattcgcgcattgctatctggtaaaatataaaactccaaagtcctggccaactgaaggtctcattgcagatcaatgtcccttgccaggatatcatgcaggacttagttataagccacaatcaatatgggattattatataaaagtagaaattacaaggcccgactcggaccgatg

SEQ ID NO: 4715 - DNA, 203 bp, Homo sapiens
ggcgcgccagtccttaaattagataaccttacaactgggtcatctctattaaaaaagagagccctgcctaaggaatggagctcacaaggtaaaaatgccttgtttaaggaaattaatgtattggatgtttgcagtaaacctgaattagtaatattgttaaatacttcatattattcattctctttatgcgactcggaccgatg

SEQ ID NO: 4716 - DNA, 203 bp, Homo sapiens
ggcgcgccagtccttactgttttattctccctaaaaaattttcttaatcacacaggtaggcctgtaaatgaaatgcctaatgctagagcctttgtgggcctagtagatcctaagtttcccccttcctatcccaatgtaacccgagaacattatacttcttgtaacaataggaaaagaagaagtactgacgactcggaccgatg

SEQ ID NO: 4717 - DNA, 203 bp, Homo sapiens
ggcgcgccagtcctaaaacaaacctacaattcacccactgctacggcttgggaaattgggttatattatgaattgactatacctaaacatgtttacttaaacaattggaatgttgtcaatataggtcatttggttcaatcagctggacaattgactcatgtaactatagctcatccatatgaaataatcgactcggaccgatg

SEQ ID NO: 4718 - DNA, 203 bp, Homo sapiens
ggcgcgccagtcctaagattaccacatttggttggaattattgcaaaaatcaaggggctaaaaatagaagtcacatcctctggagagagtataaaagaccaaattgaaagagcaaaggctgagcttcttcgactggatatccacgaaggagacactccagcctggatacagcaactagctgcagcaaccgactcggaccgatg

SEQ ID NO: 4719 - DNA, 203 bp, Homo sapiens
ggcgcgccagtcctgattcctaccaagaagaagagccagtagcctctacctctggacttcaggacctgcagactcttagtgagcttgttggccctgaaaatgccggagagggagatctggtcattgcagaagaacctgaagaaaacccccgacgccccagaagatacaccaagagagatgttaaatgtcgactcggaccgatg

SEQ ID NO: 4720 - DNA, 203 bp, Homo sapiens
ggcgcgccagtcctgtttcttaccatgcttataaagagcttgaggacaaacatcctcaccacattaagctccaagactggattcctaaacctgaagaaatgagtaagtcaatttgtaaaagacttattttatgtggattatatagtggagaaaaggctagagaaatcttaaaaaagccttttacagtacgactcggaccgatg

SEQ ID NO: 4721 - DNA, 203 bp, Homo sapiens
ggcgcgccagtcctaaacatcaaaagaactgttctcttgttaaaccttctactagttgcccagaaggtccaaaaccaagacgtaggcacgatcctgtccttcgatgtgacatgtttgaaaagcatcacaagcctcggccgaaacgatccaggaaacgatccatcgatcatgagtcatgtgcttccagtcgactcggaccgatg

SEQ ID NO: 4722 - DNA, 203 bp, Homo sapiens
ggcgcgccagtcctggtgacaccgtggccaatgagtcaggaccactatgcaccaacactttttggactcctggaccggtattacaagggctacttggagaatccagcaaccttccagacctggaagttcacatgtcaggaggacccttctggaaagaggtatatggggactcaattctgggtcccccccgactcggaccgatg

SEQ ID NO: 4723 - DNA, 203 bp, Homo sapiens
ggcgcgccagtccttctgggtcaggtgaacattcagttttataaaaattaccagattgtaacttgctgccaggccctagatccttttgctaatattttccatggcaccgaggaagaaatgtatgatattgattctgggcctgatgtttggtgcaccccctctttgtgtttcaaagtaatctatgagggcgactcggaccgatg

SEQ ID NO: 4724 - DNA, 203 bp, Homo sapiens
ggcgcgccagtcctgggctgtaaggcaggctgtttggcttcgccagtgcttaatttcaaagctctgcagttccatagaactttaatggcagaccttaccaaccctaaaattggacaaggctaccttgcccatggttatcacgctgctatggaagcttatggacctcagagaggaagtagcgaggagagcgactcggaccgatg

SEQ ID NO: 4725 - DNA, 203 bp, Homo sapiens
ggcgcgccagtcctttcaaaaccacagacagtaaaagtgtggtaacactttaagcaatattatctttgtcagaatattagaagctttcacatgctcagcagctgtttcgcaactaccaaaataagaatgatgtaataataggaagtagcttacaataggttaagtatgtttactgaagtagataatcccgactcggaccgatg

SEQ ID NO: 4726 - DNA, 203 bp, Homo sapiens
ggcgcgccagtcctacctttctatcagtacaatcaagcccattcctccccatgttctcagggtgtgtgcggcgtaagatcgaatccccacacacctgggaacttgattattgcataatattttgttagtcatatagaaaagtaatataggataagttatagggattaaactatgaggtgtgtggctcacgactcggaccgatg

SEQ ID NO: 4727 - DNA, 203 bp, Homo sapiens
ggcgcgccagtcctctagtgaacccctgaatggcgatcttaagcgcctctgtagggaagccaggaatgtccaggaggtaccccttccgctcggaagggatctgacctggagacacatcacatgtgctttacacctgtgcttgtgtttaaaaattgtcgcagcttccccaaaccaagtggtcttggtttcgactcggaccgatg

SEQ ID NO: 4728 - DNA, 203 bp, Homo sapiens
ggcgcgccagtcctactttaatcagtaccgtggttcactgaattttcttttcgttttcactggtgctgcaatggttaagggcaagtttctcatagcctacaccccgcctggtgcgggaaagcccaccacccgggaccaagctatgcaggctacctacgccatttgggacttgggcttgaattccagctcgactcggaccgatg

SEQ ID NO: 4729 - DNA, 203 bp, Homo sapiens
ggcgcgccagtcctccaatggtgccaacttcccactcatgaccaaacaggactacgccttcctctgcttttcccctttcacctactacaagtgtgaccttgaagttaccgttagtgctatgggagcaggcaccgtttcttctgttctgcgctgggcacccaccggggcgcccgcggatgtcactgacccgactcggaccgatg

SEQ ID NO: 4730 - DNA, 203 bp, Homo sapiens
ggcgcgccagtcctagctgatcggctatactcctagtcttggtgaaacacgtaacccccacatgtggatcgttggctctggaaattctcaaatttcttttgtcgtaccttacaattcccctctgtccgtcttacccgctgcttggttcaatggatggtccgactttggaaacaccaaggattttggagcgactcggaccgatg

SEQ ID NO: 4731 - DNA, 203 bp, Homo sapiens
ggcgcgccagtcctttgagaatcccgcttctctctaccgcattgatcttttcatcacctttactgatgagctcataacttttgactacaaggtccacggacgtcctgtgctcaccttccggattccaggcttcggtctgacaccggcaggcagaatgctcgtgtgcatgggcgagaagcccgcacacacgactcggaccgatg

SEQ ID NO: 4732 - DNA, 203 bp, Homo sapiens
ggcgcgccagtcctgtccgttcacctcgtctaaatctctataccatgttatcttcacttccacttgcaattccttcagctttaccatctataaaggacgctaccgctcctggaagaagcccatccacgatgagcttgtggatcgtggttacaccactttccgcgagttcttcaaggctgtgcgcggatcgactcggaccgatg

SEQ ID NO: 4733 - DNA, 203 bp, Homo sapiens
ggcgcgccagtcctttagtaaagcaatcacagttgtcactgacttggttgctgcatgggaaaaagcaaaaaccactctggtctctcctgaattttggtcagaacttatattaaaaactaccaagttcattgctgcttccgtgctctaccttcacaaccctgacttcactaccactgtttgtctctcatcgactcggaccgatg

SEQ ID NO: 4734 - DNA, 203 bp, Homo sapiens
ggcgcgccagtccttgatgactggtgtagacctcctcaccaatgattctgtttttgattggcttaagagcaaattgtcctccttctttcgtactcctcccccagcttgccccaatgtcatgcaacctcaggggcctctacgcgaggccaatgagggttttacctttgccaagaatattgaatgggccacgactcggaccgatg

SEQ ID NO: 4735 - DNA, 203 bp, Homo sapiens
ggcgcgccagtcctaatctgtttctaagatggcctttggccgtcagtctgtttattctatgccccccgattcggaatattttgatggctatgaaaatcaattttctgtgattatggatgatctaggacaaaatcccgatggtgaagatttcaccgtcttttgtcaaatggtttctagcacaaattttccgactcggaccgatg

SEQ ID NO: 4736 - DNA, 203 bp, Homo sapiens
ggcgcgccagtcctccacaggatctgtcgtacatgtccccagaaagaccaaactgaggagaacagtcgctcatgacgttttccaacccaaattcgaacctgcagttctgtcccgttatgaccctgggaccgacaaggatgtagatgttgtagccttctccaaacacactactaacatggaaagcttgccgactcggaccgatg

SEQ ID NO: 4737 - DNA, 203 bp, Homo sapiens
ggcgcgccagtcctctccaatctttgacattgtctgcggtgaatacgctaaccgtgttttcaccatccttggtaaagacaacggtctcttaaccgttgaacaggctgtgcttggcttgtcgggcatggaccccatggagaaggacacctcccctggattgccctacactcaacaaggactcagacgaacgactcggaccgatg

SEQ ID NO: 4738 - DNA, 203 bp, Homo sapiens
ggcgcgccagtcctaatgtagtcttatgcaatactcttgtagtcttgcaacatgcttatgtaacgatgagttagcaacatgccttataaggaaagaaaaagcaccgtgcatgccgattggtggaagtaaggtggtatgatcgtggtatgatcgtggtatgatcgtgccttattaggaaggcaacagaccgactcggaccgatg

SEQ ID NO: 4739 - DNA, 203 bp, Homo sapiens
ggcgcgccagtcctgggtctaacacggattggacgaaccactgaattccgcattgcagagatattgtatttaagtgcctagctcgatacaataaacgccatttgaccattcaccacattggtgtgcacctgggttgatggcgggaccgttgattccctgacgactacgagcacatgcatgaagcagaacgactcggaccgatg

SEQ ID NO: 4740 - DNA, 203 bp, Homo sapiens
ggcgcgccagtcctggcttcatttggtgaccccgacgtgatcgttagggaatagtggtcggccacaggcggcgtggcgatcctgtcctcatccgtctcgcttattcggggagcggacgatgaccctagtagagggggctgcggcttaggagggcagaagctgagtgacgtcggagggagctccacggccgactcggaccgatg

SEQ ID NO: 4741 - DNA, 203 bp, Homo sapiens
ggcgcgccagtcctccgcccctctcgcccagctgccgctccaacctggccgccgcctcctgcttcccttccaccgccgaccagctggagatggtgacggagctgctcgggggggacatggtcaaccagagctccatctgcgacccggacgacgaatccttcgtcaaatccatcatcatccgggactgccgactcggaccgatg

SEQ ID NO: 4742 - DNA, 203 bp, Homo sapiens
ggcgcgccagtcctaggcaacagacgggtctaacacggattggacgaaccactgaattccgcattgcagagatattgtatttaagtgcctagctcgatacaataaacgccatttgaccattcaccacattggtgtgcacctgggttgatggcgggaccgttgattccctgacgactacgagcacatgccgactcggaccgatg

SEQ ID NO: 4743 - DNA, 203 bp, Homo sapiens
ggcgcgccagtccttcgcttaatcggggagcggacgatgaccctagcagagggggctgcggcttaggagggcagaagctgagtgacgtcggagggagctccacggccgggggccaagataacctaccgagaactcagagagtcgttggaagacgggaaggaagcccaacgactgagcagtccaccccacgactcggaccgatg

SEQ ID NO: 4744 - DNA, 203 bp, Homo sapiens
ggcgcgccagtccttcccccaggtccggagtgcatcgagaaaccagcaacggagcggcgaatcgacaagggagaaacaactgtgcagcgagatacgaagatggcgccggaggaaacggccacacctaaaaccgttggcacatcctgctatcattgcggaacagctattggctgtaattgcgccacagccgactcggaccgatg

SEQ ID NO: 4745 - DNA, 203 bp, Homo sapiens
ggcgcgccagtcctctccccgctgctgccgcatgacgtcacgaatccaatgagagttattttaggacccgccccacatgccttatggatggacgcttgggctgcgtcaggtcagttgcaccggccccaaccccaggaacacaccagcaccagcgctgcagcggggacctggcggctcactcaggcttccgactcggaccgatg

SEQ ID NO: 4746 - DNA, 203 bp, Homo sapiens
ggcgcgccagtcctggagtcgcggcacaggctgccccactgctctgcagccccatcccaccaggatcacagtgccatgggctttgggccggagctgtggtgcccgaaggggcacactgagctgctgcggctgcaggacagcgagttgcgcctcctggagctgatgaagaagtggatgtcacagcgtgccgactcggaccgatg

SEQ ID NO: 4747 - DNA, 203 bp, Homo sapiens
ggcgcgccagtccttaagagcgaccgggagtacgcggggatgctgcaccacatgttctctcagctggagaaacaggagggcctgggacatctccgtgccaccgaccacagcagccagatcggggagtcgtggtgggttctggcaagccagactgagacactgagccagacgctgcggcggcacgcggacgactcggaccgatg

SEQ ID NO: 4748 - DNA, 203 bp, Homo sapiens
ggcgcgccagtcctgagcagcaaggagcagcgggtgtgggagctgcaggttgagctgcggggcgaggagctggcactcagccctggggagcgggtgcacttgctgggcaagcggcaggggctgcgggaggcccagcagcagctgcagggcttggtctgtgctcaggccaagctgcaggcacagcgggacgactcggaccgatg

SEQ ID NO: 4749 - DNA, 203 bp, Homo sapiens
ggcgcgccagtcctacctcccgtgcccctcatcccggaggtgcagaagccgctgtgccagcaggcctggtaccacggggccatcccgcgctcggaggtgcaggagctgctgaaatacagcggagacttcctggtgcgggagagccaggggaagcaggagtatgtgctcagcgtgctgtgggatgggcacgactcggaccgatg

SEQ ID NO: 4750 - DNA, 203 bp, Homo sapiens
ggcgcgccagtccttcccaacatcgtccggctcatcggcgtctgcacccagaagcagcccatttacatcgtcatggagctggtgcagggaggggacttcctgagcttcctgcgcagcaaggggccccgcctgaagatgaagaagctgatcaagatgatggagaatgccgcggcgggcatggagtacctcgactcggaccgatg

SEQ ID NO: 4751 - DNA, 203 bp, Homo sapiens
ggcgcgccagtcctggaaagcaagcactgcatccacagggacctggctgcccgcaactgcctggtgacagaaaagaacaccctgaaaatcagcgactttgggatgtcgcggcaggaggaggatggtgtctatgcctccacggggggcatgaagcagatccccgtgaaatggactgcccccgaggctctcgactcggaccgatg

SEQ ID NO: 4752 - DNA, 203 bp, Homo sapiens
ggcgcgccagtcctgaattacggctggtacagctcggagagcgacgtgtggagctttgggatcctgctgtgggaagccttcagcctgggcgccgtgccctacgccaacctcagcaaccagcagacgcgcgaggccatcgagcagggcgtgcggctggagcccccggagcagtgccccgaggacgtgtacgactcggaccgatg

SEQ ID NO: 4753 - DNA, 203 bp, Homo sapiens
ggcgcgccagtcctgaagcggaaggcttcattgatgttgccagttagtcatcattgccacttagtcatcattacataagacagtctaaagtcctaaaaaggaaaaacaagacatctcggatgtcattggctgcaaccagtaaggaagtagtggcgtgaggatcacccgatgggtgtaacccagaaggccgactcggaccgatg

SEQ ID NO: 4754 - DNA, 203 bp, Homo sapiens
ggcgcgccagtcctggcaagggtcagggaggagcttgcgagtactggtccgcccgtggtggccatgcctgtagtgattaagacagagggacccgcttggacccctctggagccaaaattgatcacaagactggctgatacggtcaggaccaagggcttacgatccccgattactatggcagaagtggacgactcggaccgatg

SEQ ID NO: 4755 - DNA, 203 bp, Homo sapiens
ggcgcgccagtcctaggagagataattaaatatgtgctagacaggcagaagactgcccctcttacggatcaaggcatagccgcggccatgtcgtctgctatccagcccttaattatggcagtagtcaatagagagagggatggacaaactgggtcgggtggtcgtgcccgagggctctgctacacttgcgactcggaccgatg

SEQ ID NO: 4756 - DNA, 203 bp, Homo sapiens
ggcgcgccagtccttggatccccgggacattatcaggcgcagtgcccgaaaaaacggaagtcaggaaacagccgtgagcgatgtcagttgtgtaacgggatgggacacaacgctaaacagtgtaggaagcgggatggcaaccagggccaacgcccaggaaaaggtctctcttcggggccgtggcccggcgactcggaccgatg

SEQ ID NO: 4757 - DNA, 203 bp, Homo sapiens
ggcgcgccagtcctccctgagccacctgccgtctcgttagcgatgacaatggaacataaagatcgccccttggttagggtcattctgactaacactgggagtcatccggtcaaacagcgttcggtgtatatcaccgcgctgttggactctggagcggacatcactattatttcagaggaggattggcccgactcggaccgatg

SEQ ID NO: 4758 - DNA, 203 bp, Homo sapiens
ggcgcgccagtcctttagtggaaaaagaattacagttaggacatatagaaccttcacttagttgttggaacacacctgtcttcgtgatccggaaggcttccgggtcttaccgcttactgcatgatttgcgcgctgttaacgccaagcttgttccttttggggccgtccaacagggggcgccagttctccgactcggaccgatg

SEQ ID NO: 4759 - DNA, 203 bp, Homo sapiens
ggcgcgccagtcctactatttcgcctgataaggtccagagggagcccggagtacaatatcttgggtacaagttaggcagtacgtatgtagcacccgtaggcctggtagcagaacccaggatagccaccttgtgggatgttcaaaagctggtggggtcacttcagtggcttcgcccagcgttaggaatccgactcggaccgatg

SEQ ID NO: 4760 - DNA, 203 bp, Homo sapiens
ggcgcgccagtcctccgccacgactgatgggccccttctatgagcagttacgagggtcagatcctaacgaggcgagggaatggaatctagacatgaaaatggcctggagagagatcgtacggcttagcaccactgctgccttggaacgatgggaccctgccctgcctctggaaggagcggtcgctagacgactcggaccgatg

SEQ ID NO: 4761 - DNA, 203 bp, Homo sapiens
ggcgcgccagtccttgtgaacagggggcaataggggttttgggacagggactgtccacacacccaaggccatgcttgtggttattctccacccaacccaccaaggcgtttactgcttggttagaagtgctcacccttttgattactaagctacgtgcttcggcagtgcgaacctttggcaaggaggtccgactcggaccgatg

SEQ ID NO: 4762 - DNA, 203 bp, Homo sapiens
ggcgcgccagtcctgatatcctcctgttgcctgcatgctttcgggaggaccttccgctcccagaggggatcctgttagcccttaaggggtttgcaggaaaaatcaggagtagtgacacgccatctatttttgacattgcgcgtccactgcatgtttctctgaaagtgagggttaccgaccaccctgtgcgactcggaccgatg

SEQ ID NO: 4763 - DNA, 203 bp, Homo sapiens
ggcgcgccagtcctacagaaggacccccggttaaaatacgaatagagacaggggagtgggaaaaaggatggaacgtgctggtctggggacgaggttatgccgctgtgaaaaacagggacactgataaggttatttgggtaccctctcgaaaagttaaaccggacatcacccaaaaggatgaggtgactcgactcggaccgatg

SEQ ID NO: 4764 - DNA, 203 bp, Homo sapiens
ggcgcgccagtcctgtgtgaggttacgggggtaagagctgatgttcacttactcgagcagccagggaacctttggattacatgggccaaccgtacaggccaaacggatttctgcctctctacacagtcagccacctccccttttcaaacatgtttgataggtatcccgtctcctatttccgaaggtgacgactcggaccgatg

SEQ ID NO: 4765 - DNA, 203 bp, Homo sapiens
ggcgcgccagtcctttttaagggatatgtttctgatacaaattgctccactgtgggaactgaccggttagtcttgtcagccagcattaccggcggccctgacaacagcaccaccctcacttatcgaaaggtttcatgcctgctgttaaagctgaacgtctccatgtgggatgagccacctgaactgcacgactcggaccgatg

SEQ ID NO: 4766 - DNA, 203 bp, Homo sapiens
ggcgcgccagtcctgctgctaggttcccagtctctccctaacgttactaacattactcaggtctctggcgtggccgggggatgtgtatatttcgccccaagggccactggcctgtttttaggttggtctaaacaaggtctctcgcggttcctcctccgtcacccctttacctccacctctaactccaccgactcggaccgatg

SEQ ID NO: 4767 - DNA, 203 bp, Homo sapiens
ggcgcgccagtcctggaaccgttcacggtggtgacagcggatagacacaatctttttatggggagtgagtactgtggtgcatatggctacagattttgggaaatatataactgctcacagactaggaatacttaccgctgtggagacgtgggaggtactggcctccctgaaacctggtgcagaggaaacgactcggaccgatg

SEQ ID NO: 4768 - DNA, 203 bp, Homo sapiens
ggcgcgccagtcctcctcggggacttattggatgatgtcacgagtattcgacacgcggtcctgcagaaccgagcggctattgacttcttgcttctagctcacggccatggctgtgaggacgttgccggaatgtgttgtttcaatctgagtgatcacagtgaatctatacagaagaagttccagctaatcgactcggaccgatg

SEQ ID NO: 4769 - DNA, 203 bp, Homo sapiens
ggcgcgccagtcctgaagaaacatgtcaataagatcggcgtggacagcgacccaatcggaagttggctgcgagggatattcgggggaataggggaatgggccgttcatctgctaaaaggactgcttttggggcttgtagttattttattgctactggtgtgcctgccttgccttttacaatttgtgtccgactcggaccgatg

SEQ ID NO: 4770 - DNA, 203 bp, Homo sapiens
ggcgcgccagtccttgtaacgcgcttaggaagtcccctcgaggtatggcagatatgctcttgcatagggggaaaaaatgtagtcttaatattgtctgtgtgctgcaggagctaagctgactctgctggtggcctcgcgtaccactgtggccaggcggtagctgggacgtgcagccgaccaccatggggcgactcggaccgatg

SEQ ID NO: 4771 - DNA, 203 bp, Homo sapiens
ggcgcgccagtcctttctggggcttcaacacttctgacaccgtcacgtcgccgcagcgtgccggggcactggctggcggcgtcaccactttcgtggctctctacgactacgagtcctggactgaaacggacttgtccttcaagaaaggagaacgcctgcagattgtcaacaacacggaaggtgactggcgactcggaccgatg

SEQ ID NO: 4772 - DNA, 203 bp, Homo sapiens
ggcgcgccagtccttggctggctcattccctcactacaggacagacgggctacatccccagtaactatgtcgcgccctcagactccatccaggctgaagagtggtactttgggaagatcactcgtcgggagtccgagcggctgctgcttaaccccgaaaacccccggggaaccttcttggtccggaagcgactcggaccgatg

SEQ ID NO: 4773 - DNA, 203 bp, Homo sapiens
ggcgcgccagtcctaagggagagatgggcaagtacctgcggctgccacagctcgtcgatatggctgctcagattgcatccggcatggcctatgtggagagaatgaactacgtgcaccgagacctgcgggcggccaacatcctggtgggggagaacctggtgtgcaaggtggctgacttcgggctggcacgactcggaccgatg

SEQ ID NO: 4774 - DNA, 203 bp, Homo sapiens
ggcgcgccagtcctcgcctcatcgaggacaacgagtacacagcacggcaaggtgccaagttccccatcaagtggacagcccccgaggcagccctctatggccggttcaccatcaagtcggatgtctggtccttcggcatcctgctgactgagctgaccaccaagggccgggtgccatacccagggatgcgactcggaccgatg

SEQ ID NO: 4775 - DNA, 203 bp, Homo sapiens
ggcgcgccagtcctgtcaacagggaggtgctggaccaggtggagaggggctaccgcatgccctgcccgcccgagtgccccgagtcgctgcatgacctcatgtgccagtgctggcggaaggaccctgaggagcggcccacctttaagtacctgcaggcccagctgctccctgcttgtgtgttggaggtccgactcggaccgatg

SEQ ID NO: 4776 - DNA, 203 bp, Homo sapiens
ggcgcgccagtccttaggaatcccctcaggacaattctgcttggaatatgatggcgtcttccctgttttgcccttagactattcgagttgcctctgtggattagggctggaggcagcacggatagtctgatggccaaataaggcaggcaagacagctatttgtaactgcgaaatacgcttttgcatagcgactcggaccgatg

SEQ ID NO: 4777 - DNA, 203 bp, Homo sapiens
ggcgcgccagtcctgggatcccatcactgcggcgctctcccagcgggcaatggtacttgggaaatcgggagagttaaaaacctggggattggttttgggggcattgaaggcggctcgagaggaacaggttacatctgagcaagcaaagttttggttgggattagggggagggagggtctctcccccagcgactcggaccgatg

SEQ ID NO: 4778 - DNA, 203 bp, Homo sapiens
ggcgcgccagtcctgtccggagtgcatcgagaaaccagcaacggagcggcgaatcgacaaaggggaggaagtgggagaaacaactgcgcagcgagatgcgaagatggcgccggagaaaatggccacacctaaaaccgttggcacatcctgctatcagtgcggaacagctactggctgtaattgcgccacgactcggaccgatg

SEQ ID NO: 4779 - DNA, 203 bp, Homo sapiens
ggcgcgccagtcctcatctgagtcctttgttgattttgccaatcggcttataaaggcggttgaggggtcagatctcccgccttccgcgcgggctccggtgatcattgactgctttaggcagaagtcacagccagatattcagcagcttatacgggcagcaccctccacgctgaccaccccaggagagacgactcggaccgatg

SEQ ID NO: 4780 - DNA, 203 bp, Homo sapiens
ggcgcgccagtccttaatcaaatatgtgctagacaggcagaagattgcccctcttacggatcaaggcatagccgcggccatgtcgtctgctatccagcccttagttatggcagtagtcaatagagagagggatggacaaactgggtcgggtggtcgtgcccgagggctctgctacacttgtggatccccgactcggaccgatg

SEQ ID NO: 4781 - DNA, 203 bp, Homo sapiens
ggcgcgccagtcctaaaagaattacagttaggacatatagaaccttcacttagttgttggaacacacctgtctttgtgatccggaaggcttccgggtcttatcgcttattgcatgacttgcgcgctgttaacgccaagcttgttccttttggggccgtccaacagggggcgccagttctctccgcgctcgactcggaccgatg

SEQ ID NO: 4782 - DNA, 203 bp, Homo sapiens
ggcgcgccagtcctgcctgataagatccagagggaacccggagtacaatatcttgggtacaagttaggcagtacgtatgtagcacccgtaggcctggtagcagaacccaggatagccaccttgtgggatgttcaaaagctggtggggtcacttcagtggcttcgcccagcgttaggaatcccgccacgcgactcggaccgatg

SEQ ID NO: 4783 - DNA, 203 bp, Homo sapiens
ggcgcgccagtcctgggggcaataggggtcctgggacagggactgtccacacacccaaggccatgtttgtggttattctccacccaacccaccaaggcgtttactgcttggttagaagtgctcacccttttgattactaagctacgcgcttcggcagtgcgaacctttggcaaggaggttgatatcctcgactcggaccgatg

SEQ ID NO: 4784 - DNA, 203 bp, Homo sapiens
ggcgcgccagtcctcgtggcagatagccaagccacctttcaagcgtatcccttgagagaggctaaagatcttcatactgctctccatattggaccccgcgcgctatccaaagcgtgtaatatatctatgcagcaggctagggaggttgttcagacctgcccgcattgtaattcagcccctgcgttggacgactcggaccgatg

SEQ ID NO: 4785 - DNA, 203 bp, Homo sapiens
ggcgcgccagtcctttacgggggtaagagctgatgtccacttactcgagcagccagggaacctttggattacatgggccaaccgtacaggccaaacggatttttgcctctctacacagtcagccacctccccttttcaaacatgtttgataggtatcccgtcccctatttccgaaggtgattttaaggcgactcggaccgatg

SEQ ID NO: 4786 - DNA, 203 bp, Homo sapiens
ggcgcgccagtcctcccagtctctccctaacattactaatattgctcagatttccggtataaccgggggatgcgtaggtttcagaccacaaggggttccttggtatctaggttggtctagacaggaggccacgcggtttctccttagacacccctctttctctaaatccacggaaccgtttacggtggcgactcggaccgatg

SEQ ID NO: 4787 - DNA, 203 bp, Homo sapiens
ggcgcgccagtccttggatgatgtcacgagtattcgacacgcggtcctgcagaaccgagcggctattgacttcttgcttctggctcacggccatggctgtgaggacgttgccggaatgtgttgtttcaatctgagtgatcacagtgagtctatacagaagaagttccagctaatgaaggaacatgtcacgactcggaccgatg

SEQ ID NO: 4788 - DNA, 203 bp, Homo sapiens
ggcgcgccagtcctttcagctcgtgtagctcattagctccgagctccccaacctacagcctgagaggcactggctcggttgggtagccagcctttcgggtaataaaggcttgttggcattcggcatctacccgtgcctcctgtcttgtcttactcgagcgaacccacaactccgtcctgctgagctcacgactcggaccgatg

SEQ ID NO: 4789 - DNA, 203 bp, Homo sapiens
ggcgcgccagtcctaatatattaggggtcattacagcaaacctagtacaggaagaaattaaactcctcttgaatagtacacccaagtggagattagatgtacaacttatagaatcaaaagtaagagagaaagaaaatgcccacagaacgtggaaacagcatcatccagaagccccaaaaacagatgaacgactcggaccgatg

SEQ ID NO: 4790 - DNA, 203 bp, Homo sapiens
ggcgcgccagtcctataaatagattagtggcagcccttgaaggtatggcggctccagaaaccacaaaagaatacttactccaacatctatctattgatcatgccaatgaagactgccagtctattctaagacctttgggacccaacaccccaatggagaaaaaattagaagcatgtagggtagtgggacgactcggaccgatg

SEQ ID NO: 4791 - DNA, 203 bp, Homo sapiens
ggcgcgccagtcctggaagacccacgtagagtggagatttaaggataagactgggataattgatgtcttgttctcagatactcctgtaaacctttttgggagatctcttctacgtagcatagtgacttgcttcaccctacttgttcacacagaaaaaatcgaacccctacccgtcaaggtaaggggaccgactcggaccgatg

SEQ ID NO: 4792 - DNA, 203 bp, Homo sapiens
ggcgcgccagtcctaagaaacagcactacaagtagctctctgcattttacagctaatccagagatatacagttcttcacttacatagtgacaacgggccgtgctttactgcacacaggatagaaaatctatgtaagtatctggggatcacaaaaactacgggaataccctacaacccacaatcccaggcgactcggaccgatg

SEQ ID NO: 4793 - DNA, 203 bp, Homo sapiens
ggcgcgccagtcctgagttgtagaaagagcccacagagatctaaaagacagattggcagcttatcagggagattgtgaaaccgtagaagcagcccttagcctcgcattagtttctttaaataaaaaaagagggggaatagggggccatacaccatatgaaatatacctagaatcagaacataccaaatcgactcggaccgatg

SEQ ID NO: 4794 - DNA, 203 bp, Homo sapiens
ggcgcgccagtcctagctggaacacacaccactgaagaaataggtcacttagatctcttttggcttaggtactgttcatgtccgcatgagatgcccccgtggctagacttccttagaggcaccctcaatctacgcatttcctgtcgacgcgctcttcaagcgtcagtgttgactagcacccctagacacgactcggaccgatg

SEQ ID NO: 4795 - DNA, 203 bp, Homo sapiens
ggcgcgccagtcctctccctccaacgcttagctgcacttcagctgtgcactaacgcatgtctctgttggtacccgttaggacgcatcaacgacaccaccccgttgtggttgaacttttcgtctgggaaggaaccaacgatccaacaactgagtggccacccctaactcgtcgtaacattcatagattgcgactcggaccgatg

SEQ ID NO: 4796 - DNA, 203 bp, Homo sapiens
ggcgcgccagtccttggcaatatgcccggaccttgggtggcgatgataatgttgccacagcccaaagaaagctttggaggaaagccaattggctggcttttctggaacacgtgcaaaggacctaggcgggactgtccacattgttgttgtcccatatgtagttggcattgtcagctttgctttttgcacgactcggaccgatg

SEQ ID NO: 4797 - DNA, 203 bp, Homo sapiens
ggcgcgccagtcctgaaaaatctaggaatcaactatggatcaggacctagacggcgcggaacgcggggaaaggggaggaggatccgaagaactgcttcaggaggagatcaacgaagggaggctgacagccagagaagctttacaaacatggatcaataacggtgagatccacccttgggtcctggcagcgactcggaccgatg

SEQ ID NO: 4798 - DNA, 203 bp, Homo sapiens
ggcgcgccagtcctgtcattccttctcaaaacaggcctctgcccggtggattcttgtaaaggtccccagctatgggtttgtggtagtaaatgacacagatacaccaccatccctccgcatccgaaagcctcgagcagtcggactagcaatattcctgcttgtgctggctatcatggccatcacatcctcgactcggaccgatg

SEQ ID NO: 4799 - DNA, 203 bp, Homo sapiens
ggcgcgccagtcctttatcttctcagctgattgtggttaggccgattactggaaactagacaacctgattcattagtggttaagattatgcataagtgctcgcaatgatgtagctgcttacgcttgcttactccgccctgaaacgcctaccttaacacgcaacacgcccacctgtaagaatatataaacgactcggaccgatg

SEQ ID NO: 4800 - DNA, 203 bp, Homo sapiens
ggcgcgccagtcctgaagcgttctcctcctgagaccctagtgctcagctctcggtcctgagctctcttgctcccgagaccttctggtcggctatccggcagcggtcaggtaaggcaaaccacggtttggagggtggttctcggctgagaccgccgcgagctctatctccggtcctctgaccgtctccacgactcggaccgatg

SEQ ID NO: 4801 - DNA, 203 bp, Homo sapiens
ggcgcgccagtcctcgtggactctctctcttgcctcctgaccccgcgctccaagggcgtctggcttgcacccgcgtttgtttcctgtcttactttctgtttctcgcggcccgcgctctctccctcggcgccctctagcggccaggagagaccggcaaacaattgggggctcgtccgggattgatcacccgactcggaccgatg

SEQ ID NO: 4802 - DNA, 203 bp, Homo sapiens
ggcgcgccagtcctccggaaccctaacgatcctctggacccaccccctcggcggcgttttgggtctttcctttaaattatatcatgggaaattccccctcctataacccccccgctggtatctccccctcagactggctcaaccttcgtcaaagcgcgcaaaggctcaatccgcgaccctctcctagccgactcggaccgatg

SEQ ID NO: 4803 - DNA, 203 bp, Homo sapiens
ggcgcgccagtcctgcaatcttacaggccgaccctactcctgctgacctagaacaactttgccaatatattgcttccccggtcgatcaaacggcccacatgaccagcctaacggcagcaatagccgccgctgaagcggccaataccctccagggttttaatccccaaaatgggaccctgacccaacaacgactcggaccgatg

SEQ ID NO: 4804 - DNA, 203 bp, Homo sapiens
ggcgcgccagtcctcacaccccagggcccaagatgcccgggcctcggcaaccggcccccaaaaggccccccccgggaccatgctatcgatgcctcaaagaaggccattgggcccgggactgtcccaccaagaccaccggcccccctccgggaccttgtcccatatgtaaagatccttcccattggaaacgactcggaccgatg

SEQ ID NO: 4805 - DNA, 203 bp, Homo sapiens
ggcgcgccagtcctcgagactgtccaaccctcaaatcaaaaaactaatagaggggggacttagcgccccccaaaccgtaacccctataacagatcctcttagtgaggccgaattagaatgcctactttctattcctctggctcgcagccgtccctccgtggctgtatacctgtctggcccctggctgccgactcggaccgatg

SEQ ID NO: 4806 - DNA, 203 bp, Homo sapiens
ggcgcgccagtcctagccctctcagaatcaagcccttatgctcgtggacaccggggctgaaaatacggtcctcccacaaaattggctggttcgagattacccacggatccccgccgcggtgctcggagcagggggagtctcccggaacagatacaattggctacaaggccctctgaccctggctctaacgactcggaccgatg

SEQ ID NO: 4807 - DNA, 203 bp, Homo sapiens
ggcgcgccagtcctcctccctacccccgggggactccaacctcacagacgctttgcctggcgggtcctacctcaaggcttcattaacagcccagctcttttcgaacgggcactacaggaaccccttcgccaagtttccgccgccttctcccagtctcttctggtgtcctatatggacgatatccttatcgactcggaccgatg

SEQ ID NO: 4808 - DNA, 203 bp, Homo sapiens
ggcgcgccagtcctcgcttcgcctacagaagaacaacggtcacaatgttatcaagccctggctgcccgcctccgggacctagggtttcaggtggcgtctgaaaagactcgccagacgccttcgcccgtccccttcttgggacaaatggtccataaccagattgtcacctatcagtccctacctaccttcgactcggaccgatg

SEQ ID NO: 4809 - DNA, 203 bp, Homo sapiens
ggcgcgccagtcctgcagatctcatccccaatttctcttcaccaattacaggcggtcttgggagacctccagtgggtctctaggggcacacccactacccgccggcccctgcaacttctctactcttcccttaaaggcatcgatgaccctagggccatcatccagctttccccggaacagctacaaggcgactcggaccgatg

SEQ ID NO: 4810 - DNA, 203 bp, Homo sapiens
ggcgcgccagtcctcattgcagagcttcgacaagccctgtcccataacgcaagatctagatataacgagcaagaacccctgctggcctacgtacacctaacccgggcagggtccaccctggtactcttccaaaagggcgctcaatttcccctggcctactttcagacccccttgactgacaaccaagccgactcggaccgatg

SEQ ID NO: 4811 - DNA, 203 bp, Homo sapiens
ggcgcgccagtcctctcaccttggggcctccttctcctgctgggatgccaatacctgcagactcaggccttaagctcttatgccaagcccatactcaaatactatcacaatcttcctaaaacctctctcgacaattggattcaatcatctgaggaccctcgagttcaggagttgttgcaattgtggcccgactcggaccgatg

SEQ ID NO: 4812 - DNA, 203 bp, Homo sapiens
ggcgcgccagtcctctccaaaacctttgtcaggttttgccagcagttcggaatttccctttctcatcacgttccctacaaccccacaagttcagggttggtagagcggacaaatggactgctcaaacttcttttgtctaaatatcacctagacgaaccccaccttcccatgactcaggccctttctcgcgactcggaccgatg

SEQ ID NO: 4813 - DNA, 203 bp, Homo sapiens
ggcgcgccagtcctcagcccatccagacttggagatgctccctgtccctaggaaatcaacaatggatgacaacatataaccaagaggcaaaattttccatctccattgaccaaatattagaggctcacaatcaatcacctttctgtcccaggtctcccagatacaccttggacttcgtaaatggttatcgactcggaccgatg

SEQ ID NO: 4814 - DNA, 203 bp, Homo sapiens
ggcgcgccagtcctttattcctgcatctcaaacaatgtcatggaattttcactctaacctgggaaatatggggatatgatcccctgatcaccttttctttacataaaattcctgatccccctcaacccgacttccctcagctgaacagtgactgggttccctctgtcagatcatgggccctgcttttacgactcggaccgatg

SEQ ID NO: 4815 - DNA, 203 bp, Homo sapiens
ggcgcgccagtcctaatcaaacggcacgggccttcccagactgtgctatatgttgggaaccttcccctccctgggctcccgaaatattagtatataacaaaaccatctccggctctggacccggtctcgccctcccggacgcccaaatcttctgggtcaacacgtccttgtttaacaccacccaaggacgactcggaccgatg

SEQ ID NO: 4816 - DNA, 203 bp, Homo sapiens
ggcgcgccagtccttggcaccacccttcccagaggttgttgttcaatgtttctcaaggcaacgccttattattaccccctatctccctggttaatctctctacggtttcctccgcccctcctacccgggtcagacgcagtcccgtcgcagccctgaccttaggcctagccctgtcagtggggctcactcgactcggaccgatg

SEQ ID NO: 4817 - DNA, 203 bp, Homo sapiens
ggcgcgccagtcctcggctgggttttcaaagcctatgtcccacaatcaatgaaccttgctgtttcctacgcattcaaaatgactccattatccgcctcggtgatctccagcctctctcgcaaagagtctctacagactggcagtggccctggaattgggatctggggctcaccgcctgggtgcgagaacgactcggaccgatg

SEQ ID NO: 4818 - DNA, 203 bp, Homo sapiens
ggcgcgccagtccttcagcaccagagatctactctcacctctcccccaccaaacccgattacatcaaccttcgaccctgcccttgacacccccgtgtttcacgcaccctcaggctgtggtggggcactggcttagtggaatagtcagtgtaccatcacaagcctcttcttgctgccagcaccgagttccgactcggaccgatg

SEQ ID NO: 4819 - DNA, 203 bp, Homo sapiens
ggcgcgccagtcctgaacacagccctaccctgagcctctctgagtacatgactgagtgtagcgcagagaggttgtcgcttctgcgtgtcactcagtcattttttatagccgattggggttcgcgccctcccattgcctgtgacacggttaagacctctctcacttctgcttcaccatccccctgccagcgactcggaccgatg

SEQ ID NO: 4820 - DNA, 203 bp, Homo sapiens
ggcgcgccagtcctcgttggtctagtggaaagaactaacgctgacgggggcgatttcttgcagctgtgctaagcgagaggctctggtgctggggataagatgcggcccctagcaccacagtctctgcgccttttgggttcgaatcttccccatgcagcttccgctttttacgccctgttgcacaccctcgactcggaccgatg

SEQ ID NO: 4821 - DNA, 203 bp, Homo sapiens
ggcgcgccagtcctagtgtgcacaatatctcttccaaaaggtcctgatgaacatcttcccatgtaacaagccccagcagagacattccagccacatccagcagcatttgggccgccttctctaacagtgcccataaagtcccttccgtttccacaacggctgcctctgcatcttctatttccacctcgcgactcggaccgatg

SEQ ID NO: 4822 - DNA, 203 bp, Homo sapiens
ggcgcgccagtcctgcccccttccggccgttcgcgctcagcccggcccggtttcactttcccccttcgagcagtcccccttccagccctaccaatgccaattgccctcggcctctagcgacggttgccccatcatcgggcacggccttcttccctggaacaacttagtaacgcatcctgtcctcggaacgactcggaccgatg

SEQ ID NO: 4823 - DNA, 203 bp, Homo sapiens
ggcgcgccagtcctaagtccttatattaaatcaaatggccaatttttccttactcccccccttcgataccctccttgtagaccccctccggctgtccgtctttgccccggacactaggggagccatacgttatctctccacccttttgacgctatgcccagttacttgtattctacccctaggcgagccgactcggaccgatg

SEQ ID NO: 4824 - DNA, 203 bp, Homo sapiens
ggcgcgccagtcctgtcctcaggccttacaacgcttcctccatgaccctacgctcacctggtcagaattggttgctagcgggaaactaagacttgattcacccttaaaattacagctgttagaaaatgaatggctctcccgccttttttgagggggagtcatttgtatgaaagatcatgcaggcctagcgactcggaccgatg

SEQ ID NO: 4825 - DNA, 203 bp, Homo sapiens
ggcgcgccagtcctttagcggcaccagaagcgttctcctcctgagaccctagtgctcagctctcggtcctgagctctcttgctcccgagaccttctggtcggctatccggcagcggtcaggtaaggcaaaccacggtttggagggtggttctcggctgagaccgccgcgagctctatctccggtcctccgactcggaccgatg

SEQ ID NO: 4826 - DNA, 203 bp, Homo sapiens
ggcgcgccagtcctctcccgagaccttctggtcggctatccggcagcggtcaggtaaggcaaaccacggtttggagggtggttctcggctgagaccgccgcgagctctatctccggtcctctgaccgtctccacgtggactctctctcttgcctcctgaccccgcgctccaagggcgtctggcttgcacgactcggaccgatg

SEQ ID NO: 4827 - DNA, 203 bp, Homo sapiens
ggcgcgccagtccttctgtttccccggtgaagttgcatagactgtacccacggttgaaagcgatgaatccgttacccgcttaggtacttcgagaagcctagtatcatcttggaatcttcgatgcgttgcgatcagcactctaccccgagtgtagcttgggtcgatgagtctggacaccccacaccggccgactcggaccgatg

SEQ ID NO: 4828 - DNA, 203 bp, Homo sapiens
ggcgcgccagtcctgtccaataccactacctgtataggagtgggttcctgtgccacgtacaatgcaatgctacaaaatttcaccaaggtactcttctaatagtggctatcccagaacaccaaattggaaagaaaggaacaggtacgtcagcaagctttgctgaagtcatgaaaggggctgaaggtggacgactcggaccgatg

SEQ ID NO: 4829 - DNA, 203 bp, Homo sapiens
ggcgcgccagtcctattccggtatgtccattggcaggaggtactggcaacacaaacacctatgtgccaattaccatctccattgctcccatgtgtgctgaatacaatgggcttagaaatgccattacacaaggagtgcccacttgcctgttgccaggctccaaccaatttttgactactgatgaccaccgactcggaccgatg

SEQ ID NO: 4830 - DNA, 203 bp, Homo sapiens
ggcgcgccagtcctttaggcagatctgcacttgtgtgtatgcgatcatttgagtacaagaatcactcaacaagtacctcatccattcaaaagaatttcttcatctggactttgaacaccagagaacttgtccaaattaggaggaagatggaattgtttacttacctaaggtttgacactgaaataactcgactcggaccgatg

SEQ ID NO: 4831 - DNA, 203 bp, Homo sapiens
ggcgcgccagtcctctaacagttagggtatatatgaagcctaagcatattaaggcctgggcacctagggcgcctcgcaccatgccctataccaacatcctcaacaacaattatgcaggtcggtcagctgcacccaatgctcccacagccatagtgtcccataggagtaccataaagacaatgcccaaccgactcggaccgatg

SEQ ID NO: 4832 - DNA, 203 bp, Homo sapiens
ggcgcgccagtcctctcttagtctgctcacatggagtgataggactcgtcaccgcaggcggtgagggaatagttgctttcacagacattagaaatctcctgtggttagaggatgatgccatggaacaaggtataacagattacatccagaaccttggtagcgcctttgggactggatttactgagacccgactcggaccgatg

SEQ ID NO: 4833 - DNA, 203 bp, Homo sapiens
ggcgcgccagtcctatcagtgaaaaggctaaagagattcagaacatgctagttggagaggacagtttattggaaaagcttcttaaagcattaatcaaaatagtatctgcaatggtgattgtgattaggaattcagaagatctagttacagtcactgcaacacttgccctcctagggtgcaatgactcacgactcggaccgatg

SEQ ID NO: 4834 - DNA, 203 bp, Homo sapiens
ggcgcgccagtcctccatgggcgtttcttaaacagaaagtttgctcatatcttggcatcccatacacaataagacagagtgattcttggctcaagaagttcacagaggcatgcaatgcattgagaggcctggattggctagcacaaaagattgacaagtttatcaactggcttaaaacaaagattctccgactcggaccgatg

SEQ ID NO: 4835 - DNA, 203 bp, Homo sapiens
ggcgcgccagtccttcttactcactcccacctgatccaaaatattttgatgggtataaacaacagacagtggtcctgatggatgacttaatgcaaaatccagatggtaatgatattgctatgttttgtcagatggtatctactgtagactttataccaccaatggccagtcttgaggaaaagggaacccgactcggaccgatg

SEQ ID NO: 4836 - DNA, 203 bp, Homo sapiens
ggcgcgccagtcctaacccagaaaagtgcagaccaaccaactataaaaagtgttgtccactgatttgtggaaaggccattcagtttagagacaagagaacgaacgtcaggtactcagtagatatgttagtaactgaaatgatcaaggaatataggatcagaaacagcacacaagataaattggaggctcgactcggaccgatg

SEQ ID NO: 4837 - DNA, 203 bp, Homo sapiens
ggcgcgccagtcctcagcgttggtatactgcccctacccgcgggccggctgctaattgccggcgttccgcactgcgcgggctccccgctgctgaccgcacttactgcttcgacgggttttctggctgtaactttcccgccgagactggcgtcgccctctattctctccatgatatgtcaccatctgatcgactcggaccgatg

SEQ ID NO: 4838 - DNA, 203 bp, Homo sapiens
ggcgcgccagtcctcgatcgatcttcggcccgggtggtaccccctccctatttccaacctcatgctccactaagtcgaccttccatgctgtccctgcccatatctgggaccgtctcatgttgttcggggccaccctagatgaccaagccttttgctgctcccgcctaatgacttacctccgtggcattcgactcggaccgatg

SEQ ID NO: 4839 - DNA, 203 bp, Homo sapiens
ggcgcgccagtcctagctacaaggttactgtgggcacccttgttgccaatgaaggctggaacgcctctgaggtcgctcttacagctgtcatcactgccgcctaccttaccatctgccaccagcggtacctccgcactcaggctatatctaaggggatgcgccgtctggagcgggagcatgctcagaagcgactcggaccgatg

SEQ ID NO: 4840 - DNA, 203 bp, Homo sapiens
ggcgcgccagtccttttataacacgcctctacagttggctctttgagaagtccggccgtgattatatccccggccgtcagttggagttctacgctcagtgtaggcgctggctctcggccggctttcatcttgacccacgggtgttggtttttgatgagtcggccccctgccactgtaggactgcgattcgactcggaccgatg

SEQ ID NO: 4841 - DNA, 203 bp, Homo sapiens
ggcgcgccagtcctccccggtcagcccctggcgaggtcaccgccttttgttctgccctatacaggtttaatcgcgaggcccagcgcctttcgctcaccggtaatttttggttccatcctgaggggctccttggcccctttgccccgttttcccccgggcatgtttgggagtcggctaatccattctgtcgactcggaccgatg

SEQ ID NO: 4842 - DNA, 203 bp, Homo sapiens
ggcgcgccagtcctccggcgcgtggtgagccggctcctggcgctaccgcccgggccccggccataacccaccaggcggcccggcatcgccgcctgctctttacctacccggatggctctaaggtattcgccggctcgctgtttgagtcgacatgtacctggctcgttaacgcgtctaatgttgaccaccgactcggaccgatg

SEQ ID NO: 4843 - DNA, 203 bp, Homo sapiens
ggcgcgccagtcctcgccctggcggtgggctctgtcatgcattttaccaaaggtaccccgcatcctttgatgctgcctcttttgtgatgcgcgacggcgcggccgcctatacattaaccccccggccaataattcacgccgtcgctcctgattataggttggaacataacccaaagatgcttgaggctcgactcggaccgatg

SEQ ID NO: 4844 - DNA, 203 bp, Homo sapiens
ggcgcgccagtcctgcctaccgggagacttgctcccgcctcggtaccgctgcatacccactcctcgggaccggcatataccaggtgccgatcggtcccagttttgacgcctgggagcggaatcaccgccccggggatgagttgtaccttcctgagcttgctgccagatggttcgaggccaataggccgcgactcggaccgatg

SEQ ID NO: 4845 - DNA, 203 bp, Homo sapiens
ggcgcgccagtcctacctgcccaactctcactataactgaggatgttgcacggacagcaaatctggctatcgaacttgactcagccacagacgtcggccgggcctgtgccggctgtcgagtcacccccggcgttgtgcagtaccagtttaccgcaggtgtgcctggatccggcaagtcccgctctattcgactcggaccgatg

SEQ ID NO: 4846 - DNA, 203 bp, Homo sapiens
ggcgcgccagtcctcagcgggccgccaccgtccaccttcttggtgacccgaatcagatcccagccatcgactttgagcacgccgggctcgttcccgccatcaggcccgatttggcccccacctcctggtggcatgtgacccatcgctgccctgcggatgtatgtgagctgatccgtggcgcataccctcgactcggaccgatg

SEQ ID NO: 4847 - DNA, 203 bp, Homo sapiens
ggcgcgccagtcctcgaggcctcattcagtcgtcccgagctcatgccattgttgccttgacgcgccacactgagaagtgcgtcatcattgacgcaccaggcctgcttcgcgaggtgggcatctccgatgcaatcgttaataactttttccttgctggtggcgaaattggccaccagcgcccatctgttcgactcggaccgatg

SEQ ID NO: 4848 - DNA, 203 bp, Homo sapiens
ggcgcgccagtcctgaactcaccacctgtgatagtgtcgtaacatttgaattaacagatattgtgcactgtcgtatggccgccccgagccagcgcaaggccgtgctgtccacgcttgtgggccattacggccgccgcacaaagctctacaatgcctcccactctgatgttcgcgactctctcgcccgtcgactcggaccgatg

SEQ ID NO: 4849 - DNA, 203 bp, Homo sapiens
ggcgcgccagtccttttatcccggccattggccacgtacaggttacaacctgtgaattgtacgagctagtggaggccatggtcgagaagggccaggacggctccgccgtccttgagctcgacctttgtaaccgcgacgtgtccaggatcaccttcttccagaaagattgtaataaattcaccacggggcgactcggaccgatg

SEQ ID NO: 4850 - DNA, 203 bp, Homo sapiens
ggcgcgccagtcctgcagcaagggcatccatggtgtttgagaatgacttttctgagtttgattccacccagaataatttttccttgggcctagagtgtgctattatggtggagtgtgggatgccgcagtggctcatccgcttgtaccaccttataaggtctgcgtggattctgcaggccccgaaggagcgactcggaccgatg

SEQ ID NO: 4851 - DNA, 203 bp, Homo sapiens
ggcgcgccagtccttccctgcgagggttttggaagaaacactccggtgagcccggcacccttctatggaatacagtctggaacatggccgttatcacccactgttatgatttccgcgatctgcaggtggccgcctttaaaggtgatgattcgatagtgctttgcagtgagtaccgtcagagcccagggcgactcggaccgatg

SEQ ID NO: 4852 - DNA, 203 bp, Homo sapiens
ggcgcgccagtcctctccgcctcgctgtgagtgattttctccgcaagctcacgaatgtagctcagatgtgtgtggatgttgtctctcgtgtttatggggtttcccctggactcgttcataacctgattggcatgctacaggctgttgctgacggcaaggctcatttcactgagtcagtgaagccagtgcgactcggaccgatg

SEQ ID NO: 4853 - DNA, 203 bp, Homo sapiens
ggcgcgccagtcctcagcggcggttccggcggtggtttctggggtgaccgggctgattctcagcccttcgcaatcccctatattcatccaaccaaccccttcgcccccgatgtcaccgctgcggccggggctggacctcgtgttcgccaacccgcccgaccactcggctccgcttggcgtgaccaggccgactcggaccgatg

SEQ ID NO: 4854 - DNA, 203 bp, Homo sapiens
ggcgcgccagtcctccagcgccccgccgctgcctcacgtcgtagacctaccacagctggggccgcgccgctaaccgcggtcgctccggcccatgacaccccgccagtgcctgatgttgactcccgcggcgccatcctgcgccggcagtataacctatcaacatctccccttacctcttccgtggccaccgactcggaccgatg

SEQ ID NO: 4855 - DNA, 203 bp, Homo sapiens
ggcgcgccagtcctctccatctcgttctggccacagaccaccaccaccccgacgtccgttgacatgaattcaataacctcgactgatgttcgtattttagtccagcccggcatagcctccgagcatgttatcccaagtgagcgcctacactatcgtaaccaaggttggcgctctgttgagacctccggcgactcggaccgatg

SEQ ID NO: 4856 - DNA, 203 bp, Homo sapiens
ggcgcgccagtcctctccagcactgcccgtcaccgccttcgtcgcggtgcagatgggactgccgagctcaccaccacggctgctacccgcttcatgaaggacctctattttactagtactaatggtgtcggtgagatcggccgcgggatagcgcttaccctgtttaaccttgctgacaccctgcttggcgactcggaccgatg

SEQ ID NO: 4857 - DNA, 203 bp, Homo sapiens
ggcgcgccagtccttattcaggattatgataaccaacatgagcaggaccgaccgacaccttccccagccccatcgcgccccttttctgtcctccgagctaatgatgtgctttggctttctctcaccgctgccgagtatgaccagtccacttacggctcttcgaccggcccagtctatgtctctgactccgactcggaccgatg

SEQ ID NO: 4858 - DNA, 203 bp, Homo sapiens
ggcgcgccagtcctcgggtacccttataattataacaccactgctagtgaccaactgctcgttgagaatgccgctgggcatcgggttgctatttccacttacaccactagcctgggtgctggccccgtctctatttccgcggttgctgttttagccccccactctgcgctagcattgcttgaggataccgactcggaccgatg

SEQ ID NO: 4859 - DNA, 203 bp, Homo sapiens
ggcgcgccagtcctcccggagtgccgcccccttggcctccagggctgtgcttttcagtctactgtcgctgagcttcagcgccttaagatgaaggtgggtaaaactcgggagttatagtttatttgcttgtgccccccttctttctgttgcttatttctcatttctgcgttccgcgctccctgaaaaaacgactcggaccgatg

SEQ ID NO: 4860 - DNA, 203 bp, Homo sapiens
ggcgcgccagtcctaacgagaacttggaacactcattgacgccgtgaacaagcggggcagaaaacaaaacaaaagaggaggaaatgaaggctcaatcatgtggctcgcaagcttggcagttgtcatagcttacgcaggagcaatgaagttgtcgaatttccaggggaagcttttgatgaccatcaacacgactcggaccgatg

SEQ ID NO: 4861 - DNA, 203 bp, Homo sapiens
ggcgcgccagtcctctggctatgctttcctggcggcgacacttggctggatgcttggcagtaacaacggtcaacgcgtggtatttaccatcctcctgctgttggtcgctccggcttacagttttaattgtctgggaatgggcaatcgtgacttcatagaaggagccagtggagccacttgggtggactcgactcggaccgatg

SEQ ID NO: 4862 - DNA, 203 bp, Homo sapiens
ggcgcgccagtcctacaacgagaagcgagctgatagtagctatgtgtgcaaacaaggcttcactgatcgtgggtggggcaacggatgtggacttttcgggaagggaagcattgacacatgtgcaaaattctcctgcaccagcaaagcgattggaagaacaatccagccagaaaacatcaaatacgaagcgactcggaccgatg

SEQ ID NO: 4863 - DNA, 203 bp, Homo sapiens
ggcgcgccagtcctttgggtcacaggaaggaggcctccatcaggcgttggcaggagccatcgtggtggagtactcaagctcagtgaagttaacatcaggccacctgaaatgtaggctgaaaatggacaaactggctctgaaaggcacaacctatggcatgtgtacagaaaaattctcgttcgcgaaaacgactcggaccgatg

SEQ ID NO: 4864 - DNA, 203 bp, Homo sapiens
ggcgcgccagtcctatccggcggacactggccacggaacagttgtcattgaactatcctactctgggagtgatggcccctgcaaaattccgattgtctccgttgcgagcctcaatgacatgacccccgttgggcggctggtgacagtgaaccctttcgtcgcgacttccagtgccaactcaaaggtgccgactcggaccgatg

SEQ ID NO: 4865 - DNA, 203 bp, Homo sapiens
ggcgcgccagtccttggtcgagatggaaccccccttcggagactcctacatcgtggttgggaggggagacaagcagatcaaccaccattggcacaaagctggaagcacgctaggcaaggccttttcaacaactttgaagggagctcaaagactggcagcgttgggcgacacagcctgggactttggctcgactcggaccgatg

SEQ ID NO: 4866 - DNA, 203 bp, Homo sapiens
ggcgcgccagtcctcaggaggtgtgctcgtgttcttagcgaccaatgtgcatgctgacactggatgtgccattgacatcacaagaaaagagatgagatgtggaagtggcatctttgtgcacaacgacgtggaagcctgggtggacaggtataaatacttgccagaaacgcccagatccctagcgaagacgactcggaccgatg

SEQ ID NO: 4867 - DNA, 203 bp, Homo sapiens
ggcgcgccagtccttcagacctgtcaggcatgatgaaacaacactcgttagatcacaggttgatgctttcaatggtgaaatggttgacccttttcagctgggccttctggtgatgtttctggccacccaggaggtccttcgcaagaggtggacggccagattgaccattcctgcggttttgggggccccgactcggaccgatg

SEQ ID NO: 4868 - DNA, 203 bp, Homo sapiens
ggcgcgccagtccttacttgtgctgatgcttgggggcatcacttacactgatttggcgaggtatgtggtgctagtcgctgccgctttcgcagaggccaacagtggaggagacgtcctgcatcttgctttgattgccgtttttaagatccaaccagcgtttctagtgatgaacatgcttagcacgagatcgactcggaccgatg

SEQ ID NO: 4869 - DNA, 203 bp, Homo sapiens
ggcgcgccagtcctctgccggactaatggtctgcaacccaaacaagaagagagggtggccagccactgagtttttgtcggcagttggattgatgtttgccatcgtaggtggcttggccgagttggatattgaatccatgtcaatacccttcatgctggcaggtctcatggcagtgtcctacgtggtgtcgactcggaccgatg

SEQ ID NO: 4870 - DNA, 203 bp, Homo sapiens
ggcgcgccagtcctttggcacttaccaggccggcgtcggagtcatgtacgagaatgttttccacacactatggcacacaactagaggagcagccattatgagtggagaaggaaaattgacgccatactggggtagtgtgaaagaagaccgcatagcttacggaggcccatggaggtttgaccgaaaatcgactcggaccgatg

SEQ ID NO: 4871 - DNA, 203 bp, Homo sapiens
ggcgcgccagtcctgaaccacggatccttttcctgactcaaatgccccaatccatgatttgcaagatgagataccagacagggcatggagcagtggatacgaatggatcacagaatatgcgggcaaaaccgtgtggtttgtggcgagcgtaaaaatggggaatgagattgcaatgtgcctccaaagagcgactcggaccgatg

SEQ ID NO: 4872 - DNA, 203 bp, Homo sapiens
ggcgcgccagtcctccaatggcattcagtacaccgacagaaggtggtgttttgatgggccgcgcacgaatgccatactggaggacaacaccgaggtagagatagtcacccggatgggtgagaggaaaatcctcaagccgagatggcttgatgcaagagtttatgcagatcaccaagccctcaagtggtcgactcggaccgatg

SEQ ID NO: 4873 - DNA, 203 bp, Homo sapiens
ggcgcgccagtccttgctgatcgccctgctgctgatggtggtgctcatcccagaaccggaaaaacagaggtcacagacagataaccaactggcggtgtttctcatctgcgtcttgaccgtggttggagtggtggcagcaaacgagtacgggatgctagagaaaaccaaagcagatctcaagagcatgtcgactcggaccgatg

SEQ ID NO: 4874 - DNA, 203 bp, Homo sapiens
ggcgcgccagtcctttgtcggaaagacgcaggcatcagggctgactggattgccaagcatggcactggacctgcgtccagccacagcctgggcactgtatggggggagcacagtcgtgctaacccctcttctgaaacacctgatcacgtcggaatacgtcaccacatcgctagcctcaattaactcaccgactcggaccgatg

SEQ ID NO: 4875 - DNA, 203 bp, Homo sapiens
ggcgcgccagtcctatgtcaccactgtgagagaagcaggggtattggtgacggcggctacgctcactttgtgggacaatggagccagtgccgtctggaattccaccacagccacgggactctgccatgttatgcgaggtagctacctggctggaggttccattgcttggactctcatcaagaacgcggcgactcggaccgatg

SEQ ID NO: 4876 - DNA, 203 bp, Homo sapiens
ggcgcgccagtcctcatctgactggttgcaccgaggacctagagagttctgcataaaagttctctgcccttacatgcccaaggttatagaaaaaatggaagttctgcagcgccgcttcggaggtgggctagtgcgtctccccctgtcccggaactccaatcacgagatgtattgggttagtggagccgcgactcggaccgatg

SEQ ID NO: 4877 - DNA, 203 bp, Homo sapiens
ggcgcgccagtcctctggcaatgtggtgcacgctgtgaacatgaccagccaggtactactggggcgaatggatcgcacagtgtggagagggccaaagtatgaggaagatgtcaacctagggagcggaacaagagccgtgggaaagggagaagtccatagcaatcaggagaaaatcaagaagagaatcccgactcggaccgatg

SEQ ID NO: 4878 - DNA, 203 bp, Homo sapiens
ggcgcgccagtcctaatttataaagaaagtcaacagcaacgcggctcttggagcagtgttcgctgaacagaatcaatggagcacggctcgtgaggctgtggatgacccgcggttctgggagatggttgatgaagagagggaaaaccatctgcgaggagagtgtcatacatgtatctacaacatgatggcgactcggaccgatg

SEQ ID NO: 4879 - DNA, 203 bp, Homo sapiens
ggcgcgccagtcctagctgggatacatcctccgtgacatagcaggaaagcaaggagggaaaatgtacgctgatgacaccgccggatgggacactagaattaccagaactgatttagaaaatgaagccaaggtgctggagctcctagacggtgaacaccgcatgctcgctcgagccataattgaactgacgactcggaccgatg

SEQ ID NO: 4880 - DNA, 203 bp, Homo sapiens
ggcgcgccagtcctcttacaggcacaaagtggtcaaggtcatgagacctgcagcagaaggaaagaccgtaatggacgtgatatcaagagaagatcaaagggggagtggacaggtggtcacttatgcccttaacactttcacgaacattgctgtccagctcgtcaggctgatggaggctgagggggtcacgactcggaccgatg

SEQ ID NO: 4881 - DNA, 203 bp, Homo sapiens
ggcgcgccagtcctttggaccacaacacttggaacagctacctagaaaaaccaagatagctgtcaggacctggctctttgagaatggagaggagagagtgaccaggatggcgatcagcggagatgactgtgtcgtcaagccgctggatgacagattcgccacagccctccacttcctcaacgcaatgtcgactcggaccgatg

SEQ ID NO: 4882 - DNA, 203 bp, Homo sapiens
ggcgcgccagtcctgagctggatggaatgtgaaggacacagcttgtctggccaaagcatatgcacagatgtggctactcctatacttccatcgtagggacttgcgtctcatggcaaatgcgatttgctcagcagtgccagtggattgggtgcccacaggcaggacgtcctggtcaatacactcgaaagcgactcggaccgatg

SEQ ID NO: 4883 - DNA, 203 bp, Homo sapiens
ggcgcgccagtcctaaaatgcatgcatatggagtcaggccagcaaaagctgccaccggatactgggtagacggtgctgtctgcgtctcagtcccaggaggactgggttaacaaatctgacaacagaaagtgagaaagccctcagaaccgtctcggaagtaggtccctgctcactggaagttgaaagaccgactcggaccgatg

SEQ ID NO: 4884 - DNA, 203 bp, Homo sapiens
ggcgcgccagtcctggcccaagccccctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggacgactcggaccgatg

SEQ ID NO: 4885 - DNA, 203 bp, Homo sapiens
ggcgcgccagtcctcgaagctgtagaggaggtggaaggactagaggttagaggagaccccgcatttgcatcaaacagcatattgacacctgggaatagactgggagatcttctgctctatctcaacatcagctactaggcacagagcgccgaagtatgtagctggtggtgaggaagaacacaggatctcgactcggaccgatg

SEQ ID NO: 4886 - DNA, 203 bp, Homo sapiens
ggcgcgccagtcctcctgtctctagtttgtctgttcgagatcctacagttggcgcccgaacagggacctgagaggggcgcagaccctacctgttgaacctggctgatcgtaggatccccgggacagcagaggagaacttacagaagtcttctggaggtgttcctggccagaacacaggaggacaggtacgactcggaccgatg

SEQ ID NO: 4887 - DNA, 203 bp, Homo sapiens
ggcgcgccagtcctagatgggagaccctttgacatggagcaaggcgctcaagaagttagagaaggtgacggtacaagggtctcagaaattaactactggtaactgtaattgggcgctaagtctagtagacttatttcatgataccaactttgtaaaagaaaaggactggcagctgagggatgtcattccgactcggaccgatg

SEQ ID NO: 4888 - DNA, 203 bp, Homo sapiens
ggcgcgccagtcctgggaatcccagggggaatctcaacccctattacccaacagtcagaaaaatctaagtgtgaggagaacacaatgtttcaaccttattgttataataatgacagtaagaacagcatggcagaatcgaaggaagcaagagaccaagaaatgaacctgaaagaagaatctaaagaagacgactcggaccgatg

SEQ ID NO: 4889 - DNA, 203 bp, Homo sapiens
ggcgcgccagtcctagttaatcttaattcctctgactcctctaactctgtacgtgttgaggatgtaatgaacacagcggaatattggggatttaaatggctagaatgtaatcaaacagaaaattttaagactatattagtacctgaaaatgaaatggtaaatatcaatgatactgatacctggatacccgactcggaccgatg

SEQ ID NO: 4890 - DNA, 203 bp, Homo sapiens
ggcgcgccagtccttaaggggtgtaatgagacgtgggcaagagtgaaacgttgtcctatagatattttatatgggatacatccaatcaggctgtgtgtacagccaccattttttctggtacaggagaaagggattgctgatacttctagaattggcaattgtgggccaacaatatttcttggggttttcgactcggaccgatg

SEQ ID NO: 4891 - DNA, 203 bp, Homo sapiens
ggcgcgccagtcctaactgaggttaacaaaataatggaagtacaaaatcatacttttgaggtagaaaatagtactctaaatggtatggatttaatagaacgacaaataaagatattatatgctatgattcttcaaacacatgcagatgttcaactgttaaaggaaagacaacaggtagaggagacattcgactcggaccgatg

SEQ ID NO: 4892 - DNA, 203 bp, Homo sapiens
ggcgcgccagtccttaatttaattggatgtatagaaagaacacatgtattttgtcatactggtcatccctggaatatgtcatggggacatttaaatgagtcaacacaatgggatgactgggtaagcaaaatggaagatttaaatcaagagatactaactacacttcatggagccaggaacaatttggccgactcggaccgatg

SEQ ID NO: 4893 - DNA, 203 bp, Homo sapiens
ggcgcgccagtcctcgactggaatggagaatcagaggagtacaacaggcggccaaagagctgggtgaagtcaatcgaggcatttggagagagctatatttccgagaagaccaaaggggagatttctcagcctggggcggctatcaacgagcacaagaacggctctggggggaacaatcctcaccaaggcgactcggaccgatg

SEQ ID NO: 4894 - DNA, 203 bp, Homo sapiens
ggcgcgccagtcctgtccttagacctggagattcgaagcgaaggaggaaacatttatgactgttgcattaaagcccaagaaggaactctcgctatcccttgctgtggatttcccttatggctattttggggactagtaattatagtaggacgcatagcaggctatggattacgtggactcgctgttatcgactcggaccgatg

SEQ ID NO: 4895 - DNA, 203 bp, Homo sapiens
ggcgcgccagtcctttctgcggtctgagtcccttctctgctgggctgaaaaggcctttgtaataaatataattctctactcagtccctgtctctagtttgtctgttcgagatcctacagttggcgcccgaacagggacctgagaggggcgcagaccctacctgttgaacctggctgatcgtaggatcccgactcggaccgatg

SEQ ID NO: 4896 - DNA, 203 bp, Homo sapiens
ggcgcgccagtcctgggaaaagcagagtgctttggagagctcgaaggaaagagtctccgggcctctcctgcctgcctgaaaagctcaataaaggagttggctgatatctgagcttgcctggttattatcgggattcgttactaattccgtgcaacaccggagcggatctcgcagctggcgcccaacgtcgactcggaccgatg

SEQ ID NO: 4897 - DNA, 203 bp, Homo sapiens
ggcgcgccagtcctgaaagagaaagtgttgcttgggcacaggaggagggttcgcgaccccttaaaagacggaggggcacgggcgtcctcctgggccgaggggacacaagagcaacactggtaaggaagccgccgtggtgaggctagctagagacatggcgaagcaaggctcaaaggagaaaaagggatcgactcggaccgatg

SEQ ID NO: 4898 - DNA, 203 bp, Homo sapiens
ggcgcgccagtcctgacaaaccaatcagcaggcatctcaagccaatatggatcaggcaagacagatatgcctgcagtgggtaataacagcgttaagatcagtgaggcatatgtcacatagaccaggaaaccctatgttagtgaagcagaagaatactgagagttatgaagacttcatagctcgcctaccgactcggaccgatg

SEQ ID NO: 4899 - DNA, 203 bp, Homo sapiens
ggcgcgccagtcctactgccggcagaagaaacagcagggaaacaacaggagggggccacgtgtggtgccgtccgcgccccctatgttgtaacagaagcaccacccaaaatagaaataaaagtaggaacaaggtggaaaaaattattagtagatacaggggcagataaaactatagtaacatcccatgacgactcggaccgatg

SEQ ID NO: 4900 - DNA, 203 bp, Homo sapiens
ggcgcgccagtcctagcgcccccacactggacttgtaatacccctatattttgtattaagaagaaatcaggaaaatggaggatgttaatagattttagagaattaaataagcaaacagaagatttagcagaagcacagttagggttaccgcatccaggaggattacagagaaagaaacatgtaacaatcgactcggaccgatg

SEQ ID NO: 4901 - DNA, 203 bp, Homo sapiens
ggcgcgccagtccttcccctagcagaagaagagcataacaaatggcatcaagatgctgtgtccttgcatttagaatttgggattcccaggacagctgcagaagatatagttcaacaatgtgatgtgtgtcaagaaaataaaatgcctagtacattaagaggcagtaataaaaggggcatagaccattgcgactcggaccgatg

SEQ ID NO: 4902 - DNA, 203 bp, Homo sapiens
ggcgcgccagtcctagcatttgtagcagaatctactcagctcttaatgaaatatttgggcatagaacatactacagggatcccctggaacccacaatctcaagcattagtagagagaacacatcagacgttaaagaatacattagaaaaacttatacctatgtttaacgcgtttgaatcagccctcgccgactcggaccgatg

SEQ ID NO: 4903 - DNA, 203 bp, Homo sapiens
ggcgcgccagtcctcgggtatattgggaaaaagaggatgaagaaagcatgaagtttttgaatataaaagcctgtaatatatcattgaggtgtcaagatgaaggaaagagtccgggaggatgtgtacaaggataccccattccaaagggagcagaaataataccagaagctatgaaatacctcaggggacgactcggaccgatg

SEQ ID NO: 4904 - DNA, 203 bp, Homo sapiens
ggcgcgccagtcctaagaaaagtcgatatggagggatcaaggataaaaatggggaattaaaattacctctctctgtaagggtgtgggtgaggatggcgaatttgtcaggatgggtgaatggaacgcctccttactggagtgcaaggattaatgggagtacagggataaatggaacaaggtggtatggacgactcggaccgatg

SEQ ID NO: 4905 - DNA, 203 bp, Homo sapiens
ggcgcgccagtcctataggaacattacatcacttagggtgtaacattagcagtaacccagagagagggatatgtaactttacaggagaactttggatagggggcgacaaattcccatattattatacgccctcatggaattgttcacaaaattggacaggtcacccagtatggcacgtatttagataccgactcggaccgatg

SEQ ID NO: 4906 - DNA, 203 bp, Homo sapiens
ggcgcgccagtccttacacatatggtgttgtagaaatgccacaatcatatatggaggcgcaaggggaaaacaagaggtcaagaaggaacctccaaaggaagaaaagagggataggcttggttattgtgctagccatcatggcaataatcgctgctgcaggagctggtctcggtgtcgcaaacgccgtgcgactcggaccgatg

SEQ ID NO: 4907 - DNA, 203 bp, Homo sapiens
ggcgcgccagtcctcagcaatcctataccaggacggctgtccagtctcttgctaacgcaactgctgcccagcaggaagtgttagaagcatcgtatgccatggtacagcatatagccaaaggaataagaatcctagaggcaagagtggctagggtggaagccctggtagatcgaatgatggtataccaacgactcggaccgatg

SEQ ID NO: 4908 - DNA, 203 bp, Homo sapiens
ggcgcgccagtccttgagtcatgtagcagctgatggttaagtcataaccgcagatgtaaacaagttgcctatataagccgcttgctagctggggaaaagcagagtgctttggagagctcgaaggaaagagtctccgggcctctcctgcctgcctgaaaagctcaataaaggagttggctgatatctgacgactcggaccgatg

SEQ ID NO: 4909 - DNA, 203 bp, Homo sapiens
ggcgcgccagtcctctgtattgctactaaaaatctctgctgtacatggcacatggagttgatcacaaatgaacttttatacaaaacatacaaacaaaaacccgtcggggtggaggaacctgtttatgatcaggcaggtgatcccttatttggtgaaaggggagcagtccaccctcaatcgacgctaaacgactcggaccgatg

SEQ ID NO: 4910 - DNA, 203 bp, Homo sapiens
ggcgcgccagtcctgctctttgaggagggatccatgtgtgaaacgactaaacggatagggagagtaactggaagtgacggaaagctgtaccacatttatgtgtgtatagatggatgtataataataaaaagtgccacgagaagttaccaaagggtgttcaggtgggtccataataggcttgactgccccgactcggaccgatg

SEQ ID NO: 4911 - DNA, 203 bp, Homo sapiens
ggcgcgccagtcctggtaacacaagctagagatagccccacacccttaacaggttgcaagaaaggaaagaacttctcctttgcaggcatattgatgcggggcccctgcaactttgaaatagctgcaagtgatgtattattcaaagaacatgaacgcattagtatgttccaggataccactctttacctcgactcggaccgatg

SEQ ID NO: 4912 - DNA, 203 bp, Homo sapiens
ggcgcgccagtcctcatatggtatacaaaaaattgcacccctgcctgcttacccaagaacacaaaaattgtcggccctgggaaatttggcaccaatgcagaggacggcaagatattacatgagatggggggtcacttgtcggaggtactactactttctttagtggtgctgtccgacttcgcaccggacgactcggaccgatg

SEQ ID NO: 4913 - DNA, 203 bp, Homo sapiens
ggcgcgccagtcctaacagctagtgtaatgtacctaatcctacatttttccatcccacaaagtcacgttgatgtaatggattgtgataagacccagttgaacctcacagtggagctgacaacagctgaagtaataccagggtcggtctggaatctaggcaaatatgtatgtataagaccaaattggtgcgactcggaccgatg

SEQ ID NO: 4914 - DNA, 203 bp, Homo sapiens
ggcgcgccagtcctgccttatgagacaactgtagtgttggcatttgaagaggtgagccaggtggtgaagttagtgttgagggcactcagagatttaacacgcatttggaacgctgcaacaactactgcttttttagtatgccttgttaagatagtcaggggccagatggtacagggcattctgtggctcgactcggaccgatg

SEQ ID NO: 4915 - DNA, 203 bp, Homo sapiens
ggcgcgccagtcctcaagtgtaaattggagaacgagactggttacaggctagtagacagtacctcttgcaatagagaaggtgtggccatagtaccacaagggacattaaagtgcaagataggaaaaacaactgtacaggtcatagctatggataccaaactcggacctatgccttgcagaccatatgacgactcggaccgatg

SEQ ID NO: 4916 - DNA, 203 bp, Homo sapiens
ggcgcgccagtcctaattgtaacgaggtggaaggttgacgtggctggcctattgttgcaatgtgtgcctatcttattgctggtcacaaccttgtgggccgacttcttaaccctaatactgatcctgcctacctatgaattggttaaattatactatctgaaaactgttaggactgatacagaaagaagcgactcggaccgatg

SEQ ID NO: 4917 - DNA, 203 bp, Homo sapiens
ggcgcgccagtcctatacatgagttacttaactttggactttatgtactacatgcacaggaaagttatagaagagatctcaggaggtaccaacataatatccaggttagtggcagcactcatagagctgaactggtccatggaagaagaggagagcaaaggcttaaagaagttttatctattgtctggcgactcggaccgatg

SEQ ID NO: 4918 - DNA, 203 bp, Homo sapiens
ggcgcgccagtcctaggtggcacctgcccaaaatgtggacgccatgggaagccgataacgtgtgggatgtcgctagcagattttgaagaaagacactataaaagaatctttataagggaaggcaactttgagggtatgtgcagccgatgccagggaaagcataggaggtttgaaatggaccgggaacccgactcggaccgatg

SEQ ID NO: 4919 - DNA, 203 bp, Homo sapiens
ggcgcgccagtccttaagagtgccagatactgtgctgagtgtaataggctgcatcctgctgaggaaggtgacttttgggcagagtcgagcatgttgggcctcaaaatcacctactttgcgctgatggatggaaaggtgtatgatatcacagagtgggctggatgccagcgtgtgggaatctccccagacgactcggaccgatg

SEQ ID NO: 4920 - DNA, 203 bp, Homo sapiens
ggcgcgccagtcctgattactttggcaacaggggcaggcaaaaccacagaactcccaaaagcagttatagaggagataggaagacacaagagagtattagttcttataccattaagggcagcggcagagtcagtctaccagtatatgagattgaaacacccaagcatctcttttaacctaaggataggcgactcggaccgatg

SEQ ID NO: 4921 - DNA, 203 bp, Homo sapiens
ggcgcgccagtcctaatactaaataatctactcatctcagaagacttgccagccgctgttaagaacataatggccaggactgatcacccagagccaatccaacttgcatacaacagctatgaagtccaggtcccggtcctattcccaaaaataaggaatggagaagtcacagacacctacgaaaattacgactcggaccgatg

SEQ ID NO: 4922 - DNA, 203 bp, Homo sapiens
ggcgcgccagtcctaaatgccctactagtggctttatttgggtatgtgggttaccaggctctctcaaagaggcatgtcccaatgataacagacatatataccatcgaggaccagagactagaagacaccacccacctccagtatgcacccaacgccataaaaaccgatgggacagagactgaactgaacgactcggaccgatg

SEQ ID NO: 4923 - DNA, 203 bp, Homo sapiens
ggcgcgccagtcctaaataaagaagaaataatcagatatggtttgtggggaacacacacagcactatacaaaagcatagctgcaagactggggcatgaaacagcgtttgccacactagtgttaaagtggctagcttttggaggggaatcagtgtcagaccacgtcaagcaggcggcagttgatttagtcgactcggaccgatg

SEQ ID NO: 4924 - DNA, 203 bp, Homo sapiens
ggcgcgccagtcctggtctattatgtgatgaataagccttccttcccaggtgactccgagacacagcaagaagggaggcgattcgtcgcaagcctgttcatctccgcactggcaacctacacatacaaaacttggaattaccacaatctctctaaagtggtggaaccagccctggcttacctcccctacgactcggaccgatg

SEQ ID NO: 4925 - DNA, 203 bp, Homo sapiens
ggcgcgccagtcctcccatgtggctatgagatgaaagctttcaaaaatgtaggtggcaaacttaccaaagtggaggagagcgggcctttcctatgtagaaacagacctggtaggggaccagtcaactacagagtcaccaagtattacgatgacaacctcagagagataaaaccagtagcaaagttggacgactcggaccgatg

SEQ ID NO: 4926 - DNA, 203 bp, Homo sapiens
ggcgcgccagtcctcaccacatggctagcttacaccttcgtgaatgaagacgtagggactataaaaccagtactaggagagagagtaatccccgaccctgtagttgatatcaatttacaaccagaggtgcaagtggacacgtcagaggttgggatcacaataattggaagggaaaccctgatgacaaccgactcggaccgatg

SEQ ID NO: 4927 - DNA, 203 bp, Homo sapiens
ggcgcgccagtcctcccacctgcaactaagagcaataaggggcacatggcatcagcttaccaattggcacagggtaactgggagcccctcggttgcggggtgcacctaggtacaataccagccagaagggtgaagatacacccatatgaagcttacctgaagttgaaagatttcatagaagaagaagacgactcggaccgatg

SEQ ID NO: 4928 - DNA, 203 bp, Homo sapiens
ggcgcgccagtccttataaatatagttgggaccgtccacctcaagaagacgacacgcccaacacgcacagctaaacagtagtcaagattatctacctcaagataacactacatttaatgcacacagcactttagctgtatgaggatacgcccgacgtctatagttggactagggaagacctctaacagcgactcggaccgatg

SEQ ID NO: 4929 - DNA, 203 bp, Homo sapiens
ggcgcgccagtcctgagttctaggagagtccctcctagtctctcctctccgaggaggtaccgagacctcaaaataaaggagtgattgccttactgccgagtggagagtgattactgagcggccggtgtatcgggagtcgtcccttaatctgtgcaataccagagcggctctcgcagctggcgcccaaccgactcggaccgatg

SEQ ID NO: 4930 - DNA, 203 bp, Homo sapiens
ggcgcgccagtcctattaacagtggatcaaattatgggggtaggacaaacaaatcaagcagcagcacaagctaacatggatcaggcaaggcaaatatgcctgcaatgggtaataaatgcattaagagcagtaagacatatggcgcacaggccagggaatccaatgctagtaaagcaaaaaacgaatgacgactcggaccgatg

SEQ ID NO: 4931 - DNA, 203 bp, Homo sapiens
ggcgcgccagtcctaaaaatgcaagcatgtagagatgtgggatcagaagggttcaaaatgcaattgttagcacaagcattaaggccaggaaaaggaaaagggaatggacagccacaaaggtgttacaactgtggaaaaccgggacatcaagcaaggcaatgtagacaaggaatcatatgtcacaactgcgactcggaccgatg

SEQ ID NO: 4932 - DNA, 203 bp, Homo sapiens
ggcgcgccagtccttggaaagagaggacatatgcaaaaagaatgcagaggaaagagagacataaggggaaaacagcagggaaacgggaggagggggatacgtgtggtgccgtccgctcctcctatggaataacttcagcaccacctatggttcaggtccgcataggttcccagcagaggaacttgttacgactcggaccgatg

SEQ ID NO: 4933 - DNA, 203 bp, Homo sapiens
ggcgcgccagtcctgaaatcatagataaattagtggaagaaggaaaactaggaaaggcacccccacattggacatgtaatactccaatcttttgcataaaaaagaaatcagggaagtggagaatgttaatagatttcagagaattgaacaaacagacagaagatttaacagaagcgcagttaggactccgactcggaccgatg

SEQ ID NO: 4934 - DNA, 203 bp, Homo sapiens
ggcgcgccagtcctggacaattggcttggggagacaaagctatagaatatatagtgtatcaggagaaagggaaaccattatgggtaaatgtggttcacaatataaagaacctaagcatcccgcaacaggttattaaagcagcgcaaaaattaacccaagaagtcatcattaggacaggaaaaataccacgactcggaccgatg

SEQ ID NO: 4935 - DNA, 203 bp, Homo sapiens
ggcgcgccagtcctaattgggatgaagaagtaataaagaatccaattcaagcaagaattatggaaattgcccacaagaaagataggataggagtgcattgggtgccaggacataaagggattccccaaaatgaagaaatagacaaatatatttcggaaatatttcttgcaaaagaaggagaaggaattcgactcggaccgatg

SEQ ID NO: 4936 - DNA, 203 bp, Homo sapiens
ggcgcgccagtcctaaaacctggaccagaattacccttagcactatggatacatatagcagaaagcattaatggggatagctcatggtacataacaatgagactgcaacagatgatgtggggaaaaagaggaaataagttacaatataagaatgaagacagggaatatgaaaattgggaaattacatccgactcggaccgatg

SEQ ID NO: 4937 - DNA, 203 bp, Homo sapiens
ggcgcgccagtcctatggggatggaaaatgcacctaaggagagtgaaacaatggatacaagacaacaggagaggaagcccatggcagtacaaagtaggaggaacatggaaaagtataggagtgtggttcctgcaagcaggagattacagaaaggtagacaggcacttctggtgggcatggaggatactcgactcggaccgatg

SEQ ID NO: 4938 - DNA, 203 bp, Homo sapiens
ggcgcgccagtccttatatcaagagaattggccatggaatacatatcattggcctctctggcaaatggagaatgttaggtactggttaaaagaaaatatgcaagaaaatcaacagagaaaaaataatacaaaagagggtatagaggaattattagcaggaactataaggggaagattctgtgtaccatcgactcggaccgatg

SEQ ID NO: 4939 - DNA, 203 bp, Homo sapiens
ggcgcgccagtcctgagagagcatggcctttatgaatatcaaagcatgtgatagcaacctaaggtgtcagaaaagacctggagggtgtatggaaggataccctatcccagtaggagcagaaataatccctgaaagtatgaaatacctaaggggagcaaagagtcagtatgggggaataaaagataagacgactcggaccgatg

SEQ ID NO: 4940 - DNA, 203 bp, Homo sapiens
ggcgcgccagtcctgccagaacggcaaatggtgtaactacaccggggaaataaaattagggcaagaaacattccaatatcattacaagccaaactggaactgtaccgggaattggacgcaatatccggtgtggcaagtgattagaaacctggatatggtggaacatatgacaggagaatgtgtgcagacgactcggaccgatg

SEQ ID NO: 4941 - DNA, 203 bp, Homo sapiens
ggcgcgccagtcctaaatgccagaaaactatgcaaaaacaagaatcataaacaggaaaaaaagagaactcagccacaagaggaagaagagaggcgttggcttggtcattatgctagttatcatggcaatagtagctgccgcaggggcttctctgggagtcgcaaacgcgattcagcagtcttacactacgactcggaccgatg

SEQ ID NO: 4942 - DNA, 203 bp, Homo sapiens
ggcgcgccagtcctaggcagctgtccagacccttgctaatgcaactgctgcacagcaggatgtgttagaggcaacctatgccatggtacagcatgtggctaaaggcgtacgaatcttggaagctcgagtggctcgagtggaagctatcacagatagaataatgctataccaagaattggattgttggccgactcggaccgatg

SEQ ID NO: 4943 - DNA, 203 bp, Homo sapiens
ggcgcgccagtcctactatcatcaatactgtataacctctacaaaaacagaagtagcaaaatatatcaattggacgaggtttaaggataattgcacatggcagcagtgggagagaggattacaggggtatgatacaaacttaacaatactgttaaaggaatcagcagcaatgacacaactagcagaagcgactcggaccgatg

SEQ ID NO: 4944 - DNA, 203 bp, Homo sapiens
ggcgcgccagtcctagcaagcaaggaggataccagaagtatgggaaagtttaaaagacgtctttgattggtcaggatggttctcatggctaaagtatattcctattatagtagtaggattattaggatgcattctgataagagctgtgatatgtgtatgtcaacctcttgtgcagatatacagaactccgactcggaccgatg

SEQ ID NO: 4945 - DNA, 203 bp, Homo sapiens
ggcgcgccagtcctgtaacagctgacatatcagctgatgcttgctcatgctgacactgtagctctgagctgtatataaggagaagcttgctgcttgcacttcagagttctaggagagtccctcctagtctctcctctccgaggaggtaccgagacctcaaaataaaggagtgattgccttactgccgacgactcggaccgatg

SEQ ID NO: 4946 - DNA, 203 bp, Homo sapiens
ggcgcgccagtcctccgtggcggtggctgcgttggcggcctgcctacggggaaacccgtaggacgctctaatacagacatggtgcgaagagtctattgagctagttggtaatcctccggcccctgaatgcggctaatcctaactgcggagcacataccctcaaaccagggggcagtgtgtcgtaacggcgactcggaccgatg

SEQ ID NO: 4947 - DNA, 203 bp, Homo sapiens
ggcgcgccagtcctagaggttaaaacactacatctcatcattaaactaaatacaacaaaatgggggctcaagtatcaacacaaaagactggagcacatgagaccgggctgaatgcaagcgggaattccatcatccattacacaaacataaactactataaagatgctgcatccaactcagccaacagacgactcggaccgatg

SEQ ID NO: 4948 - DNA, 203 bp, Homo sapiens
ggcgcgccagtcctttgcccgtcatgacgacaccgggtagcacgcaatttctgacttctgatgatttccaatcgccatcagcaatgccacaattcgacgtcacaccagagatgcagatcccgggtcgtgtcaacaatctgatggaaatagctgaggtggactctgtggtcccagtgaacaacactgaccgactcggaccgatg

SEQ ID NO: 4949 - DNA, 203 bp, Homo sapiens
ggcgcgccagtcctaagaattaccactcaaggtcggaatcttccattgaaaatttcttgtgccgatctgcttgtgtgtattacgccacctacaataataattctgagaagggctacgcagagtgggttatcaacaccaggcaggttgcgcagttgctgaggaggaaactagagttcacttacttaaggcgactcggaccgatg

SEQ ID NO: 4950 - DNA, 203 bp, Homo sapiens
ggcgcgccagtcctacagaggggaatgccccaccgaggatgtctattcccttcatcagtattggaaatgcttatagctgcttttatgatggatggacacagttctctaggaatggggtttacggcattaataccctgaacaacatgggtacgctgtacatgcggcacgtaaatgaggcaggccaaggccgactcggaccgatg

SEQ ID NO: 4951 - DNA, 203 bp, Homo sapiens
ggcgcgccagtcctgtaactatgggaggggagggtgttgttggctttgccgacgtacgcgacctgctgtggttagaagatgatgcaatggagcagggggtcaaagattacgtagagcaacttggaaacgcctttgggtcaggattcactaaccaagtctgtgaacaggttaaccttttgaaagagtcccgactcggaccgatg

SEQ ID NO: 4952 - DNA, 203 bp, Homo sapiens
ggcgcgccagtcctctagtgggccaagactccatcttagaaaaatctctgaaagccctagtaaaaattgtgtcagccttggtgatagtcgtgaggaaccacgacgatttaataacagtgactgcaacacttgccctcattggctgcacctcctcaccatggagatggcttaagcaaaaggtgtcccagcgactcggaccgatg

SEQ ID NO: 4953 - DNA, 203 bp, Homo sapiens
ggcgcgccagtcctagacttaaacaacttccgttactggagagtcagattgccaccattgagcaaagtgcaccttctcagagtgatcaagagcaattgttttctaatgttcagtactttgcacattactgcaggaaatacgcacccctgtatgcggccgaagcaaaaagggtgttctcccttgagaagcgactcggaccgatg

SEQ ID NO: 4954 - DNA, 203 bp, Homo sapiens
ggcgcgccagtcctaaaatgagtaactacatacagttcaagtccaaatgccgtattgaacctgtatgcttgctcttgcacgggagtcctggtgcagggaagtcagttgccactaacctgattgggcgctcactcgcggagaagcttaatagctctgtgtactctctaccaccagacccagaccattttcgactcggaccgatg

SEQ ID NO: 4955 - DNA, 203 bp, Homo sapiens
ggcgcgccagtcctgacggttacaaacaacaggccgttgtgatcatggatgatttatgccagaacccagatggtaaggatgtttctttgttttgtcaaatggtctccagtgtggactttgtaccgccaatggcagcgctagaagagaaaggcattttgttcacctctccctttgtcctggcttcaacccgactcggaccgatg

SEQ ID NO: 4956 - DNA, 203 bp, Homo sapiens
ggcgcgccagtcctaacgccggctctattaatgctccaacagtttcagacagtagggcactggctaggaggtttcactttgatatgaacatcgaggtcatttccatgtacagccagaatgggaagataaacatgcctatgtcggtgaagacgtgtgatgaagagtgttgcccagtcaactttaagaaacgactcggaccgatg

SEQ ID NO: 4957 - DNA, 203 bp, Homo sapiens
ggcgcgccagtccttgctgccccttagtgtgtggaaaggctatccagtttatagatagaaggacacaagtcagatactcccttgacatgctggtaactgagatgttcagagaatataaccatagacatagtgttggggccacccttgaggcgctatttcagggcccgccaatatatagagagattaagcgactcggaccgatg

SEQ ID NO: 4958 - DNA, 203 bp, Homo sapiens
ggcgcgccagtcctatcagtattgcgccagagacgccaccaccacctgccattgcagatctactcaaatcagtagacagtgaggctgtgagggagtactgcaaagaaaaaggatggctggttccagagatcaactccaccctgcagattgaaaagcacgtcagtagggcctttatctgtttgcaagcacgactcggaccgatg

SEQ ID NO: 4959 - DNA, 203 bp, Homo sapiens
ggcgcgccagtcctcccaccaagagaatgcttatgtacaacttccccacgagggcaggtcagtgtggcggagtgctcatgtccactggcaaagttttggggatccatgttggcgggaatggtcatcaaggcttctcagcggcacttcttaaacactacttcaatgatgaacaaggagaaatcgagttccgactcggaccgatg

SEQ ID NO: 4960 - DNA, 203 bp, Homo sapiens
ggcgcgccagtcctattgaaagctcaaaggaagcagggttcccagtcatcaacacgcctagcaaaactaaattggagccaagtgtcttccaccaggtttttgaaggcaataaagagccagcagtcctcaggaatggcgatccacgcctcagagccaactttgaggaggccatattttccaaatacatccgactcggaccgatg

SEQ ID NO: 4961 - DNA, 203 bp, Homo sapiens
ggcgcgccagtcctatcatgacaccagcagacaaaggggattgcttcaatgaagtcacctgggctaatgtcacatttctaaagaggtattttagagcagatgaacagtacccctttttagtgcaccccgtcatgcctatgaaagacatacatgaatcaatcagatggaccaaggacccaaagaacacccgactcggaccgatg

SEQ ID NO: 4962 - DNA, 203 bp, Homo sapiens
ggcgcgccagtcctagcgtcccagttggagcttgcttgactctacctgcgttttcaactctacgcaggaagtggttggactctttttaaattagagacaatttgaactaattttaattggcttaaccctaccgcactaaccgaactagataacggtgcagtgggggtaaattctccgcattcggtgcgcgactcggaccgatg

SEQ ID NO: 4963 - DNA, 203 bp, Homo sapiens
ggcgcgccagtcctgatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatcgactcggaccgatg

SEQ ID NO: 4964 - DNA, 203 bp, Homo sapiens
ggcgcgccagtcctcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacacgactcggaccgatg

SEQ ID NO: 4965 - DNA, 203 bp, Homo sapiens
ggcgcgccagtcctgaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatcgactcggaccgatg

SEQ ID NO: 4966 - DNA, 203 bp, Homo sapiens
ggcgcgccagtcctaaaatgctctctacagagtctcataaccagacctttctcattgatggccccgaaacagcagaatgccccaacacaaatagagcttggaattcgttggaagttgaagactatggctttggagtattcaccaccaatatatggctaaaattgaaagaaaaacaggatgtattctgccgactcggaccgatg

SEQ ID NO: 4967 - DNA, 203 bp, Homo sapiens
ggcgcgccagtcctgactcaaaactcatgtcagcggccataaaagacaacagagccgtccatgccgatatgggttattggatagaaagtgcactcaatgacacatggaagatagagaaagcctctttcattgaagttaaaaactgccactggccaaaatcacacaccctctggagcaatggagtgctacgactcggaccgatg

SEQ ID NO: 4968 - DNA, 203 bp, Homo sapiens
ggcgcgccagtcctgtaggcgccactatgacggatgacataggtatgggcgtgacttatcttgccctactagcagccttcaaagtcagaccaacttttgcagctggactactcttgagaaagctgacctccaaggaattgatgatgactactataggaattgtactcctctcccagagcaccataccacgactcggaccgatg

SEQ ID NO: 4969 - DNA, 203 bp, Homo sapiens
ggcgcgccagtccttccgtttccccactgctcttaacatcctcacagcaaaaaacagattggataccattagcattgacgatcaaaggtctcaatccaacagctatttttctaacaaccctctcaagaaccagcaagaaaaggagctggccattaaatgaggctatcatggcagtcgggatggtgagccgactcggaccgatg

SEQ ID NO: 4970 - DNA, 203 bp, Homo sapiens
ggcgcgccagtcctattttagccagttctctcctaaaaaatgatattcccatgacaggaccattagtggctggagggctcctcactgtgtgctacgtgctcactggacgatcggccgatttggaactggagagagcagccgatgtcaaatgggaagaccaggcagagatatcaggaagcagtccaatccgactcggaccgatg

SEQ ID NO: 4971 - DNA, 203 bp, Homo sapiens
ggcgcgccagtcctctgtcaataacaatatcagaagatggtagcatgtcgataaaaaatgaagaggaagaacaaacactgaccatactcattagaacaggattgctggtgatctcaggactttttcctgtatcaataccaatcacggcagcagcatggtacctgtgggaagtgaagaaacaacgggcccgactcggaccgatg

SEQ ID NO: 4972 - DNA, 203 bp, Homo sapiens
ggcgcgccagtcctcataaaggaaagaggattgaaccatcatgggcggacgtcaagaaagacctaatatcatatggaggaggctggaagttagaaggagaatggaaggaaggagaagaagtccaggtattggcactggagcctggaaaaaatccaagagccgtccaaacgaaacctggtcttttcaaacgactcggaccgatg

SEQ ID NO: 4973 - DNA, 203 bp, Homo sapiens
ggcgcgccagtcctaccaacgccggaacaataggtgctgtatctctggacttttctcctggaacgtcaggatctccaattatcgacaaaaaaggaaaagttgtgggtctttatggtaatggtgttgttacaaggagtggagcatatgtgagtgctatagcccagactgaaaaaagcattgaagacaaccgactcggaccgatg

SEQ ID NO: 4974 - DNA, 203 bp, Homo sapiens
ggcgcgccagtcctactgacatttcagaaatgggtgccaatttcaaggctgagagggttatagaccccagacgctgcatgaaaccagtcatactaacagatggtgaagagcgggtgattctggcaggacctatgccagtgacccactctagtgcagcacaaagaagagggagaataggaagaaatccacgactcggaccgatg

SEQ ID NO: 4975 - DNA, 203 bp, Homo sapiens
ggcgcgccagtcctcgcttgagaggagaagcaaggaaaacctttgtagacttaatgagaagaggagacctaccagtctggttggcctacagagtggcagctgaaggcatcaactacgcagacagaaggtggtgttttgatggagtcaagaacaaccaaatcctagaagaaaacgtggaagttgaaatccgactcggaccgatg

SEQ ID NO: 4976 - DNA, 203 bp, Homo sapiens
ggcgcgccagtcctacatttgttacaccaatgttgagacatagcattgaaaattcctcagtgaatgtgtccctaacagctatagccaaccaagccacagtgttaatgggtctcgggaaaggatggccattgtcaaagatggacatcggagttccccttctcgccattggatgctactcacaagtcaaccgactcggaccgatg

SEQ ID NO: 4977 - DNA, 203 bp, Homo sapiens
ggcgcgccagtccttcatactattgtggaggactaaagaatgtaagagaagtcaaaggcctaacaaaaggaggaccaggacacgaagaacccatccccatgtcaacatatgggtggaatctagtgcgtcttcaaagtggagttgacgttttcttcatcccgccagaaaagtgtgacacattattgtgtcgactcggaccgatg

SEQ ID NO: 4978 - DNA, 203 bp, Homo sapiens
ggcgcgccagtcctgcagagtggctttggaaagaattagggaagaaaaagacacccaggatgtgcaccagagaagaattcacaagaaaggtgagaagcaatgcagccttgggggccatattcactgatgagaacaagtggaagtcggcacgtgaggctgttgaagatagtaggttttgggagctggttcgactcggaccgatg

SEQ ID NO: 4979 - DNA, 203 bp, Homo sapiens
ggcgcgccagtcctgaagatcactggttctccagagagaactccctgagtggagtggaaggagaagggctgcacaagctaggttacattctaagagacgtgagcaagaaagagggaggagcaatgtatgccgatgacaccgcaggatgggatacaagaatcacactagaagacctaaaaaatgaagaacgactcggaccgatg

SEQ ID NO: 4980 - DNA, 203 bp, Homo sapiens
ggcgcgccagtcctatggtaacaaaccacatggaaggagaacacaagaaactagccgaggccattttcaaactaacgtaccaaaacaaggtggtgcgtgtgcaaagaccaacaccaagaggcacagtaatggacatcatatcgagaagagaccaaagaggtagtggacaagttggcacctatggactccgactcggaccgatg

SEQ ID NO: 4981 - DNA, 203 bp, Homo sapiens
ggcgcgccagtcctaaacctttagatgacaggttcgcaagcgctttaacagctctaaatgacatgggaaagattaggaaagacatacaacaatgggaaccttcaagaggatggaatgattggacacaagtgcccttctgttcacaccatttccatgagttaatcatgaaagacggtcgcgtactcgttcgactcggaccgatg

SEQ ID NO: 4982 - DNA, 203 bp, Homo sapiens
ggcgcgccagtccttggtagaaagcaaaactaacatgaaacaaggctagaagtcaggtcggattaagccatagtacggaaaaaactatgctacctgtgagccccgtccaaggacgttaaaagaagtcaggccatcataaatgccatagcttgagtaaactatgcagcctgtagctccacctgagaaggcgactcggaccgatg

SEQ ID NO: 4983 - DNA, 203 bp, Homo sapiens
ggcgcgccagtccttgtaaaaaatccgggaggccacaaaccatggaagctgtacgcatggcgtagtggactagcggttagaggagacccctcccttacaaatcgcagcaacaatgggggcccaaggcgagatgaagctgtagtctcgctggaaggactagaggttagaggagacccccccgaaacaaacgactcggaccgatg

SEQ ID NO: 4984 - DNA, 203 bp, Homo sapiens
ggcgcgccagtcctacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaacgactcggaccgatg

SEQ ID NO: 4985 - DNA, 203 bp, Homo sapiens
ggcgcgccagtcctgaaggagatctcaaacatgctgagcataatcaaccaacggaaaaagacatcgctctgtctcatgatgatattgccagcagcacttgctttccacttgacttcacgagatggagagccgcgcatgattgtggggaagaatgaaagaggtaaatccctactttttaagacagcctccgactcggaccgatg

SEQ ID NO: 4986 - DNA, 203 bp, Homo sapiens
ggcgcgccagtcctacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttctcgcccattacataggcgactcggaccgatg

SEQ ID NO: 4987 - DNA, 203 bp, Homo sapiens
ggcgcgccagtcctcacttccctgacccagaaggtggttattttcatattattaatgctggtcaccccatccatgacaatgagatgtgtgggagtaggaaacagagattttgtggaagggctatcaggagctacgtgggttgacgtggtgctcgagcacggggggtgtgtgactaccatggctaagaacgactcggaccgatg

SEQ ID NO: 4988 - DNA, 203 bp, Homo sapiens
ggcgcgccagtcctatacgtagacagaggttgggggaacggttgtggtttgtttggcaaaggaagcttggtaacatgtgcgaaatttcaatgcctggaaccaatagagggaaaagtggtgcaatatgagaacctcaaatacaccgtcatcattacagtgcacacaggagaccaacaccaggtgggaaacgactcggaccgatg

SEQ ID NO: 4989 - DNA, 203 bp, Homo sapiens
ggcgcgccagtcctgaaaatcaactggtacaagaaggggagctcgattgggaagatgttcgaggccactgaaaggggtgcaaggcgcatggccatcttgggagacacagcttgggactttggatcagtgggtggtgttctgaactcattaggcaaaatggtgcaccaaatatttggaagtgcttataccgactcggaccgatg

SEQ ID NO: 4990 - DNA, 203 bp, Homo sapiens
ggcgcgccagtcctgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtctacacccaactatgtgaccatagcgactcggaccgatg

SEQ ID NO: 4991 - DNA, 203 bp, Homo sapiens
ggcgcgccagtcctgctaatgtcggcagctgtcaaggatgagagggccgtgcatgccgacatgggctactggatagaaagccaaaagaatggaagttggaagctagaaaaagcatccctcatagaggtaaaaacctgcacatggccaaaatcacacactctctggactaatggtgtgctagagagtgacgactcggaccgatg

SEQ ID NO: 4992 - DNA, 203 bp, Homo sapiens
ggcgcgccagtcctgagaacaacaacagtgtcagggaagttgatacacgaatggtgttgccgctcgtgcacacttccccccctgcgatacatgggagaagacggctgctggtatggcatggaaatcagacccatcagtgagaaagaagagaacatggtaaagtctttagtctcagcgggaagtggaaacgactcggaccgatg

SEQ ID NO: 4993 - DNA, 203 bp, Homo sapiens
ggcgcgccagtcctcagttctctccttagaaatgatgtgcccatggctggaccattagtggccgggggcttgctgatagcgtgctacgtcataactggcacgtcagcggacctcactgtagaaaaagccccagatgtaacatgggaggaagaggctgagcagacaggagtgtcccacaacttaatgatcgactcggaccgatg

SEQ ID NO: 4994 - DNA, 203 bp, Homo sapiens
ggcgcgccagtcctgaaaagactggaaccaaactgggctagtgtgaaaaaagatctgatttcatatggaggaggatggagactgagcgcacaatggcaaaagggggaggaggtgcaggttattgccgtagagccagggaagaacccaaagaactttcaaaccacgccaggcactttccagactactaccgactcggaccgatg

SEQ ID NO: 4995 - DNA, 203 bp, Homo sapiens
ggcgcgccagtcctgttggaagaagagatgttcaaaaagcgaaacctgaccataatggatcttcatcctgggtcaggaaagacacggaaataccttccagctattgtcagagaggcaatcaagagacgtttaagaaccttaattttggcaccgacaagggtggttgcagctgagatggaagaagcattcgactcggaccgatg

SEQ ID NO: 4996 - DNA, 203 bp, Homo sapiens
ggcgcgccagtcctgaaagggctcccaataaggtaccaaacaacagcaacaaaatctgaacacacaggaagagagattgttgatctaatgtgccacgcaacgttcacaatgcgtttgctgtcaccagttagggttccaaattacaacttgataataatggatgaggcccatttcacagacccagccagcgactcggaccgatg

SEQ ID NO: 4997 - DNA, 203 bp, Homo sapiens
ggcgcgccagtccttatagcggctagagggtacatatcaactcgtgttggaatgggagaggcagccgcaatcttcatgacagcaacaccccctggaacagctgatgcctttcctcagagcaacgctccaattcaagatgaagaaagggacataccagaacgctcatggaattcaggcaatgaatggatcgactcggaccgatg

SEQ ID NO: 4998 - DNA, 203 bp, Homo sapiens
ggcgcgccagtccttaccgacttcgctgggaaaacggtgtggtttgtccctagcattaaagccggaaatgacatagcaaactgcttgcgaaaaaacgggaaaaaagtcattcaacttagtaggaagacttttgacacagaatatcagaagactaaactgaatgattgggactttgtggtgacaactgacgactcggaccgatg

SEQ ID NO: 4999 - DNA, 203 bp, Homo sapiens
ggcgcgccagtcctgaagggtgagtccaggaagactttcgtggaactcatgaggaggggtgaccttccagtttggttagcccataaagtagcatcagaaggaatcaaatacacagatagaaaatggtgctttgatgggcaacgcaataatcaaattttagaggagaacatggatgtggaaatttggaccgactcggaccgatg

SEQ ID NO: 5000 - DNA, 203 bp, Homo sapiens
ggcgcgccagtcctaaaggaaggagaaaagaaaaaattgagacctaggtggcttgatgcccgcacttattcagatccattggcactcaaggaattcaaggactttgcggctggcagaaagtcaatcgcccttgatcttgtgacagaaataggaagagtgccttcacatctagcccacagaacaagaaacgactcggaccgatg

SEQ ID NO: 5001 - DNA, 203 bp, Homo sapiens
ggcgcgccagtcctcgctctggacaatctggtgatgctgcatacgtcagaagatggcggtagggcttacaggcatgcggtggaggaactaccagaaacaatggaaacactcctactcttgggactaatgatcttgttgacaggtggagcaatgcttttcttgatatcaggtaaagggattggaaagaccgactcggaccgatg

SEQ ID NO: 5002 - DNA, 203 bp, Homo sapiens
ggcgcgccagtcctatttgaaaaacaactgggacaggttatgctcctggttttgtgcgcagtccaactcttgctaatgagaacatcatgggccttgtgtgaagctttaactctagctacaggaccaataacaacactctgggaaggatcacctggtaagttctggaacaccacgatagctgtttccatcgactcggaccgatg

SEQ ID NO: 5003 - DNA, 203 bp, Homo sapiens
ggcgcgccagtcctggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatccgactcggaccgatg

SEQ ID NO: 5004 - DNA, 203 bp, Homo sapiens
ggcgcgccagtccttggaatcactgaagtggatagaacagaagccaaagaagggttgaaaagaggagagacaacacatcatgccgtgtcccgaggtagcgcaaaacttcaatggtttgtggaaagaaacatggtcgttcccgaaggaagagtcatagacttgggctgtggaagaggaggctggtcatacgactcggaccgatg

SEQ ID NO: 5005 - DNA, 203 bp, Homo sapiens
ggcgcgccagtcctttactgtgcaggactgaaaaaagtcacagaagtgcgaggatacacaaaaggcggtccaggacacgaagaaccagtacctatgtctacatatggatggaacatagttaagttaatgagcggaaaggatgtgttctatctcccacctgaaaagtgtgataccctgttgtgtgacatcgactcggaccgatg

SEQ ID NO: 5006 - DNA, 203 bp, Homo sapiens
ggcgcgccagtcctgagaaatccactttcacgaaactccacgcacgaaatgtactggatatctaatggcacaggtaacattgtctcttcagtcaacatggtgtctagattgctactgaacaggttcacgatgacacacaggagacccaccatagagaaagatgtggatttaggagcaggaactcgacacgactcggaccgatg

SEQ ID NO: 5007 - DNA, 203 bp, Homo sapiens
ggcgcgccagtcctacagcaaatggaccctgaacacaggcagttagcgaacgctatattcaagctcacataccaaaacaaagtggtcaaagttcaacgaccgactccaacgggcacggtaatggatattatatctaggaaagaccaaaggggcagtggacaactgggaacttatggcctgaatacattcgactcggaccgatg

SEQ ID NO: 5008 - DNA, 203 bp, Homo sapiens
ggcgcgccagtcctccactgggttcccacaagtagaacgacatggtctattcatgctcaccatcagtggatgactacagaagacatgcttactgtttggaacagggtgtggatagaggaaaatccatggatggaagacaaaactccagttacaacttgggaaaatgttccatatctaggaaagagagacgactcggaccgatg

SEQ ID NO: 5009 - DNA, 203 bp, Homo sapiens
ggcgcgccagtcctagaccaatggtgtggatcacttattggtctcacttccagagcaacctgggcccagaacatacccacagcaattcaacaggtgagaagccttataggcaatgaagagttcctggactacatgccttcaatgaagagattcaggaaggaagaggagtcggagggagccatttggtacgactcggaccgatg

SEQ ID NO: 5010 - DNA, 203 bp, Homo sapiens
ggcgcgccagtcctaacgtaggaagtggaaaagaggctaactgtcaggccaccttaagccacagtacggaagaagctgtgctgcctgtgagccccgtccaaggacgttaaaagaagaagtcaggccccaaagccacggtttgagcaaaccgtgctgcctgtagctccgtcgtggggacgtaaaacctgcgactcggaccgatg

SEQ ID NO: 5011 - DNA, 203 bp, Homo sapiens
ggcgcgccagtcctagcactgagggaagctgtacctccttgcaaaggactagaggttagaggagaccccccgcaaataaaaacagcatattgacgctgggagagaccagagatcctgctgtctcctcagcatcattccaggcacagaacgccagaaaatggaatggtgctgttgaatcaacaggttctcgactcggaccgatg

SEQ ID NO: 5012 - DNA, 203 bp, Homo sapiens
ggcgcgccagtcctaacatccatcacccagaaagggatcatttttattttgctgatgctggtaactccatccatggccatgcggtgcgtgggaataggcaacagagacttcgtggaaggactgtcaggagctacgtgggtggatgtggtactggagcatggaagttgcgtcactaccatggcaaaagacgactcggaccgatg

SEQ ID NO: 5013 - DNA, 203 bp, Homo sapiens
ggcgcgccagtccttgagaccacagaacatggaacaactgcaaccataacacctcaagctcccacgtcggaaatacagctgacagactacggagctctaacattggattgttcacctagaacagggctagactttaatgagatggtgttgttgacaatgaaaaaaaaatcatggctcgtccacaaacacgactcggaccgatg

SEQ ID NO: 5014 - DNA, 203 bp, Homo sapiens
ggcgcgccagtcctatctcttagaaccacaacagtcacaggaaagacaatccatgaatggtgctgtagatcttgcacgttaccccccctacgtttcaaaggagaagacgggtgctggtacggcatggaaatcagaccagtcaaggagaaggaagagaacctagttaagtcaatggtctctgcagggtccgactcggaccgatg

SEQ ID NO: 5015 - DNA, 203 bp, Homo sapiens
ggcgcgccagtccttcttctaagttcacttctcaagaatgatgtgccactagctggcccactaatagctggaggcatgctaatagcatgttatgtcatatctggaagctcggccgatttatcactggagaaagcggctgaggtctcctgggaagaagaagcagaacactctggtgcctcacacaacatcgactcggaccgatg

SEQ ID NO: 5016 - DNA, 203 bp, Homo sapiens
ggcgcgccagtcctccctgaaggcgaagttggagccatagctctagactttaaacccggcacatctggatctcctatcgtgaacagagagggaaaaatagtaggtctttatggaaatggagtggtgacaacaagtggtacctacgtcagtgccatagctcaagctaaagcatcacaagaagggcctctcgactcggaccgatg

SEQ ID NO: 5017 - DNA, 203 bp, Homo sapiens
ggcgcgccagtcctaccagagattgaggacgaggtgtttaggaaaagaaacttaacaataatggacctacatccaggatcgggaaaaacaagaagataccttccagccatagtccgtgaggccataaaaagaaagctgcgcacgctagtcttagctcccacaagagttgtcgcttctgaaatggcagacgactcggaccgatg

SEQ ID NO: 5018 - DNA, 203 bp, Homo sapiens
ggcgcgccagtcctaacagacatatccgaaatgggagcaaacttccgagccgacagggtaatagacccgaggcggtgcctgaaaccggtaatactaaaagatggcccagagcgtgtcattctagcgggaccgatgccagtgactgtggctagcgccgcccagaggagaggaagaattggaaggaaccacgactcggaccgatg

SEQ ID NO: 5019 - DNA, 203 bp, Homo sapiens
ggcgcgccagtcctggtgataggtctgttattcatgatattgacagtggcagccaatgagatgggattactggaaaccacaaagaaggacctggggattggtcatgcagctgctgaaaaccaccatcatgctgcaatgctggacgtagacctacatccagcttcagcctggactctctatgcagtggccgactcggaccgatg

SEQ ID NO: 5020 - DNA, 203 bp, Homo sapiens
ggcgcgccagtcctcatggtcaatggtgtggtgagactgctaaccaaaccatgggatgtcattcccatggtcacacaaatagccatgactgacaccacaccctttggacaacagagggtgtttaaagagaaagttgacacgcgtacaccaaaagcgaaacgaggcacagcacaaattatggaggtgaccgactcggaccgatg

SEQ ID NO: 5021 - DNA, 203 bp, Homo sapiens
ggcgcgccagtccttccagttgattgggtcccaaccagccgcaccacctggtcgatccatgcccaccatcaatggatgacaacagaagacatgttgtcagtgtggaatagggtttggatagaggaaaacccatggatggaggacaagactcatgtgtccagttgggaagacgttccatacctaggaaacgactcggaccgatg

SEQ ID NO: 5022 - DNA, 203 bp, Homo sapiens
ggcgcgccagtcctgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgccccgactcggaccgatg

SEQ ID NO: 5023 - DNA, 203 bp, Homo sapiens
ggcgcgccagtcctacactgcttcagaaaagatcctggcggtggaaaggtactacaccttcaaggttaatgattggacatcaacacaaaagccctttgagtacatccgcattccccttcctcacgtcctgtccggtgaagatggtggtgtctttggtgcggccctccgccggcactacctggtgaaaacgactcggaccgatg

SEQ ID NO: 5024 - DNA, 203 bp, Homo sapiens
ggcgcgccagtcctctggatggcgggtgcaagttcagtgcaacgcctctcaattccacgctggaggtttgctggtgttcatggcaccagagtatccaaccttagatgcttttgccatggacaaccgttggtccaaggataacctgcctaatggaaccagaactcagacaaacaaaaagggaccatttgcgactcggaccgatg

SEQ ID NO: 5025 - DNA, 203 bp, Homo sapiens
ggcgcgccagtcctatggcaagactcctgttgctccatccaattacatggtaggcgaatacaaggacttcctggagatagctcagattccaacctttattgggaataagatccctaatgctgtcccctacattgaggcatccaacacagccgtcaagacccaaccgctggccacctatcaagtgacctcgactcggaccgatg

SEQ ID NO: 5026 - DNA, 203 bp, Homo sapiens
ggcgcgccagtccttgtcctgctcctgtctggccaatacattcttggccgctttgtctagaaactttgctcagtaccggggatcattggtttatacctttgtgttcactgggaccgcgatgatgaagggcaagttcctcattgcctacaccccacctggagcgggcaagcccactagtcgagaccaagcgactcggaccgatg

SEQ ID NO: 5027 - DNA, 203 bp, Homo sapiens
ggcgcgccagtcctgatgcccgacctctgctaagatactaacaatggtgagcgcagggaaggatttctcactcaagatgcctatctcacctgccccctggagccctcagggagtagaaaacgctgaaaaaggggtcactgaaaacacaaacgcaactgctgactttgtggctcaaccagtttacttgccgactcggaccgatg

SEQ ID NO: 5028 - DNA, 203 bp, Homo sapiens
ggcgcgccagtcctcttttagactgcccctggttcagaaggaatggcccgtgcgagaggagaacgttttcggtttgtaccggatcttcaatgcccactacgctggttactttgcggacctactgattcatgacattgagacaaatccagggcccttcatgtttagaccaaggaaacaggttttccagacgactcggaccgatg

SEQ ID NO: 5029 - DNA, 203 bp, Homo sapiens
ggcgcgccagtcctaaacactaaacaacccagagttctggaagcagctcttgagcagatgtgtgcagctgattgcagggatgacaatagcagtgatgcatccggaccctttgactctgctctgcttaggaacattgacggccgccgagattacaagccagacaagtctgtgcgaagaaatagcagctacgactcggaccgatg

SEQ ID NO: 5030 - DNA, 203 bp, Homo sapiens
ggcgcgccagtcctaggaaaaggaacagaccctagatcagctcttgcagcgtttccccgaacatgcgaagcgcatttctgatctccggaatggaatggccgcctatgtagagtgcaaggagagttttgatttctttgaaaagctgtacaatcaggcagtgaaagagaagagaacgggtatcgccgccgcgactcggaccgatg

SEQ ID NO: 5031 - DNA, 203 bp, Homo sapiens
ggcgcgccagtcctctcttccatgcttccagaataactgccttttccttgagaaagctgggctccagttcagagataaccgaactaaagagatcatttccctggtagatgtgattgagagagccgtggctaggattgaaaggaagaagaaagttctcacaaccgtgcagacccttgtggcacaaggtccgactcggaccgatg

SEQ ID NO: 5032 - DNA, 203 bp, Homo sapiens
ggcgcgccagtcctcagtagacgaggtcagtttccattccgtagtccagcagcttaaagcaagacagcaagcgacagatgaacagcttgaggaattgcaagaggctttcgcgaaagtacaggagcgtaactctgtgttttctgattggttgaagatttctgcaatgttgtgtgctgcgactctggcaccgactcggaccgatg

SEQ ID NO: 5033 - DNA, 203 bp, Homo sapiens
ggcgcgccagtcctaatatgtagccaaacatgtaaccgcccccattggttttgtctaccccactggggtgagcacccagacttgcctccttgtgagaggccgcaccttggtagtaaatagacacatggccgagtctgactggacttccatagtagtgcgtggagtcacacacgcccgctctactgttacgactcggaccgatg

SEQ ID NO: 5034 - DNA, 203 bp, Homo sapiens
ggcgcgccagtcctaaattttggccatagctaaagcaggcaaagagactgacgtatctttcatccgcctctcttctggtcctctattcagagacaatacatccaaatttgtcaaggctggtgatgtacttcctactggtgccgctccagtcacggggataatgaacacggacatacccatgatgtacacgactcggaccgatg

SEQ ID NO: 5035 - DNA, 203 bp, Homo sapiens
ggcgcgccagtcctctttggaaggactggaggggatggaccccatggacaggaacacctccccggggcttccatatactgcgctaggaatgcgcagaacagatgtcgtagattgggaatcagccaccctgatcccgtttgcggcagaaagattaagaaaaatgaatgaaggagacttttccgaagttgcgactcggaccgatg

SEQ ID NO: 5036 - DNA, 203 bp, Homo sapiens
ggcgcgccagtcctccattgtaagagtatataaccagtgctttgtgaaacttcgaggagtctctttgttgaggacttttgagttctcccttgaggctcccacagatacaataaatatttgagattgaaccctgtcgagtatctgtgtaatcttttttacctgtgaggtctcggaatccgggccgagaacgactcggaccgatg

SEQ ID NO: 5037 - DNA, 203 bp, Homo sapiens
ggcgcgccagtcctggatcaggaccagtgtgttttaattgtaaaaaaccaggacatctagcaagacaatgtagagaagtgaaaaaatgtaataaatgtggaaaacctggtcatgtagctgccaaatgttggcaaggaaatagaaagaattcgggaaactggaaggcggggcgagctgcagccccagtgcgactcggaccgatg

SEQ ID NO: 5038 - DNA, 203 bp, Homo sapiens
ggcgcgccagtccttaacagaaatagtagaaagactagaaagagaagggaaagtaaaaagagcagatccaaataatccatggaatacaccagtatttgctataaaaaagaaaagtggaaaatggagaatgctcatagattttagagaattaaacaaactaactgagaaaggagcagaggtccagttggcgactcggaccgatg

SEQ ID NO: 5039 - DNA, 203 bp, Homo sapiens
ggcgcgccagtccttatatgctaaattaagtttggtgggaccacatcaaataagttatcaagtatatcagaaggatccagaaaagatactatggtatggaaaaatgagtagacaaaagaaaaaggcagaaaatacatgtgatatagccttaagagcatgctataagataagagaagagtctattataacgactcggaccgatg

SEQ ID NO: 5040 - DNA, 203 bp, Homo sapiens
ggcgcgccagtcctgaataggaaaagaaccaagatatgaaatacctacttctagagaagcctgggaatcaaatttaattaattcaccatatcttaaggccccacctcctgaggtagaatatatccatgctgctttgaatataaagagagcgttaagtatgataaaagatgctccaataccaggagcagcgactcggaccgatg

SEQ ID NO: 5041 - DNA, 203 bp, Homo sapiens
ggcgcgccagtcctaaacatggtatatagatggaggtagaaagctaggaaaagcagcaaaagcagcctattggacagatacaggaaagtggcaagtgatggaattagaaggcagtaatcagaaggcagaaatacaagcattattattggcattaaaagcaggatcagaggagatgaatattataacagcgactcggaccgatg

SEQ ID NO: 5042 - DNA, 203 bp, Homo sapiens
ggcgcgccagtcctaagctgtcttacaattgttgagtgctcataatgttactgaattacaaacagataatggaccaaattttaaaaatcaaaagatggaaggagtactcaattacatgggtgtgaaacataagtttggtatcccagggaacccacagtcacaagcattagttgaaaatgtaaatcatacgactcggaccgatg

SEQ ID NO: 5043 - DNA, 203 bp, Homo sapiens
ggcgcgccagtccttcaggtagtatggagacttccaccattagtagtcccagtagaagaatcagaaataattttttgggattgttgggcaccagaagaacccgcctgtcaggactttcttggggcaatgatacatctaaaagctaagacaaatataagtatacgagagggacctaccttggggaattgcgactcggaccgatg

SEQ ID NO: 5044 - DNA, 203 bp, Homo sapiens
ggcgcgccagtccttgaaagtaaaaaggtgaaaatatctctacagtgcaatagcacaaaaaacctaacctttgcaatgagaagttcaggagattatggagaagtaacgggagcttggatagagtttggatgtcatagaaataaatcaaaacttcatgctgaagcaaggtttagaattagatgtagatgcgactcggaccgatg

SEQ ID NO: 5045 - DNA, 203 bp, Homo sapiens
ggcgcgccagtccttaaagcgctagcagctgcctaaccgcaaaaccacatcctatggaaagcttgctaatgacgtataagttgttccattgtaagagtatataaccagtgctttgtgaaacttcgaggagtctctttgttgaggacttttgagttctcccttgaggctcccacagatacaataaatatcgactcggaccgatg

SEQ ID NO: 5046 - DNA, 203 bp, Homo sapiens
ggcgcgccagtcctagaaaaaaatagacctcacccttacccacttcccctagcgctgaaaaacaaggctctgacgattaccccctgcccataaaatttgcctagtcaaaataaaagatgccgagtctataaaagcgcaaggacagttcaggaggtggctcgctccctcaccgaccctctggtcacggacgactcggaccgatg

SEQ ID NO: 5047 - DNA, 203 bp, Homo sapiens
ggcgcgccagtcctgtttccgcctgcgctcggctagactctgccttaaacttcacttccgcgttcttgtctcgttctttcctcttcgccgtcactgaaaacgaaacctcaacgccgccctcttggcaggcgtcccggggccaacatacgccgtggagcgcagcaagggctagggcttcctgaacctctcgactcggaccgatg

SEQ ID NO: 5048 - DNA, 203 bp, Homo sapiens
ggcgcgccagtcctccgggagaggtctattgctataggcaggcccgccctaggagcattgtcttcccggggaagacaaacaattgggggctcgtccgggatttgaattcctccattctcacattatgggacaaatccacgggctttccccaactccaatacccaaagcccccagggggctatcaaccccgactcggaccgatg

SEQ ID NO: 5049 - DNA, 203 bp, Homo sapiens
ggcgcgccagtccttggctgctttctccaccctgccaggcaatacccgtgacccctcttgggcagctatcctacaggggctggaggaaccctattgcgcgttcgtagagcgccttaacgtggcccttgacaacggcctccccgagggtacccccaaagagcccatcttacgttccctagcgtactcaacgactcggaccgatg

SEQ ID NO: 5050 - DNA, 203 bp, Homo sapiens
ggcgcgccagtcctacgccaacaaagaatgccaaaaaatcttacaagcccgcggacacactaacagcccccttggggagatgctccggacatgtcaggcgtggacacccaaggacaaaaccaaggtccttgtggtccaaccacggaggcccccccccacacagccctgctttcgttgtggcaaggtagcgactcggaccgatg

SEQ ID NO: 5051 - DNA, 203 bp, Homo sapiens
ggcgcgccagtcctccttaaggggggagatctaatctccccccatcccgatcaagacatctcgatactcccactcatccccctgcggcagcaacagcaaccaattctaggggtccggatctccgttatgggacaaacacctcagcctacccaagcgctacttgacacaggagccgaccttacggttatcgactcggaccgatg

SEQ ID NO: 5052 - DNA, 203 bp, Homo sapiens
ggcgcgccagtcctaccccagacactcgtgcccgggccggtaaagctccacgacaccctgatcctaggcgccagtgggcaaaccaacacccagttcaaactcctccaaacccccctacacatattcttgcccttccgaaggtcccccgttatcctttcctcctgcctcttagacacccacaacaaatgcgactcggaccgatg

SEQ ID NO: 5053 - DNA, 203 bp, Homo sapiens
ggcgcgccagtcctgaccatcattggaagggacgccctacaacaatgccaggggcttctatacctcccagacgaccccagcccccaccaattgctgccaatagccactccaaacaccataggcctcgaacaccttcccccacctccccaagtggaccaatttcctttaaacctgagcgcctccaggcccgactcggaccgatg

SEQ ID NO: 5054 - DNA, 203 bp, Homo sapiens
ggcgcgccagtcctttaaatgacctggtctccaaggccctggaggctggtcacattgaaccatactcaggaccaggcaataaccccgtcttccccgttaaaaaaccaaatggtaaatggaggttcattcatgacctaagagccaccaatgccattactaccaccctcacctctccttccccagggccccgactcggaccgatg

SEQ ID NO: 5055 - DNA, 203 bp, Homo sapiens
ggcgcgccagtcctcccgatctcactagcctaccgacagccttaccccacctacagaccatagatcttactgacgcctttttccaaatccccctccccaagcagtaccagccatacttcgccttcaccattccccagccatgtaactatggccccgggaccagatatgcatggactgtccttccacagcgactcggaccgatg

SEQ ID NO: 5056 - DNA, 203 bp, Homo sapiens
ggcgcgccagtcctgtctctaaaggaacacccatccttcgcaaacacctacaatccctatattctgcccttcacgggtaccgggacccaagagcttgtatcaccctcaccccacaacaactccatgcgttacatgccattcaacaagctctacaacataactgccgtggccgcctcaaccccgccctacgactcggaccgatg

SEQ ID NO: 5057 - DNA, 203 bp, Homo sapiens
ggcgcgccagtcctcctctccttggcctcatctcgttaagtacatctggtacaacatctgtcatctttcaacccaagcaaaattggcccctggcttggctccacaccccccaccctccgaccagtttatgtccttggggtcacctactggcctgcaccatcttaactctagacaaatataccctacaacgactcggaccgatg

SEQ ID NO: 5058 - DNA, 203 bp, Homo sapiens
ggcgcgccagtcctcattatggccagctctgccaatctttccaccacaacatgtcaaagcaagccctttgcgacttcctgaggaactcccctcatccaagtgtcggcatcctcattcaccacatgggtcgattccataaccttggcagccaaccgtctggtccgtggaagactctcttacacctcccacgactcggaccgatg

SEQ ID NO: 5059 - DNA, 203 bp, Homo sapiens
ggcgcgccagtcctcccctactgcagggcaagaccatctacctccaccatgtccgcagccacaccaacctccccgacccaatttccaccttcaatgaatacacagactcccttatcttagctccccttgttcccctgacgccccaaggcctccacggcctcacccattgcaatcaaagggctctagtccgactcggaccgatg

SEQ ID NO: 5060 - DNA, 203 bp, Homo sapiens
ggcgcgccagtcctctaaatgtcatgaaccccagtggtaaaacccgatggcaaatccaccacagtcctccactaccacccattcctgaagcctctacccctcccaaaccacctcccaaatggttctattataaactccccggccttaccaatcagcggtggaaaggtccattgcaatccctccaggaacgactcggaccgatg

SEQ ID NO: 5061 - DNA, 203 bp, Homo sapiens
ggcgcgccagtcctgcggccggggcagccttgctctccatagacggctccccccggtggatcccgtggcgattcctgaaaaaagctgcatgcccaagaccagacgccagcgaactcgccgagcacgccgcaacagaccaccaacaccatgggtaatgttttcttcctacttttattcagtctcacacacgactcggaccgatg

SEQ ID NO: 5062 - DNA, 203 bp, Homo sapiens
ggcgcgccagtcctgtttcattcagatgtaaatttcacccaggaagtcagccaagtgtcccttcgactacacttctctaagtgcggctcctccatgaccctcctagtagatgcccctggatatgatcctttatggttcatcacctcagaacccactcagcctccaccaacttctcccccattggtccacgactcggaccgatg

SEQ ID NO: 5063 - DNA, 203 bp, Homo sapiens
ggcgcgccagtcctaacctcctcccgaaccatcctctttccttcccttgccctgcccgctcctccatcccaacccttcccttggacccattgctaccaacctcgcctacaggcgataacaacagataactgcaacaactccattatcctcccccctttttccctcgctcccgtacctcctccggcgaccgactcggaccgatg

SEQ ID NO: 5064 - DNA, 203 bp, Homo sapiens
ggcgcgccagtcctaagacgccgccgtgccgttccaatagcagtgtggcttgtctccgccctagcggccggaacaggtatcgctggtggagtaacaggctccctatctctggcttccagtaaaagccttctcctcgaggttgacaaagacatctcccaccttacccaggccatagtcaaaaatcatcacgactcggaccgatg

SEQ ID NO: 5065 - DNA, 203 bp, Homo sapiens
ggcgcgccagtcctaaacatcctccgggttgcacagtatgcagcccaaaatagacgaggattagacctcctattctgggaacaagggggtttgtgcaaggccatacaggagcaatgttgcttcctcaacatcagtaacactcatgtatccgtcctccaggaacggccccctcttgaaaaacgtgtcatcgactcggaccgatg

SEQ ID NO: 5066 - DNA, 203 bp, Homo sapiens
ggcgcgccagtcctcgctcacattcctcccataggaccttcttttccccttcaggaaatccacataaccctgaagcaagtcacaaaacccatcaaaacccaggagtcctatacactccaactgctgatgcctttcttccctctcccggcgcttttgatccttttcccgcaggcgctcctttctgcgcccgactcggaccgatg

SEQ ID NO: 5067 - DNA, 203 bp, Homo sapiens
ggcgcgccagtcctggtctatgttccacccgcctacatcgacatgccctcctggccacctgtccagagcaccaactcacctgggaccccatcgatggacgcgttgtcagctctcctctccaataccttatccctcgcctcccctccttccccacccagagaacctcaaggaccctcaaggtccttacccgactcggaccgatg

SEQ ID NO: 5068 - DNA, 203 bp, Homo sapiens
ggcgcgccagtcctcctcccaccactcctgtctcccccaaggttccacctgccttctttcaatcaatgcgaaagcacaccccctaccgaaatggatgcctggaaccaaccctcggggatcagctcccctccctcgccttccccgaacctggcctccgtccccaaaacatctacaccacctggggaaaacgactcggaccgatg

SEQ ID NO: 5069 - DNA, 203 bp, Homo sapiens
ggcgcgccagtcctcagccatctttagtagttcagtcctccctattaatcttcgaaaaattcgaaaccaaagccttccatccctcctatctactctctcatcagcttatacaatactcctccttccataaccttcaccttctattcgatgaatacaccaacatccctgtctctattttatttaataaacgactcggaccgatg

SEQ ID NO: 5070 - DNA, 203 bp, Homo sapiens
ggcgcgccagtcctaacagctctccagaaaaaaatagacctcacccttacccacttcccctagcgctgaaaaacaaggctctgacgattaccccctgcccataaaatttgcctagtcaaaataaaagatgccgagtctataaaagcgcaaggacagttcaggaggtggctcgctccctcaccgaccctcgactcggaccgatg

SEQ ID NO: 5071 - DNA, 203 bp, Homo sapiens
ggcgcgccagtcctctggtcacggagactcaccttggggatccatcctctccaagcggcctcggttgagacgccttccgtgggaccgtctcccggcctcggcacctcctgaactgctcctcccaaggtaagtctcctctcaggtcgagctcggctgccccttaggtagtcgctccccgagggtctttacgactcggaccgatg

SEQ ID NO: 5072 - DNA, 203 bp, Homo sapiens
ggcgcgccagtccttgtacaagcacttctgtttcccaggagcgaggtataggctgtacccactgccaaaagcctttaaccgttatccgccaaccaactacgtaacagttagtaccatcttgttcttgactggacgttcgatcaggtggattttccctccactagtttggtcgatgaggctaggaattccgactcggaccgatg

SEQ ID NO: 5073 - DNA, 203 bp, Homo sapiens
ggcgcgccagtcctcccacgggtgaccgtgtcctagcctgcgtggcggccaacccagcttatgctgggacgcccttttaaggacatggtgtgaagactcgcatgtgcttggttgtgagtcctccggcccctgaatgcggctaaccttaaccctagagccttatgccacgatccagtggttgtaaggtccgactcggaccgatg

SEQ ID NO: 5074 - DNA, 203 bp, Homo sapiens
ggcgcgccagtcctagaacaccaactggcttcacatgagggtggcaatgtttcagttaaatacacattcacgcatccaggtgaacgtggtatagatttatcatctgcaaatgaagtgggagggcctgtcaaggatgtcatatacaatatgaatggtactttattaggaaatctgctcattttccctcacgactcggaccgatg

SEQ ID NO: 5075 - DNA, 203 bp, Homo sapiens
ggcgcgccagtccttgaaattgttcagtactatacacattggtctggatcacttagattctcttcgatgtatactggtcctgccttgtccagtgctaaactcactctagcatacaccccgcctggtgctcgtggtccacaggacaggagagaagcaatgctaggtactcatgttgtctgggatattggcgactcggaccgatg

SEQ ID NO: 5076 - DNA, 203 bp, Homo sapiens
ggcgcgccagtccttgttccacatggtgccccgaaatccaaaagagtgggcgattacacatggcaaagtgcttcaaaccccagtgtattcttcaaggtgggggatacatcaaggtttagtgtgccttatgtaggattggcatcagcatataattgtttttatgatggttactcacatgatgatgcagacgactcggaccgatg

SEQ ID NO: 5077 - DNA, 203 bp, Homo sapiens
ggcgcgccagtcctaactcagtatggcataactgttctaaaccatatgggtagtatggcattcagaatagtaaatgaacatgatgaacacaaaactcttgtcaagatcagagtttatcacagggcaaagctcgttgaagcatggattccaagagcacccagagcactaccctacacatcaatagggcgcgactcggaccgatg

SEQ ID NO: 5078 - DNA, 203 bp, Homo sapiens
ggcgcgccagtcctcttgcctccaatggctagtttagataacaagggcatgttattcaccagtaattttgttctagcctccacaaattctaacacactaagccccccaacaatcttgaatcctgaagctttagtcaggagatttggttttgacctagatatatgtttgcatactacctacacaaagaacgactcggaccgatg

SEQ ID NO: 5079 - DNA, 203 bp, Homo sapiens
ggcgcgccagtccttggaaaactcaatgcaggcatgtcaaccaagacatgcaaagattgccatcaaccatctaatttcaagaaatgttgccccctagtctgtggaaaagctattagcttggtagacagaactaccaacgttaggtatagtgtggatcaactggtcacggctattataagtgatttcaacgactcggaccgatg

SEQ ID NO: 5080 - DNA, 203 bp, Homo sapiens
ggcgcgccagtcctacgcccagttgttgtgcaaggaccaaacacagaatttgcactatccctgttaaggaaaaacataatgactataacaacctcaaagggagagttcacagggttaggcatacatgatcgtgtctgtgtgatacccacacacgcacagcctggtgatgatgtactagtgaatggtcacgactcggaccgatg

SEQ ID NO: 5081 - DNA, 203 bp, Homo sapiens
ggcgcgccagtcctcactatcttagaagttggccctgtaacaatggcaggacttattaatttgagtagcacccccactaacagaatgattcgttatgattatgcaacaaaaactgggcagtgtggaggtgtgctgtgtgctactggtaagatctttggtattcatgttggcggtaatggaagacaaggcgactcggaccgatg

SEQ ID NO: 5082 - DNA, 203 bp, Homo sapiens
ggcgcgccagtccttgacaatgatcccagactggaagttaaattgactgaatcattattctctaagtacaaggggaatgtaaatacggaacccactgaaaatatgcttgtggctgtagaccattatgcagggcaactattatcactagatatccccacttctgaacttacactaaaagaagcattatacgactcggaccgatg

SEQ ID NO: 5083 - DNA, 203 bp, Homo sapiens
ggcgcgccagtcctgtctgtcatcccttgcttaatggatgggcacctgatggcatttgattactctaattttgatgcctctttgtcaccagtttggtttgtctgtctagagaaggttttgaccaagttaggctttgcaggctcttcattaattcaatcaatttgtaatacccatcatatctttagggacgactcggaccgatg

SEQ ID NO: 5084 - DNA, 203 bp, Homo sapiens
ggcgcgccagtcctgcaaggtatcagccgttctggtctgatcctctcaaccccatcttttgtctttctcagtttcttagcggggaccgtccgttctctccctgtgcaggtgcgactcttgtttgtgctggtcgcggcaggtggcgcccaacgtggggctcgagctcgacagttttcttccgccactaccgactcggaccgatg

SEQ ID NO: 5085 - DNA, 203 bp, Homo sapiens
ggcgcgccagtcctattaattaattttctttcatttattgaggaagtttgcccttggtttcctagggaaggcacagtgaatttggagacatggaagaaggtgggagagcaaattcggacgcattataccttacacggccctgaaaaggtccctgtcgagacattatctttttggacattgattcgtgacgactcggaccgatg

SEQ ID NO: 5086 - DNA, 203 bp, Homo sapiens
ggcgcgccagtcctctgcctggattttgataatgatgaattgaaacgtttaggaaatttgttaaaacaggaagaagatcctctccatacccctgattcggtacctagttatgatcctcctcctcctcctccgccatctctgaaaatgcacccttctgataatgatgattcactttcatctacagatgacgactcggaccgatg

SEQ ID NO: 5087 - DNA, 203 bp, Homo sapiens
ggcgcgccagtccttaacaaccagcgttactatgaatcactgccgtttaaacaactaaaagagttaaagattgcttgttcgcaatatggtcctaccgctccatttactattgctatgatagaaagtttgggtactcaagctttgcccccgaatgactggaaacagaccgctagggcatgtctctcaggcgactcggaccgatg

SEQ ID NO: 5088 - DNA, 203 bp, Homo sapiens
ggcgcgccagtccttgcggctcgacaggcatggaaaaaacttcctagctccagtactaagacagaggacctttcaaaggtccggcagggacctgatgagccttaccaggacttcgtggcacgacttttagatactataggtaagataatgtcagatgaaaaggctgggatggtgctggcaaaacaattcgactcggaccgatg

SEQ ID NO: 5089 - DNA, 203 bp, Homo sapiens
ggcgcgccagtcctagcttttgaaaacgctaactctgcttgtcaagctgctttgagaccttatcgaaaaaagggagatctatctgattttattcgcatttgtgctgatattggaccctcctacatgcaaggcattgctatggcagcagcattacaaggaaaaagcataaaagaagtacttttccagcacgactcggaccgatg

SEQ ID NO: 5090 - DNA, 203 bp, Homo sapiens
ggcgcgccagtcctgcaagcccggaacaagaaaggacttcaaaagtcaggtaattcgggttgctttgtttgtggtcagcctggccatcgggctgcagtatgccctcaaaaacatcaaacctctgttaatacccctaatttgtgcccacgctgtaaaaaaggaaagcattgggcacgagactgccgttccgactcggaccgatg

SEQ ID NO: 5091 - DNA, 203 bp, Homo sapiens
ggcgcgccagtccttacgtccttatttaaaattacccacttataccttgcagccattatttgacatccttaaaggtgactctgatcctgcgtcaccccgaacgctttctttagaaggacgaactgctttacaatcaatagaagaagctattagacaacaacagattacttattgtgattaccaacgatcgactcggaccgatg

SEQ ID NO: 5092 - DNA, 203 bp, Homo sapiens
ggcgcgccagtcctttaaatcttgctctacttgtcctcaattctttgttctccctcaatatggtgtcaaccctcgaggtttacgccctaatcacctctggcaaacagatgttactcacattcctcaatttgggcgtcttaaatatgttcatgtttctattgacactttttccaattttctcatggcttcgactcggaccgatg

SEQ ID NO: 5093 - DNA, 203 bp, Homo sapiens
ggcgcgccagtcctcagaggaactccctgacgcatcagatgcaacgcatgaccctgagtgagcccacgagtgagctgcccacccagaggcaaattgaagcgctaatgccgtacgcctggaatgaggcacatgtacaaccccccgtgacacctactaatatactgattatgttgttgttactattacagcgactcggaccgatg

SEQ ID NO: 5094 - DNA, 203 bp, Homo sapiens
ggcgcgccagtcctggccttactactcaataccccatgtgcttttcttatcaatcgcagcatccccattgtatacaggtgtcagccgacatatcatatcctcgagtgactatttcaggcattgatgaaaaaacagggaaaaaatcgtatgggaacggaactggacccctcgatattccgttttgtgaccgactcggaccgatg

SEQ ID NO: 5095 - DNA, 203 bp, Homo sapiens
ggcgcgccagtcctaagcatttaagcatcggcataggcatagacactccgtggactttatgtcgagcccgggttgcatcggtgtataatatcaataatgccaatgccacctttttatgggactgggcacctggaggaacacctgattttcctgagtatcgaggacagcatccacctattttttcggtgcgactcggaccgatg

SEQ ID NO: 5096 - DNA, 203 bp, Homo sapiens
ggcgcgccagtcctcaccgacatctaatggagcttttaaagaataaagagaggggagctgcgggggacgacccgtgaagggttaagtcctgggagctctttggcaaaagccaaagcctaggacaaatacctaagctccctgtcccgccaccctctaggattcttgaaagctcttaaggttcggatgttcgactcggaccgatg

SEQ ID NO: 5097 - DNA, 203 bp, Homo sapiens
ggcgcgccagtcctgatccggtggagccatcagaggaatcaaacacattattatagtaccaattcctggagattcctcaattaccactcgatccagactactggaccggttggtcaggttaattggaaacccggatgtgagcgggcccaaactaacaggggcactaataggtatattatccttatttgcgactcggaccgatg

SEQ ID NO: 5098 - DNA, 203 bp, Homo sapiens
ggcgcgccagtcctgtgatcaatccaggtccggatggttcgagaacaaggaaatctcagatattgaagtgcaagaccctgagggattcaacatgattctgggtaccattctagcccagatctgggtcttgctcgcaaaggcggttacggccccagacacggcagctgattcggagctaagaaggtggacgactcggaccgatg

SEQ ID NO: 5099 - DNA, 203 bp, Homo sapiens
ggcgcgccagtccttggtaatcctagagaactcaattcagaacaagttcagtgcaggatcataccctctgctctggagctatgccatgggagtaggagtggaacttgaaaactccatgggaggtttgaactttggtcgatcttactttgatccagcatattttagattagggcaagagatggtgaggacgactcggaccgatg

SEQ ID NO: 5100 - DNA, 203 bp, Homo sapiens
ggcgcgccagtcctaaaacttaggaaccaggtccacacagccgccagccaaccaaccatccactcccacgactggagccgatggcagaagagcaggcacgccatgtcaaaaacggactggaatgcatccgggctctcaaggccgagcccatcggctcactggccgtcgaggaagccatggcagcatggcgactcggaccgatg

SEQ ID NO: 5101 - DNA, 203 bp, Homo sapiens
ggcgcgccagtccttcagaaatatcagacaacccaggacaggaccgagccacctgcaaggaagaggaggcaggcagttcgggtctcagcaaaccatgcctctcagcaattggatcaactgaaggcggtgcacctcgcatccgcggtcagggatctggagaaagcgatgacgacgctgaaactttgggacgactcggaccgatg

SEQ ID NO: 5102 - DNA, 203 bp, Homo sapiens
ggcgcgccagtcctaatgttcctccgcccccgaaccccagtagggccagcacttccgagacacccattaaaaagggcacagacgcgagattggcctcatttggaacggagatcgcgtctttattgacaggtggtgcaacccaatgtgctcgaaagtcaccctcggaaccatcagggccaggtgcacctcgactcggaccgatg

SEQ ID NO: 5103 - DNA, 203 bp, Homo sapiens
ggcgcgccagtcctgggaaaaaggtgagctcagccgtcgggtttgttcctgacaccggccctgcatcacgcagtgtaatccgctccattataaaatccagccggctagaggaggatcggaagcgttacctgatgactctccttgatgatatcaaaggagccaacgatcttgccaagttccaccagatgcgactcggaccgatg

SEQ ID NO: 5104 - DNA, 203 bp, Homo sapiens
ggcgcgccagtccttcgggtccctgcccttaggtgttggtagatccacagcaaaacccgaggaactcctcaaagaggccactgagcttgacatagttgttagacgtacagcagggctcaatgaaaaactggtgttctacaacaacaccccactaaccctcctcacaccttggagaaaggtcctaacaacgactcggaccgatg

SEQ ID NO: 5105 - DNA, 203 bp, Homo sapiens
ggcgcgccagtcctcagggagtgtcttcaatgcaaaccaagtgtgcaatgcggttaatctaataccgctggacaccccgcagaggttccgtgttgtttatatgagcatcacccgtctttcggataacgggtattacaccgttcccagaagaatgctggaattcagatcggtcaatgcagtggccttcacgactcggaccgatg

SEQ ID NO: 5106 - DNA, 203 bp, Homo sapiens
ggcgcgccagtcctagacggggggccccccccaaaaaaaggcccccaggggccgacagccagcatcgcgaggaagcacacccaccccacacacgaccacggcaaccgaaccagagtccagaccaccctgggccaccagctcccagactcggccatcaccccgcaaaaaggaaaggccacaacccgcgccgactcggaccgatg

SEQ ID NO: 5107 - DNA, 203 bp, Homo sapiens
ggcgcgccagtcctaccccagccccgatccggcgggcagccactcaacccgaaccagcacccaagagcgatccctgggggacccccaaaccgcaaaagacatcagtatcccacagcctctccaagtcccccggtctcctcctcttctcgaagggaccaaaagatcaatccaccacatccgacgacactcgactcggaccgatg

SEQ ID NO: 5108 - DNA, 203 bp, Homo sapiens
ggcgcgccagtcctcaattccccacccccaaaggagacaccgggaatcccagaatcaagactcatccagtgtccatcatgggtctcaaggtgaacgtctctgccatattcatggcagtactgttaactctccaaacacccaccggtcaaatccattggggcaatctctctaagataggggtggtagggcgactcggaccgatg

SEQ ID NO: 5109 - DNA, 203 bp, Homo sapiens
ggcgcgccagtcctcagaatataagaccggttcagagtgtagcttcaagtaggagacacaagagatttgcgggagttgtcctggcaggtgcggccctaggcgttgccacagctgctcagataacagccggcattgcacttcaccagtccatgctgaactctcaagccatcgacaatctgagagcaagccgactcggaccgatg

SEQ ID NO: 5110 - DNA, 203 bp, Homo sapiens
ggcgcgccagtcctctggaaactactaatcaggcaattgaggcaatcagacaagcagggcaggagatgatattggctgttcagggtgtccaagactacatcaataatgagctgataccgtctatgaaccaactatcttgtgatttaatcggccagaagctagggctcaaattgctcagatactatacacgactcggaccgatg

SEQ ID NO: 5111 - DNA, 203 bp, Homo sapiens
ggcgcgccagtcctactcacgtcgacacagagtcctacttcattgtactcagtatagcctatccgacgctgtccgagattaagggggtgattgtccaccggctagagggggtctcgtacaatataggctctcaagagtggtataccactgtgcccaagtatgttgcaacccaagggtaccttatctcgcgactcggaccgatg

SEQ ID NO: 5112 - DNA, 203 bp, Homo sapiens
ggcgcgccagtcctggagtacgacttcagagatctcacttggtgtatcaacccgccagagagaatcaaattggattatgatcaatactgtgcagatgtggctgctgaagaactcatgaatgcattggtgaactcaactctactggaggccagggcaaccaatcagttcctagctgtctcaaagggaaacgactcggaccgatg

SEQ ID NO: 5113 - DNA, 203 bp, Homo sapiens
ggcgcgccagtcctgacagttgagcttaaaatcaaaattgcttcaggattcgggccattgatcacacacggttcagggatggacctatacaaaaccaaccacaacaatgtgtattggctgactatcccgccaatgaagaacctagccttaggtgtaatcaacacattggagtggataccgagattcaacgactcggaccgatg

SEQ ID NO: 5114 - DNA, 203 bp, Homo sapiens
ggcgcgccagtcctacatgctgtggtttattatgtttacagcccaagccgctcattttcttacttttatccttttaggttgcctataaagggggtcccaatcgaattacaagtggaatgcttcacatgggacaaaaaactctggtgccgtcacttctgtgtgcttgcggactcagaatctggtggacacgactcggaccgatg

SEQ ID NO: 5115 - DNA, 203 bp, Homo sapiens
ggcgcgccagtccttatcactcactctgggatggtgggcatgggagtcagctgcacagtcactcgggaagatggaaccaatcgcagatagggctgccagtgaaccgatcacatgatgtcacccagacatcaggcatacccactagtgtgaaatagacatcagaattaagaaaaacgtagggtccaagtcgactcggaccgatg

SEQ ID NO: 5116 - DNA, 203 bp, Homo sapiens
ggcgcgccagtcctggtttcccgttatggactcgctatctgtcaaccagatcttataccctgaagttcacctagatagcccgatagttaccaataagatagtagctatcctggagtatgctcgagtccctcacgcttacagcctggaggaccctacactgtgtcagaacatcaagcaccgcctaaaaacgactcggaccgatg

SEQ ID NO: 5117 - DNA, 203 bp, Homo sapiens
ggcgcgccagtccttcaagactgagatgaggtcagtgattaaatcacaaacccatacttgccataggaggagacacacacctgtattcttcactggtagttcagttgagctgttaatctctcgtgaccttgttgctataatcagtaaggagtctcaacatgtatattacctgacgtttgaactggtttcgactcggaccgatg

SEQ ID NO: 5118 - DNA, 203 bp, Homo sapiens
ggcgcgccagtccttgatgtattgtgatgtcatagaggggaggttaatgacagagaccgctatgaccattgatgctaggtatgcagaacttctaggaagagtcagatacatgtggaaactgatagatggtttcttccctgcactcgggaatccaacttatcaaattgtagccatgctggagccactttcgactcggaccgatg

SEQ ID NO: 5119 - DNA, 203 bp, Homo sapiens
ggcgcgccagtcctggcacggaggcagttggccacccctgaccctccccctgcatgctgcagacacaatccggaatgctcaagcttcaggtgaagggttaacacatgagcagtgcgttgataactggaaatcatttgctggagtgagatttggctgttttatgcctcttagcctggacagtgatctgacgactcggaccgatg

SEQ ID NO: 5120 - DNA, 203 bp, Homo sapiens
ggcgcgccagtcctttcagtggctgcataagaggcttgaaacctctgtcctctatgtaagtgaccctcattgcccccccgaccttgacgcccatgtcccgttatgcaaagtccccaatgaccaaatcttcatcaagtaccctatgggaggtatagaagggtattgtcagaagctgtggaccatcagcacgactcggaccgatg

SEQ ID NO: 5121 - DNA, 203 bp, Homo sapiens
ggcgcgccagtcctccattccctacttatacctggctgcttatgagagcggggtaaggattgcttcgttagtgcaaggggacaatcagaccatagccgtaacaaaaagggtacccagcacatggccttacaaccttaagaaacgggaagctgctagagtaactagagattactttgtaattcttaggccgactcggaccgatg

SEQ ID NO: 5122 - DNA, 203 bp, Homo sapiens
ggcgcgccagtcctcatgcagtaatattgctacaacaatggctaaaagcatcgagagaggttatgaccgttatcttgcatattccctgaacgtcctaaaagtgatacagcaaattttgatctctcttggcttcacaatcaattcaaccatgacccgagatgtagtcatacccctcctcacaaacaacgcgactcggaccgatg

SEQ ID NO: 5123 - DNA, 203 bp, Homo sapiens
ggcgcgccagtcctatctcttaataaggatggcactgttgcccgctcctattggggggatgaattatctgaatatgagcaggctgtttgtcagaaacatcggtgatccagtaacatcatcaattgctgatctcaagagaatgattctcgcatcactaatgcctgaagagaccctccatcaagtaatgacgactcggaccgatg

SEQ ID NO: 5124 - DNA, 203 bp, Homo sapiens
ggcgcgccagtcctcacaacaaccgggggactcttcattcctagactgggctagcgacccttactcagcaaatcttgtatgcgtccagagcatcactagactcctcaagaacataactgcaaggtttgtcctaatccatagtccaaacccaatgttaaaagggttattccatgatgacagtaaagaagcgactcggaccgatg

SEQ ID NO: 5125 - DNA, 203 bp, Homo sapiens
ggcgcgccagtcctaggacgagagactggcggcattcctcatggacaggcatattatagtacctagggcagctcatgaaatcctggatcatagtgtcacaggggcaagagagtctattgcaggcatgctagataccacaaaaggcctgattcgagccagcatgaggaagggggggttaacctctcgagcgactcggaccgatg

SEQ ID NO: 5126 - DNA, 203 bp, Homo sapiens
ggcgcgccagtccttgataaccagattgtccaattatgactatgaacaatttagagcagggatggtgctattgacaggaagaaagagaaatgtcctcattgacaaagagtcatgttcagtgcagctggctagagccctaagaagccatatgtgggcaagactagctcgaggacggcctatttacggcccgactcggaccgatg

SEQ ID NO: 5127 - DNA, 203 bp, Homo sapiens
ggcgcgccagtcctctaccactgatgagagaacagacatgaagctcgccttcgtaagagccccaagtagatccttgcgatctgccgttagaatagcaacagtgtactcatgggcttacggtgatgatgatagctcttggaacgaagcctggttgttggcaaggcaaagggccaatgtgagcctggaggcgactcggaccgatg

SEQ ID NO: 5128 - DNA, 203 bp, Homo sapiens
ggcgcgccagtcctagctaagggtgatcactcccatctcgacttcgactaatttagcgcataggttgagggatcgtagcactcaagtgaaatactcaggtacatcccttgtccgagtggcaaggtataccacaatctccaacgacaatctctcatttgtcatatcagataagaaggttgatactaactcgactcggaccgatg

SEQ ID NO: 5129 - DNA, 203 bp, Homo sapiens
ggcgcgccagtcctttatataccaacaaggaatgcttctagggttgggtgttttagaaacattgtttcgactcgagaaagatactggatcatctaacacggtattacatcttcacgtcgaaacagattgttgcgtgatcccgatgatagatcatcccaggatacccagctcccgcaagctagagctgacgactcggaccgatg

SEQ ID NO: 5130 - DNA, 203 bp, Homo sapiens
ggcgcgccagtccttcaaacagataagattgagagttgatccaggattcatttttgacgccctcgctgaggtaaatgtcagtcagccaaaggtcggcagcaacaacatctcaaatatgagcatcaaggatttcagacctccacacgatgatgttgcaaaattgctcaaagatatcaacacaagcaagccgactcggaccgatg

SEQ ID NO: 5131 - DNA, 203 bp, Homo sapiens
ggcgcgccagtcctatcctgaaaagatcaagcagcagataattgaatcatctgtgcggacttcacctggacttataggtcacatcctatccattaagcaactaagctgcatacaagcaattgtgggaggcgcagttagtagaggtgatatcaaccctattctgaaaaaacttacacctatagagcaggcgactcggaccgatg

SEQ ID NO: 5132 - DNA, 203 bp, Homo sapiens
ggcgcgccagtcctccgtattggtaagtagtaggcaacgagaacttgtatctaggatcactcgcaaattttgggggcatattcttctttactccgggaacagaaagttgataaatcggtttatccagaatctcaagtccggttatctagtactagacttacaccagaatatcttcgttaagaatctatcgactcggaccgatg

SEQ ID NO: 5133 - DNA, 203 bp, Homo sapiens
ggcgcgccagtcctagtcggttgatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgcgactcggaccgatg

SEQ ID NO: 5134 - DNA, 203 bp, Homo sapiens
ggcgcgccagtccttgacctgggaagccttggcttttgacccccctccctgggtcaagccctttgtacaccctaagcctccgcctcctcttcctccatccgccccgtctctcccccttgaacctcctctttcgaccccgcctcgatcctccctttatccagccctcactccttctctaggcgccaaaccgactcggaccgatg

SEQ ID NO: 5135 - DNA, 203 bp, Homo sapiens
ggcgcgccagtcctggagacgggagcccccagtggccgactccactacctcgcaggcattccccctccgcacaggaggaaacggacagcttcaatactggccgttctcctcttctgacctttacatcacccccgtcaacagcctggagaaacattcctggtatcatggccctgtatctcggaatgctgcgactcggaccgatg

SEQ ID NO: 5136 - DNA, 203 bp, Homo sapiens
ggcgcgccagtccttggctgagttagttcaccatcactccacggtggctgatggcctcatcaccacactccactacccagctcccaagcgcaacaagcccactatctacggtgtgtcccccaactacgacaagtgggaaatggagcgcaccgacatcaccatgaagcacaagttgggtggaggccagtcgactcggaccgatg

SEQ ID NO: 5137 - DNA, 203 bp, Homo sapiens
ggcgcgccagtcctacggggaggtgtacgagggcgtttggaagaagtacagcctcactgtggccgtgaagaccttgaaggaggacaccatggaggtggaggagttcctgaaggaagcggcggtgatgaaggagatcaaacaccctaacctggtgcagctgctaggggtgtgtacccgggaaccaccatcgactcggaccgatg

SEQ ID NO: 5138 - DNA, 203 bp, Homo sapiens
ggcgcgccagtccttctacataatcactgagttcatgacctatgggaacctgctggactacctgagggagtgtaaccggcaggaggtgagcgccgtggtactgctctacatggccacacagatctcatcagccatggagtacttggagaagaagaacttcatccacagagaccttgctgcccggaactcgactcggaccgatg

SEQ ID NO: 5139 - DNA, 203 bp, Homo sapiens
ggcgcgccagtcctcctttgctgaaatccaccaagcctttgaaaccatgttccaggaatccagtatctcagatgaggtggagaaggagctggggaaacgaggcacgagaggaggtgctgggagtatgctgcaggccccagagctgcccaccaagaccagaacctgcaggagagcagctgagcagaaagcgactcggaccgatg

SEQ ID NO: 5140 - DNA, 203 bp, Homo sapiens
ggcgcgccagtcctccagccctcccagcttgactcccaaactcctccgcaggcaggtcactgcctctccttcctctggcctctctcacaagaaagaggccaccaagggcagtgcctcaggcatggggactccggccactgcagagccagcaccccccagcaacaaagtgggcctcagcaaggcctcctcgactcggaccgatg

SEQ ID NO: 5141 - DNA, 203 bp, Homo sapiens
ggcgcgccagtcctctgaggagatgcgcgtaaggaggcacaagcacagctcggagtccccagggagagacaaggggcgactggctaagctcaagcctgccccgccgcctcctcctgcctgcacaggaaaagcaggcaagcccgcacagagccccagccaagaggccggggaggcaggggggcccacaacgactcggaccgatg

SEQ ID NO: 5142 - DNA, 203 bp, Homo sapiens
ggcgcgccagtcctagacaaaatgcacgagtctggctatggatgctgtgaacactgaccccaccaaggccggcccacctggagaaggactgagaaagcctgtgcccccatctgtgccaaagccccagtcgacggctaagcctccagggactcccaccagcccggtctccaccccctccacagcaccagcgactcggaccgatg

SEQ ID NO: 5143 - DNA, 203 bp, Homo sapiens
ggcgcgccagtcctctccttcacccctggctggggaccagcagccatcttctgccgccttcatccccctcatatcaacccgtgtgtctcttaggaagacccgccagccgccagagcgcattgccagtggcaccatcaccaagggtgtggttctggacagtactgaggccctgtgccttgccatctccccgactcggaccgatg

SEQ ID NO: 5144 - DNA, 203 bp, Homo sapiens
ggcgcgccagtcctggaactcagagcagatggccagccacagtgctgtactggaggctggcaagaacctgtacactttctgtgtgagctatgtggactctatccagcagatgaggaacaagtttgccttccgtgaggctatcaacaagctggagagcaacctccgagagctgcagatctgccctgccacgactcggaccgatg

SEQ ID NO: 5145 - DNA, 203 bp, Homo sapiens
ggcgcgccagtcctgtctttccccaggagctttaaagagagacaagcagagcctgagggagacctggatggagcctggtggagttggctcttcctcctgtgttgtgcaccagctgccctgcacctttcctgcccagcccaggcgtcagccacctctcctcactgcctgtggatgggtctcctgctctgcgactcggaccgatg

SEQ ID NO: 5146 - DNA, 203 bp, Homo sapiens
ggcgcgccagtcctaagactacatctggcctgcctggccaccaggcttctcactccccggtgcctcagacccagctcccaggtcagcctggagtgctcttccctgtccttgcagaacgacctcctctgatggaccttcttgtcaccaaggcatgggagcccctgtgcttactgtacctgcacctttgacgactcggaccgatg

SEQ ID NO: 5147 - DNA, 203 bp, Homo sapiens
ggcgcgccagtccttgcttacaaactgtccccgagagcctgtgctcactgtgttttcattggaaggaagctgtcgctttaagggtcatgaggtgctaaagccaggggcccagatgggtgggcactggaaacaggagctgggcagtgtggtctgtcacctgctctcagtatcttcagcagtgtgcccggcgactcggaccgatg

SEQ ID NO: 5148 - DNA, 203 bp, Homo sapiens
ggcgcgccagtcctcagatcttggacagcaagcttgagttttatgggtggcagtcactggctggctaggcacatagccaggccaaacctaggcctccaagggctccccaaaatctgaatttctgagtagtcttcatcccctctcctgctctaaggtcaggtccatcctctctggtccttaccttgatgcgactcggaccgatg

SEQ ID NO: 5149 - DNA, 203 bp, Homo sapiens
ggcgcgccagtcctctctagttttgactcaacaatatcaccagctgaagcctatagagtacgagccatagataaaataaaagattttatttagtctccagaaaaagggggaatgaaagaccccacctgtaggtttggcaagctagcttaagtaacgccattttgcaaggcatggaaaaatacataactcgactcggaccgatg

SEQ ID NO: 5150 - DNA, 203 bp, Homo sapiens
ggcgcgccagtcctgagaatagagaagttcagatcaaggtcaggaacagagaaacagctgaatatgggccaaacaggatatgctgtggtaagcagttcctgccccggctcagggccaagaacagttggaacagctgaatatgggccaaacaggatatctgtggtaagcagttcctgccccggctcaggcgactcggaccgatg

SEQ ID NO: 5151 - DNA, 203 bp, Homo sapiens
ggcgcgccagtcctgccaagaacagatggtccccagatgcggtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaacgactcggaccgatg

SEQ ID NO: 5152 - DNA, 203 bp, Homo sapiens
ggcgcgccagtcctagtaaggagcaccctgcagtcttgaaaactgtatatctttgcacgattctgggtgaaagaccccacctgtaggtttggcaagctagcttaagtaacgccattttgcaaggcatggaaaaatacataactgagaatagagaagttcagatcaaggtcaggaacagagaaacagctcgactcggaccgatg

SEQ ID NO: 5153 - DNA, 203 bp, Homo sapiens
ggcgcgccagtcctgaatatgggccaaacaggatatgctgtggtaagcagttcctgccccggctcagggccaagaacagttggaacagctgaatatgggccaaacaggatatctgtggtaagcagttcctgccccggctcagggccaagaacagatggtccccagatgcggtccagccctcagcagttcgactcggaccgatg

SEQ ID NO: 5154 - DNA, 203 bp, Homo sapiens
ggcgcgccagtccttgaaagaccccaccaagttgcttagcctgatagccgcagtaacgccattttgcaaggcatggaaaaataccaaaccaagaatagggaagttcagatcaagggcgggtacacgaaaacagctaacgttgggccaaacaagatatctgcggtaagcagtttcggccccggcccgggcgactcggaccgatg

SEQ ID NO: 5155 - DNA, 203 bp, Homo sapiens
ggcgcgccagtcctctcgtccgggatttggagacccccgcccagggaccaccgacccaccgtcgggaggtaagctggccagcgatcgttttgtctccgtctctgtctttgtgtgtgtgtgtgtgtaccggtatttactttttgcgcctgcgtctggttctgtactagttagctaactagatctgtatccgactcggaccgatg

SEQ ID NO: 5156 - DNA, 203 bp, Homo sapiens
ggcgcgccagtcctgggaggtccaagccctcgccgcctccatctgaatttttgctttcggtttttcgccgaaaccgcgccgcgcgtcttgtctgtctcagtattgttttgttatttgtctgttcgttattgttttggaccgcttctaaaaacatgggacagaccgtaaccacccctctgagtctgacccgactcggaccgatg

SEQ ID NO: 5157 - DNA, 203 bp, Homo sapiens
ggcgcgccagtcctctagaacactgggaggatgtccagcgcaccgcgtccaatcagtccgtagatgtcaagaagagacgctgggtcaccttctgctctgccgagtggccaactttcggtgtagggtggccacaagatggtacttttaacttggacattattctacaggttaaatctaaggtgttctctcgactcggaccgatg

SEQ ID NO: 5158 - DNA, 203 bp, Homo sapiens
ggcgcgccagtcctcctggtccccacggacacccggatcaggtcccatatattgtcacctgggaggctattgcctatgaaccccctccgtgggtaaaaccttttgtctctcccaaactctccccctctccaaccgctcccatcctcccatccggtccttcgactcaacctccgccccgatctgcccttcgactcggaccgatg

SEQ ID NO: 5159 - DNA, 203 bp, Homo sapiens
ggcgcgccagtccttaccctgctcttaccccctctataaaacccggaccttctccgataatggcggacctctcactgaccttctctcagaagaccctccgccgtacggaggacagggaccgtcctcctctgacggagatggcgacagagaagaggccacctccacttctgagattcctgccccctctccgactcggaccgatg

SEQ ID NO: 5160 - DNA, 203 bp, Homo sapiens
ggcgcgccagtcctaaactgactacattgattgaatctgtcctcaccacccaccagcccacctgggatgattgccagcaattattagggactctgcttaccggggaggagaagcagcgggtgctcctggaagcccgaaaagctgtccggggcaacgatgggcgccccacccaactgcccaacgaggttcgactcggaccgatg

SEQ ID NO: 5161 - DNA, 203 bp, Homo sapiens
ggcgcgccagtcctagggaagctgaagagatctttaataaatgagaaaccccggaagaaagagagagaaggagagggaccgcagaagacatagagaaatgagtaagttgctggctgctgtcgttagcgggcagagacaggatagacagggaggagagcgaaggaggccccaactcgaccacgaccagtcgactcggaccgatg

SEQ ID NO: 5162 - DNA, 203 bp, Homo sapiens
ggcgcgccagtcctaccttcctagtggatactggggcccaacactccgtgctgacccaaaatcctggacccctaagtgacaagtctgcctgggtccaaggggctactggaagaaagcggtatcgctggaccacggatcgccaggtgcacctagccaccgggtttcaaaaacagtcccaccctgtttgacgactcggaccgatg

SEQ ID NO: 5163 - DNA, 203 bp, Homo sapiens
ggcgcgccagtcctagcccaaaattgccagaaacaggtcaagtatctggggtatcttctaaaagagggtcagggatggctgactgaggccagaaaagagactgtgatggggcagcctactccaaagacccctcgacaactaagggagttcctagggacggcaggcttctgtcgcctctggatccccggcgactcggaccgatg

SEQ ID NO: 5164 - DNA, 203 bp, Homo sapiens
ggcgcgccagtcctgtttgcagaaatggcagcccccttgtaccctctcaccaaaacggggactctgtttaaatggggcccagaccagcaaaaggcctaccaagagatcaagcaggctctcttaactgcccctgccctgggattaccagacttgactaagcccttcgaactttttgttgaccaaagacacgactcggaccgatg

SEQ ID NO: 5165 - DNA, 203 bp, Homo sapiens
ggcgcgccagtcctggaatactccgggcccccatggacttactccgtatgaaattctgtatggggcacccccgccccttgtcaattttcatgatcctgaaatgtcaaagttaactaatagtccctctctccaagctcacttacaggccctccaagcagtacaacgagaggtctggaagccactggccgcgactcggaccgatg

SEQ ID NO: 5166 - DNA, 203 bp, Homo sapiens
ggcgcgccagtcctctgcttatcaggaccagctggatcagccagtgataccacaccccctccgtgtcggtgacgccgtgtgggtacgccggcaccagactaagaacttagaaccccgctggaaaggaccctacaccgtcctgctgaccacccccaccgctctcaaagtagacggcatctctgcggggacgactcggaccgatg

SEQ ID NO: 5167 - DNA, 203 bp, Homo sapiens
ggcgcgccagtcctcgacccggtgacccggttctctttgacccgccaggtcctcaatatagggccccgcatccccattgggcctaatcccgtgatcattggccaactacccccctcccgacccgtgcaggtcaggctccccaggcctcctcagcctcctcctacaggcgcagcctctatggtccctggcgactcggaccgatg

SEQ ID NO: 5168 - DNA, 203 bp, Homo sapiens
ggcgcgccagtcctgactgccccaccttctcaacaaccggggacgggagacaggttactaaatctagtacagggagcttaccaggcactcaaccttaccaaccctgataaaacccaagagtgctggttatgcctagtgtctggacccccctattacgagggggttgcggtcctaggcactaattctaacgactcggaccgatg

SEQ ID NO: 5169 - DNA, 203 bp, Homo sapiens
ggcgcgccagtccttcatacctctgccctaaaagaaaaatgttgtttctatgctgaccatacaggcctagtaagagatagtatggccaaattaagaaagagactcactcagagacaaaaactatttgagtcgagccaaggatggttcgaaggatcgtttaacagatccccctggtttaccacgttgatcgactcggaccgatg

SEQ ID NO: 5170 - DNA, 203 bp, Homo sapiens
ggcgcgccagtcctacaagatatctgcggtaagcagtttcggccccggcccggggccaagaacagatggtccccagatatggcccaaccctcagcagtttcttaagacccatcagatgtttccaggctcccccaaggacctgaaatgaccctgtgccttatttgaattaaccaatcagcccgcttctccgactcggaccgatg

SEQ ID NO: 5171 - DNA, 203 bp, Homo sapiens
ggcgcgccagtccttatgcgcctgcgtcggtactagttagctaactagctctgtatctggcggacccgtggtggaactgacgagttcggaacacccggccgcaaccctgggagacgtcccagggacttcgggggccgtttttgtggcccgacctgagtccaaaaatcccgatcgttttggactctttgcgactcggaccgatg

SEQ ID NO: 5172 - DNA, 203 bp, Homo sapiens
ggcgcgccagtcctgtgcaccccccttagaggagggatatgtggttctggtaggagacgagaacctaaaacagttcccgcctccgtctgaatttttgctttcggtttgggaccgaagccgcgccgcgcgtcttgtctgctgcagcatcgttctgtgttgtctctgtctgactgtgtttctgtatttgtcgactcggaccgatg

SEQ ID NO: 5173 - DNA, 203 bp, Homo sapiens
ggcgcgccagtcctctgagaatatgggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctcgactcggaccgatg

SEQ ID NO: 5174 - DNA, 203 bp, Homo sapiens
ggcgcgccagtcctgaagccccaccaatttggccaaggtaaaaggaataacacaagggcccaatgagtctccctcggccttcctagagagacttaaggaagcctatcgcaggtacactccttatgaccctgaggacccagggcaagaaactaatgtgtctatgtctttcatttggcagtctgccccagcgactcggaccgatg

SEQ ID NO: 5175 - DNA, 203 bp, Homo sapiens
ggcgcgccagtcctaaccacgaggacctcggggaccaagaccccagacctccctcctgaccctagatgactagggaggtcagggtcaggagcccccccctgaacccaggataaccctcaaagtcggggggcaacccgtcaccttcctggtagatactggggcccaacactccgtgctgacccaaaatccgactcggaccgatg

SEQ ID NO: 5176 - DNA, 203 bp, Homo sapiens
ggcgcgccagtcctaaaccgggggcatgggactggcagttcgccaagctcctctgatcatacctctgaaagcaacctctacccccgtgtccataaaacaataccccatgtcacaagaagccagactggggatcaagccccacatacagagactgttggaccagggaatactggtaccctgccagtccccgactcggaccgatg

SEQ ID NO: 5177 - DNA, 203 bp, Homo sapiens
ggcgcgccagtcctacttccggatccagcacccagacttgatcctgctacagtacgtggatgacttactgctggccgccacttctgagctagactgccaacaaggtactcgggccctgttacaaaccctagggaacctcgggtatcgggcctcggccaagaaagcccaaatttgccagaaacaggtcacgactcggaccgatg

SEQ ID NO: 5178 - DNA, 203 bp, Homo sapiens
ggcgcgccagtcctagtatctggggtatcttctaaaagagggtcagagatggctgactgaggccagaaaagagactgtgatggggcagcctactccgaagacccctcgacaactaagggagttcctagggacggcaggcttctgtcgcctctggatccctgggtttgcagaaatggcagcccccttgtcgactcggaccgatg

SEQ ID NO: 5179 - DNA, 203 bp, Homo sapiens
ggcgcgccagtccttggccgaagcccacggaacccgacccgacctaacggaccagccgctcccagacgccgaccacacctggtacacggatggaagcagtctcttacaagagggacagcgtaaggcgggagctgcggtgaccaccgagaccgaggtaatctgggctaaagccctgccagccgggacatcgactcggaccgatg

SEQ ID NO: 5180 - DNA, 203 bp, Homo sapiens
ggcgcgccagtcctaaaattcatcaccctacacctcagaacattttcattacacagtgactgatataaaggacctaaccaagttgggggccatttatgataaaacaaagaagtattgggtctaccaaggaaaacctgtgatgcctgaccagtttacttttgaattattagactttcttcatcagctgacgactcggaccgatg

SEQ ID NO: 5181 - DNA, 203 bp, Homo sapiens
ggcgcgccagtcctcgcttgcaactggctctagagactgggtgctcctactccccttagccctgtaccgagcccgcaacacgccgggcccccatggcctcaccccatatgagatcttatatggggcacccccgccccttgtaaacttccctgaccctgacatgacaagagttactaacagcccctctccgactcggaccgatg

SEQ ID NO: 5182 - DNA, 203 bp, Homo sapiens
ggcgcgccagtccttccaagctcacttacaggctctctacttagtccagcacgaagtctggagacctctggcggcagcctaccaagaacaactggaccgaccggtggtacctcacccttaccgagtcggcgacacagtgtgggtccgccgacaccagactaagaacctagaacctcgctggaaaggaccgactcggaccgatg

SEQ ID NO: 5183 - DNA, 203 bp, Homo sapiens
ggcgcgccagtccttacatttgggatccgactcagataccaaaatctaggaccccgcgtcccaatagggccaaaccccgttctggcagaccaacagccactctccaagcccaaacctgttaagtcgccttcagtcaccaaaccacccagtgggactcctctctcccctacccaacttccaccggcgggcgactcggaccgatg

SEQ ID NO: 5184 - DNA, 203 bp, Homo sapiens
ggcgcgccagtcctaacggaaaataggctgctaaacttagtagacggagcctaccaagccctcaacctcaccagtcctgacaaaacccaagagtgctggttgtgtctagtagcgggacccccctactacgaaggggttgccgtcctgggtacctactccaaccatacctctgctccagccaactgctccgactcggaccgatg

SEQ ID NO: 5185 - DNA, 203 bp, Homo sapiens
ggcgcgccagtcctactgtttaacagatccccttggtttaccaccttgatatctaccattatgggacccctcattgtactcctaatgattttgctcttcggaccctgcattcttaatcgattagtccaatttgttaaagacaggatatcagtggtccaggctctagttttgactcaacaatatcaccacgactcggaccgatg

SEQ ID NO: 5186 - DNA, 203 bp, Homo sapiens
ggcgcgccagtcctgtccagccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggggcgccgactcggaccgatg

SEQ ID NO: 5187 - DNA, 203 bp, Homo sapiens
ggcgcgccagtcctcagtcctccgattgactgagtcgcccgggtacccgtgtatccaataaaccctcttgcagttgcagcgccagtcctccgattgactgagtcgcccgggtacccgtgtatccaataaaccctcttgcagttgcatccgacttgtggtctcgctgttccttgggagggtctcctctgcgactcggaccgatg

SEQ ID NO: 5188 - DNA, 203 bp, Homo sapiens
ggcgcgccagtcctccttgggagggtctcctctgagtgattgactacccgtcagcgggggtctttcatttgggggctcgtccgggatcgggagacccctgcccagggaccaccgacccaccaccgggaggtaagctggccagcaacttatctgtgtctgtccgattgtctagtgtctatgactgatttcgactcggaccgatg

SEQ ID NO: 5189 - DNA, 203 bp, Homo sapiens
ggcgcgccagtcctattcccaataaagcctcttgctgtttgcatccgaatcgtggtctcgctgttccttgggagggtctcctctgagtgattgactacccacgacgggggtctttcatttgggggctcgtccgggatttggagacccctgcccagggaccaccgacccaccaccgggaggtaagctggcgactcggaccgatg

SEQ ID NO: 5190 - DNA, 203 bp, Homo sapiens
ggcgcgccagtcctccagcaacttatctgtgtctgtccgattgtctagtgtctatgtttgatgttatgcgcctgcgtctgtactagttagctaactagctctgtatctggcggacccgtggtggaactgacgagttctgaacacccggccgcaaccctgggagacgtcccagggactttgggggccgtcgactcggaccgatg

SEQ ID NO: 5191 - DNA, 203 bp, Homo sapiens
ggcgcgccagtcctttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcatcgttctgtgttgtctcgactcggaccgatg

SEQ ID NO: 5192 - DNA, 203 bp, Homo sapiens
ggcgcgccagtcctcgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcccgactcggaccgatg

SEQ ID NO: 5193 - DNA, 203 bp, Homo sapiens
ggcgcgccagtccttccgcctcctcttcttccatccgcgccgtctctcccccttgaacctcctctttcgaccccgcctcaatcctccctttatccagccctcactccttctttgggcgccaaacctaaacctcaagttctttctgacagtggggggccgctcatcgacctacttacagaagacccccccgactcggaccgatg

SEQ ID NO: 5194 - DNA, 203 bp, Homo sapiens
ggcgcgccagtcctgccttatagggacccaagaccacccccttccgacagggacggagatagtggagaagcgacccctgcgggagaggcaccggacccctccccaatggcatctcgcctgcgtgggagacgggagccccctgtggccgactccactacctcgcaggcattccccctccgcacaggaggcgactcggaccgatg

SEQ ID NO: 5195 - DNA, 203 bp, Homo sapiens
ggcgcgccagtcctcggggaagaaaaacaacgggtgctcttagaggctagaaaggcggtgcggggcgatgatgggcgccccactcaactgcccaatgaagtcgatgccgcttttcccctcgagcgcccagactgggagtacaccacccaggcaggtaggaaccacctagtccactatcgccagttgctcgactcggaccgatg

SEQ ID NO: 5196 - DNA, 203 bp, Homo sapiens
ggcgcgccagtcctacgccgtaggacagaggatgagcagaaagagaaagaaagagatcgtaggagacatagagagatgagcaggctattggccactgtcgttagtggacagagacaggatagacaggaaggagaacgaaggaggtcccaactcgactgcgaccagtgtacctactgcgaagaacaaggcgactcggaccgatg

SEQ ID NO: 5197 - DNA, 203 bp, Homo sapiens
ggcgcgccagtcctgcactgggctaaagattgtcccaagagaccacgaggacctcggggaccaagaccccagacctccctcctgaccctagatgactagggaggtcagggtcaggagcccccccctgaacccaggataaccctcaaagtcggggggcaacccgtcaccttcctggtagatactggggccgactcggaccgatg

SEQ ID NO: 5198 - DNA, 203 bp, Homo sapiens
ggcgcgccagtccttccaaacagctagacccagtagcagctgggtgacccccttgcctacggatggtagcagccattgccgtactgacaaaggatgcaggcaagctaaccatgggacagccactagtcattctggccccccatgcagtagaggcactagtcaaacaaccccccgaccgctggctttcccgactcggaccgatg

SEQ ID NO: 5199 - DNA, 203 bp, Homo sapiens
ggcgcgccagtcctaacgcccggatgactcactatcaggccttgcttttggacagggaccgggtccagttcagaccggtggtagccctgaacccggctacgctgctcccactgcctgagaaagggctgcaacacaactgccttgatatcctggccgaagctcatggaacccgacccgacctaagggaccgactcggaccgatg

SEQ ID NO: 5200 - DNA, 203 bp, Homo sapiens
ggcgcgccagtcctcagccgctcccagacgccgaccacacctggtacacggatggaagcagtcttttacaagagggacagcgtaaggcgggagctgcggtgaccaccgagaccgagaagccttcccaaccaagaaaaaaaaccgccaaggtcgtaaatcttccccaggttcggcatgcttcaggtattcgactcggaccgatg

SEQ ID NO: 5201 - DNA, 203 bp, Homo sapiens
ggcgcgccagtccttagggactgggtgctcctactccccttagccctgtatcgagcccgcaacacgccgggcccccatggcctcaccccatatgagatcttatgtggggcacccccgccccttgtaaacttccctgaccctgacatgacaagagttactaacagcccctctctccaagctcacatacacgactcggaccgatg

SEQ ID NO: 5202 - DNA, 203 bp, Homo sapiens
ggcgcgccagtccttaatgccttcgcctctaagcctgtgtcgctacctccctcgtgagctgtcgccatcggtagactcgcggtcctgcagcattcctttggtggccccgaggaaggcagggaagctcttcctggggaccactcctcctcgggctcccggactgccacgccggctggcctggttctccacgactcggaccgatg

SEQ ID NO: 5203 - DNA, 203 bp, Homo sapiens
ggcgcgccagtcctgccacgacaacatagttcgggttgtggctgccagcacgcgcacgcccgaagactccaacagcctaggtaccataatcatggagtttgggggcaacgtgactctacaccaagtcatctacgatgccacccgctcaccggagcctctcagctgcagaaaacaactaagtttggggacgactcggaccgatg

SEQ ID NO: 5204 - DNA, 203 bp, Homo sapiens
ggcgcgccagtcctcccctccccacatagggggcacgtacacgcaccaagctccggagatcctaaaaggagagattgccacgcccaaagctgacatctactcttttggaatcaccctgtggcagatgactaccagagaggtgccttactccggcgaacctcagtacgtgcagtatgcagtggtagcctcgactcggaccgatg

SEQ ID NO: 5205 - DNA, 203 bp, Homo sapiens
ggcgcgccagtcctacaatctgcgtccctcactggcaggagcggtgttcaccgcctccctgactggaaaggcactgcagaacatcatccagagctgctgggaggcccgcggcctgcagaggccgagtgcagaactgctccaaagggacctcaaggctttccgagggacactaggctgactccatcgagcgactcggaccgatg

SEQ ID NO: 5206 - DNA, 203 bp, Homo sapiens
ggcgcgccagtcctagtttctagtgaatcatcagatgtttccagggtgccccaaggacctgaaaatgaccctgtaccttatttgaactaaccaatcagttcgcttctcgcttctgttcgcgcgcttccgctctccgagctcaataaaagagcccacaacccctcactccgcgcgccagtcttccgatacgactcggaccgatg

SEQ ID NO: 5207 - DNA, 203 bp, Homo sapiens
ggcgcgccagtcctcactttgcaaggcatggaaaaatacataactgagaatagaaaagttcagatcaaggtcaggaacaaagaaacagctgaataccaaacaggatatctgtggtaagcggttcctgccccggctcagggccaagaacagatgagacagctgagtgatgggccaaacaggatatctgtcgactcggaccgatg

SEQ ID NO: 5208 - DNA, 203 bp, Homo sapiens
ggcgcgccagtccttttccagggtgccccaaggacctgaaaatgaccctgtaccttatttgaactaaccaatcagttcgcttctcgcttctgttcgcgcgcttccgctctccgagctcaataaaagagcccacaacccctcactccgcgcgccagtcttccgatagactgcgtcgcccgggtacccgtcgactcggaccgatg

SEQ ID NO: 5209 - DNA, 203 bp, Homo sapiens
ggcgcgccagtcctggagagatcagagcactcttgggagtggaagctcccgggtctctcctgcctgactgtggagacaataaaggagttactttacaactgcgctagcctggttattatcgggattcgtcactaattctgtgcaacaccagagcggatctcgcagctggcgcccaacgtggggctcgacgactcggaccgatg

SEQ ID NO: 5210 - DNA, 203 bp, Homo sapiens
ggcgcgccagtcctgaaaagaagacagcagtccgcagaaatcaggagaagaagagtcatggaaggagttatgggacctcggactttgctgttgtaaagagaaaccagcgcgcagcggaagagcggagacacggacaaaagggaaacaaaaacttcggggacgcctgaagtaaggtaagagagacacctcgactcggaccgatg

SEQ ID NO: 5211 - DNA, 203 bp, Homo sapiens
ggcgcgccagtcctgaaaaaatgcaagcatgtcgggacgtaggatcagaaggatttaaaatgcagctgttagcacaggcattgagaccgccacggaaggaaggaaaacagggagtacaaaaatgctattactgcgggaaaccaggacatctcgcaaggcaatgcagacaaggaataatatgtcatcatcgactcggaccgatg

SEQ ID NO: 5212 - DNA, 203 bp, Homo sapiens
ggcgcgccagtcctgatggaagttgagtccctcagtgtatcaatttacaatgcaagaaatattaagggattggatagcgaaacatcctatgatacaatttggaatatacatggatgatatttatatagggagtgatttggatataatgaaacacagagagatagtagaagaactagctagctatattgcgactcggaccgatg

SEQ ID NO: 5213 - DNA, 203 bp, Homo sapiens
ggcgcgccagtcctcccagtatggatttatgttaccagaagaaaagagacaagaagggtatccagcaaagtggcttggatttgaattgcacccagagaaatggagatttcagaaacatacacttccagaaataaaggaagggaccataacattaaataaattacaaaaattagtaggagatttagtctcgactcggaccgatg

SEQ ID NO: 5214 - DNA, 203 bp, Homo sapiens
ggcgcgccagtcctggagacaatcattaataggaaaaagcatacctaatatactaaagttaatggaaggggatagggcgctccaaagtgaaagaaggatagagctcagacatgtaaaggaatgggaggaatgtagaagaaaattagcagaaatggaaggaaattactatgatgaagagaaggatgtatcgactcggaccgatg

SEQ ID NO: 5215 - DNA, 203 bp, Homo sapiens
ggcgcgccagtcctagaatggaaaaggaagtctaggattcattgcctctacaggcgttaaatttagaaaacacgaagagggaacaaatcaacaattagaattaagagcaatagaagaggcgtgcaaacagggaccagagaaaatgaatatagtaacagatagcagatatgcatatgaatttatgagaacgactcggaccgatg

SEQ ID NO: 5216 - DNA, 203 bp, Homo sapiens
ggcgcgccagtcctaagggggaataatagattcaggatatcaaggcattatacaggtagtagtatataacagcaatgacaaggaagtcattatcccacaagggagaaaatttgcacaattaattctcatgcctttaatacatgaagacctagaagcttggggggaaactagaaggacagaaagaggaacgactcggaccgatg

SEQ ID NO: 5217 - DNA, 203 bp, Homo sapiens
ggcgcgccagtcctaccaaggatttggatcaacgggagcatattggattgaaaatattcccctagcagaggaagatcacagtaaatggcatcaagatgctgggtcattacacttagactttgggataccccgaactgcagctgaggatattgtacaacaatgtgaagtatgtcaagaaaataaaatgccgactcggaccgatg

SEQ ID NO: 5218 - DNA, 203 bp, Homo sapiens
ggcgcgccagtccttttgttattacagagtcaggaaaagaggacacccaggcgagtggctgggaccaacacaggtactctgggaaggggaaggagcaatcgtaataaaagataaaaatctagaaaagtatttagtcatagcaaaaaaggatgttaagttcataccgcaaccaaaagaaatacaaacagcgactcggaccgatg

SEQ ID NO: 5219 - DNA, 203 bp, Homo sapiens
ggcgcgccagtcctaatgaggaaacagagagacgaagaagaaaaacaaaatttggtaacaggtaaggaaaaatcttgggtaagtattgacctcctggggaccaaacaagaagggaaaaggcagaaggtaaacatatggggaccatgggaaaaatggggaattaaaatagtatgggtaatgctatgggtcgactcggaccgatg

SEQ ID NO: 5220 - DNA, 203 bp, Homo sapiens
ggcgcgccagtccttgctatcatggctataatagctgctgcaggagctggactcggcgttgctaatgccgtgcagcaatcctacaccaggacggctgttcagtctcttgctaacgcaactgctgctcagcagaatgtgttagaagcaacttatgccatggttcagcatgtggcaaaaggggtaagaatcgactcggaccgatg

SEQ ID NO: 5221 - DNA, 203 bp, Homo sapiens
ggcgcgccagtcctggccaccaataaaggacctgatcacgcacagaacatgcatggctgcaccaatggggtagctgatcatgagctaaacactcgtctcccagcctatcagaactacttcccctttcccctctctacccgctcccctccctatataaggaacccattttgaaataaactttgcagcttcgactcggaccgatg

SEQ ID NO: 5222 - DNA, 203 bp, Homo sapiens
ggcgcgccagtcctttcactgggcttcagaatgccgttctcgattagacattaatggacaacccattattaagcagggaaacttgaacaggggccagccccagggccccactaccgggatgaactccggggcttcacagttcaccccccaataccgccagccaacccctgccctcccagtaatcaacccgactcggaccgatg

SEQ ID NO: 5223 - DNA, 203 bp, Homo sapiens
ggcgcgccagtcctacgccgctacgtcacagacctctggcgagcaacagcgggcagtgcaggactggacctctgtaccaccaccgacacaatactaaccacccaaaatagccctctgacacttccagttggaatatatggacccttaccaccccagacattcggcctcatattagcagagccagctctcgactcggaccgatg

SEQ ID NO: 5224 - DNA, 203 bp, Homo sapiens
ggcgcgccagtcctaaccgttgctactcacctgcgcggtattggccaggccaccaacccccaacaaagtgctcaaatgcttaagtgggaggactctgaaggcaataatggtcacattaccccttatgtcctccccaatctgccagtcaatctctggggaagggacatcctctctcaaatgaaacttgtcgactcggaccgatg

SEQ ID NO: 5225 - DNA, 203 bp, Homo sapiens
ggcgcgccagtcctttaagaaaaaatcaggtagctggcgtcttttacaggatctaagagccgttaataaggtaatggtccccatgggagcccttcagcctggtcttccctctcctgtagccatccccctaaactatcacaaaattgttattgaccttaaggattgtttctttaccatccccttacacccgactcggaccgatg

SEQ ID NO: 5226 - DNA, 203 bp, Homo sapiens
ggcgcgccagtcctctgaagacagaccttactttgcctttagcgtccctcaaatcaacttccaaagtcctatgcctcgttatcagtggaaggttctgccacagggcatggccaacagtcccacactgtgccaaaaatttgttgctgccgccattgccccagtaagatcccagtggccagaggcctatacgactcggaccgatg

SEQ ID NO: 5227 - DNA, 203 bp, Homo sapiens
ggcgcgccagtcctccctcctttggctccatctacctgcctccccatcaaaagtcttactcacctacccctcgctcctcgccatgttaattattaagggtcggtacactggccgccaactgtttggcagggacccccactctataatcattccatacacccaggaccaattaacctggctcctgcaaacgactcggaccgatg

SEQ ID NO: 5228 - DNA, 203 bp, Homo sapiens
ggcgcgccagtcctgaattgctgcatatgttattgataatcaacccatctcaataaaatccccctacctgtcagctcaacttgttgagctctatgctattctccaggtgttcacagttctagctcaccaaccgtttaacttgtacactgacagtgcgtatattgctcaatcagtccctcttttggagacgactcggaccgatg

SEQ ID NO: 5229 - DNA, 203 bp, Homo sapiens
ggcgcgccagtccttcaccagtgtttggaagggccctgaccctgtcctcatatgggggcgaggctcagcctgcatatacgatcaaaaggaggatggcccccgctggctccctgagcgactaattagacacatcaataatcagacagcccccttgtgtgacaggccaagtaacccaaatacagccccagcgactcggaccgatg

SEQ ID NO: 5230 - DNA, 203 bp, Homo sapiens
ggcgcgccagtcctcggatgcgatggcacggttggaaaatcggtttgttggaatcagcaagcccctattcacgtctccgacggtggcggaccccaagatgctgtgagagagctttatgtacaaaaacaaatagagcttgttattcaaagccaattccctaagttatcctaccaccccctagctcgctccgactcggaccgatg

SEQ ID NO: 5231 - DNA, 203 bp, Homo sapiens
ggcgcgccagtcctaaaaccaagaggacctgacattgatgcacaaatgcttgatattctgtcagccacccaccaggccctcaatatctccaaccccagcctagcccaaaattgctggttatgcttaaatcaaggtacctccatgcccctagccttccctgtcaatatatctagttttaatgcctcacacgactcggaccgatg

SEQ ID NO: 5232 - DNA, 203 bp, Homo sapiens
ggcgcgccagtcctccaagcttttgtttgcggcaacaacctcgcctttactgctctgcctgcaaactggacagggtcatgtgtgttagccgccctcctgccagatatagacattatttctggtgatgaccctgtccctatccctacctttgactatattgcagggcggcagaaacgagccgttacactcgactcggaccgatg

SEQ ID NO: 5233 - DNA, 203 bp, Homo sapiens
ggcgcgccagtcctgattcccctgctagtaggattgggtgtctctacagcagtcgctaccggtacagcaggactcggggtggctgttcaatcttacacaaaactttcccatcaacttattaacgacgtccaagccttgtctagcaccattaatgacttacaggaccaactagattccctagccgaagtcgactcggaccgatg

SEQ ID NO: 5234 - DNA, 203 bp, Homo sapiens
ggcgcgccagtcctcttcctcaccggcctcaatggacttctcccttacctcctccccttccttggacccttattcgctatcatcctgttcttctcttttgccccttggatcctaagacgagtaacagcgttaatcagggatcagctcaattccctactgggaaagcccatacaaatccactatcaccacgactcggaccgatg

SEQ ID NO: 5235 - DNA, 203 bp, Homo sapiens
ggcgcgccagtccttggcttgcatagaggttggtactcgaaaaatcctctcctcccaaaaaggtacctgtaagcctgaaaattaaggctcaggaggagcacagcctctacctcccctagctggttaaggtccgcctcctctttttttaaagaaaaagggaggagatgttgggaacccaggctaagctgcgactcggaccgatg

SEQ ID NO: 5236 - DNA, 203 bp, Homo sapiens
ggcgcgccagtccttttgaaaaagccctgtataactctaggaaaggctcccgatttaaataaagcatacaagtcagttttatcatgcatgagcgccgccaaacttgatcctgacgatgtatgttcctatttggcggcggcaatgcagttttttgaggggacatgtccggaagactggaccagctatggcgactcggaccgatg

SEQ ID NO: 5237 - DNA, 203 bp, Homo sapiens
ggcgcgccagtcctaaatgcaacggttattgctgcatgtgctcctcatgaaatgtctgttctagggggctatctgggagaggaattcttcgggaaagggacatttgaaagaagattcttcagagatgagaaagaacttcaagaatacgaggcggctgaactgacaaagactgacgtagcactggcagacgactcggaccgatg

SEQ ID NO: 5238 - DNA, 203 bp, Homo sapiens
ggcgcgccagtcctcaaccctccaggaaagtcttcagaggataaatcaacccagactaccggccgagagctcaagaaggagacaacacccactccttctcagagagaaagccaatcctcgaaagccaggatggcggctcaaactgcttctggccctccagcccttgaatggtcggccaccaatgaagacgactcggaccgatg

SEQ ID NO: 5239 - DNA, 203 bp, Homo sapiens
ggcgcgccagtcctgggtcttccctggcgggaattgctcaggagtagcggtgtcttctacctactgctccactaaccacgattacaccatttggatgcccgagaatccgagactagggatgtcttgtgacatttttaccaatagtagagggaagagagcatccaaagggagtgagacttgcggctttgcgactcggaccgatg

SEQ ID NO: 5240 - DNA, 203 bp, Homo sapiens
ggcgcgccagtcctatgctcactacaagtcagtcagaacttggaatgagatcatcccttcaaaagggtgtttaagagttggggggaggtgtcatcctcatgtaaacggggtatttttcaatggtataatattaggacctgacggcaatgtcttaatcccagagatgcaatcatccctcctccagcaaccgactcggaccgatg

SEQ ID NO: 5241 - DNA, 203 bp, Homo sapiens
ggcgcgccagtccttactgagtgcaggggccctgactgccttgatgttgataattttcctgatgacatgctggagaagagtcaatcgatcggaacctacacaacacaatctcagagggacagggagggaggtgtcagtcactccccaaagcgggaagatcatatcttcatgggaatcatacaagagcgcgactcggaccgatg

SEQ ID NO: 5242 - DNA, 203 bp, Homo sapiens
ggcgcgccagtcctttgccaacacgtattcctcttacttgttcttccatgtaatcaccttatacatgaacgccctagactgggatgaagaaaagaccatcctagcattatggaaagatttaacctcagtggacatcgggaaggacttggtaaagttcaaagaccaaatatggggactgctgatcgtgacgactcggaccgatg

SEQ ID NO: 5243 - DNA, 203 bp, Homo sapiens
ggcgcgccagtcctcaaaggactttgtttactcccaaagttccaattgtctttttgacagaaactacacacttatgctaaaagatcttttcttgtctcgcttcaactccttaatggtcttactttctcccccagagccccgatactcagatgacttgatatctcagctatgccagctgtacattgctgcgactcggaccgatg

SEQ ID NO: 5244 - DNA, 203 bp, Homo sapiens
ggcgcgccagtcctggcacaagctcccgatcacgcaaatctttgagattcctgaatcaatggatccatcagaaatattggatgacaaatcacattctttcaccagaacgagactagcttcttggctgtcagaaaaccgaggggggcctgttcctagcgaaaaagttattatcacggccctgtctaagccgactcggaccgatg

SEQ ID NO: 5245 - DNA, 203 bp, Homo sapiens
ggcgcgccagtcctatggccaggatggcgggctagaaggcttacggcagaagggctggagtctagtcagcttattgatgatagatagagaatctcaaatcaggaacacaagaaccaaagtactagctcaaggagacaaccaggttttatgtccgacatatatgttgtcgccagggctatctcaagaggcgactcggaccgatg

SEQ ID NO: 5246 - DNA, 203 bp, Homo sapiens
ggcgcgccagtcctagtccaaaagatgggccagagtctcttgcgtctctaatgaccaaatagtcaacctcgccaatataatgtcgacagtgtccaccaacgcgctaacagtggcacaacactctcaatctttgatcaaaccgatgagggattttctgctcatgtcagtacaggcagtctttcactacccgactcggaccgatg

SEQ ID NO: 5247 - DNA, 203 bp, Homo sapiens
ggcgcgccagtcctggttatccttctggagagagatctggttaagctcccacgagtcctggattcacgcgttgtgtcaagaggctggaaacccagatcttggagagagaacactcgagagcttcactcgccttctagaagatcctaccaccttaaatatcagaggaggggccagtcctaccattctaccgactcggaccgatg

SEQ ID NO: 5248 - DNA, 203 bp, Homo sapiens
ggcgcgccagtccttgggaatccccgagtcaatcattggactgatacaaaactcccgaacgataagaaggcagtttagaaagagtctctcaaaaactttagaagaatccttctacaactcagagatccacgggattagtcggatgacccagacacctcagagggttgggggggtgtggccttgctcttcgactcggaccgatg

SEQ ID NO: 5249 - DNA, 203 bp, Homo sapiens
ggcgcgccagtcctatcagtcatttttttgcacggggcccctaaaggggtacttgggctcgtccacctctatgtcgacccagctattccatgcatgggaaaaagtcactaatgttcatgtggtgaagagagctctatcgttaaaagaatctataaactggttcattactagagattccaacttggctccgactcggaccgatg

SEQ ID NO: 5250 - DNA, 203 bp, Homo sapiens
ggcgcgccagtcctttaatagacctcttgaattgatctcaggggtaatctcatatattctcctgaggctagataaccatccctccttgtacataatgctcagagaaccgtcttttagagaagagatattttctatccctcagaaaatccccgccgcttatccaaccactatgaaagaaggcaacagatcgactcggaccgatg

SEQ ID NO: 5251 - DNA, 203 bp, Homo sapiens
ggcgcgccagtcctctggagattacagccccaacaagaaggtgtcccgtaaggtaggatgttcagaatgggtctgctctgctcaacaggttgcagtctctacctcagcaaacccggcccctgtctcggagcttgacataagggccctctctaagaggttccagaaccctttgatctcgggcttgagagcgactcggaccgatg

SEQ ID NO: 5252 - DNA, 203 bp, Homo sapiens
ggcgcgccagtccttggttcagtgggcaaccggtgctcattataagcttaagcctattctagatgatctcaatgttttcccatctctctgccttgtagttggggacgggtcaggggggatatcaagggcagtcctcaacatgtttccagatgccaagcttgtgttcaacagtcttttagaggtgaatgcgactcggaccgatg

SEQ ID NO: 5253 - DNA, 203 bp, Homo sapiens
ggcgcgccagtcctaaagcgggccatcgtagccgtgatacccagacctgtgttcacgcagatgcaggtcagtgatcacccagcactccacgcaatttcgcggtatacccgccgccattggatcgagtggggccctaaagaagccctacacgtcctcatcgacccaagcccgggcctgctccgcgaggtcgactcggaccgatg

SEQ ID NO: 5254 - DNA, 203 bp, Homo sapiens
ggcgcgccagtcctcggcggttgccccgccgattgccgcggagccggcgctgggcccacgcccggctacacccgcccctgcaccacacgcatctaccaagtcctgccggacaccgcccaccccgggcgcctctaccggtgcgggccccgcctgtggacgcgcgattgcgccgtggccgaactctcatgcgactcggaccgatg

SEQ ID NO: 5255 - DNA, 203 bp, Homo sapiens
ggcgcgccagtcctcgccgccttcgaccgcggccccctcgaggacggcgggcgccacttggacaccgtgcaacccccaaaatcgccgccccgccctgagatcgccgcgacctggatcgtccacgcagccagcgaagaccgccattgcgcgtgcgctccccgctgcgacgtcccgcgcgaacgtccttccgactcggaccgatg

SEQ ID NO: 5256 - DNA, 203 bp, Homo sapiens
ggcgcgccagtcctaaccagggcagacccagacagcgacatcgttgaaagttacgcccgcgccgccggacccgtgcacctccgagtccgcgacatcatggacccaccgcccggctgcaaggtcgtggtcaacgccgccaacgaggggctactggccggctctggcgtgtgcggtgccatctttgccaacgactcggaccgatg

SEQ ID NO: 5257 - DNA, 203 bp, Homo sapiens
ggcgcgccagtcctcgccacgctgacgcacgcctccgtgctcgtcggcgcggggctcgctgccaggcgcgtcagtcctcctccgaccgagcccctcgcatcttgccccgccggtgacccgggccgaccggctcagcgcagcgcgtcgcccccagcgaccccccttggggatgccaccgcgcccgagcccgactcggaccgatg

SEQ ID NO: 5258 - DNA, 203 bp, Homo sapiens
ggcgcgccagtcctccgcggatgccaggggtgcgaactctgccggtacacgcgcgtcaccaatgaccgcgcctatgtcaacctgtggctcgagcgcgaccgcggcgccaccagctgggccatgcgcattcccgaggtggttgtctacgggccggagcacctcgccacgcattttccattaaaccactacgactcggaccgatg

SEQ ID NO: 5259 - DNA, 203 bp, Homo sapiens
ggcgcgccagtcctagacccaaacacctgctggctccgcgccgccgccaacgttgcgcaggctgcgcgcgcctgcggcgcctacacgagtgccgggtgccccaagtgcgcctacggccgcgccctgagcgaagcccgcactcatgaggacttcgccgcgctgagccagcggtggagcgcgagccacgccgactcggaccgatg

SEQ ID NO: 5260 - DNA, 203 bp, Homo sapiens
ggcgcgccagtcctgcgccccgaggggggcaaccccaccggccacttcgtctgcgcggtcggcggcggcccacgccgcgtctgggaccgcccccacctctggcttgcggtccccctgtctcggggcggtggcacctgtgccgcgaccgacgaggggctggcccaggcgtactacgacgacctcgaggtcgactcggaccgatg

SEQ ID NO: 5261 - DNA, 203 bp, Homo sapiens
ggcgcgccagtcctgcgccgcctcggggatgacgccatggcccgggcggccctcgcatcagtccaacgccctcgcaaaggcccttacaatatcagggtatggaacatggccgcaggcgctggcaagactacccgcatcctcgctgccttcacgcgcgaagacctttacgtctgccccaccaatgcgctcgactcggaccgatg

SEQ ID NO: 5262 - DNA, 203 bp, Homo sapiens
ggcgcgccagtcctcggcaccttcgcctgcaacctttgggacggccgccaggtcgaccttcacctcgccttctcgcgcgaaaccgtgcgccgccttcacgaggctggcatacgcgcatacaccgtgcgcgaggcccagggtatgagcgtcggcaccgcctgcatccatgtaggcagagacggcacggacgactcggaccgatg

SEQ ID NO: 5263 - DNA, 203 bp, Homo sapiens
ggcgcgccagtcctcatgcgcatctcgcgtcacctgctcaacaagaatcacaccgagatgcccggaacggaacgcgttctcagtgccgtttgcgccgtgcggcgctaccgcgcgggcgaggatgggtcgaccctccgcactgctgtggcccgccagcacccgcgcccttttcgccagatcccaccccccgactcggaccgatg

SEQ ID NO: 5264 - DNA, 203 bp, Homo sapiens
ggcgcgccagtcctcgccttgcgcccgcaattccttgtggccgctggccatacggagcccgaggtcgatgcgtggtggcaggcccattacaccaccaacgccatcgaggtcgacttcactgagttcgacatgaaccagaccctcgctactcgggacgtcgagctcgagattagcgccgctctcttgggcgactcggaccgatg

SEQ ID NO: 5265 - DNA, 203 bp, Homo sapiens
ggcgcgccagtcctcctcttccatgatgtcatgcaccaggcgatcaaggtgctttgccgccgtttcgacccagacgtgcttgaagaacagcaggtggccctcctcgaccgcctccggggggtctacgcggctctgcctgacaccgttgccgccaatgctgcgtactacgactacagcgcggagcgcgtcgactcggaccgatg

SEQ ID NO: 5266 - DNA, 203 bp, Homo sapiens
ggcgcgccagtcctcgaggcctgcgtgacctcgtggctttggagcgagggcgaaggcgcggtcttttaccgcgtcgacctgcatttcaccaacctgggcacccccccactcgacgaggacggccgctgggaccctgcgctcatgtacaacccttgcgggcccgagccgcccgctcacgtcgtccgcgccgactcggaccgatg

SEQ ID NO: 5267 - DNA, 203 bp, Homo sapiens
ggcgcgccagtcctgacccgctccgcgcgccatccttggcgcatccgcttcggtgccccccaggccttccttgccgggctcttgctcgccacggtcgccgttggcaccgcgcgcgccgggctccagccccgcgctgatatggcggcacctcctacgctgccgcagcccccctgtgcgcacgggcagcacgactcggaccgatg

SEQ ID NO: 5268 - DNA, 203 bp, Homo sapiens
ggcgcgccagtccttcataccaagcacatggacttctggtgtgtggagcacgaccgaccgccgcccgcgaccccgacgcctctcaccaccgcggcgaactccacgaccgccgccacccccgccactgcgccggccccctgccacgccggcctcaatgacagctgcggcggcttcttgtctgggtgcggcgactcggaccgatg

SEQ ID NO: 5269 - DNA, 203 bp, Homo sapiens
ggcgcgccagtcctcgtgcccgcccatccaggcgcccgctgccccgaactggtgagccccatgggacgcgcgacttgctccccagcctcggccctctggctcgccacagcgaacgcgctgtctcttgatcacgccctcgcggccttcgtcctgctggtcccgtgggtcctgatatttatggtgtgccgcgactcggaccgatg

SEQ ID NO: 5270 - DNA, 203 bp, Homo sapiens
ggcgcgccagtcctctcctctggcgggtacgcgcagctggcctcttacttcaaccctggcggcagctactacaagcagtaccaccctaccgcgtgcgaggttgaacctgccttcggacacagcgacgcggcctgctggggcttccccaccgacaccgtgatgagcgtgttcgcccttgctagctacgtcgactcggaccgatg

SEQ ID NO: 5271 - DNA, 203 bp, Homo sapiens
ggcgcgccagtcctgctgcgcactgcccctggacccggcgaggtgtgggtcacgcctgtcataggctctcaggcgcgcaagtgcggactccacatacgcgctggaccgtacggccatgctaccgtcgaaatgcccgagtggatccacgcccacaccaccagcgacccctggcatccaccgggccccttcgactcggaccgatg

SEQ ID NO: 5272 - DNA, 203 bp, Homo sapiens
ggcgcgccagtcctggggctgaagttcaagacagttcgcccggtggccctgccacgcacgttagcgccaccccgcaatgtgcgtgtgaccgggtgctaccagtgcggtacccccgcgctggtggaaggccttgcccccgggggaggcaattgccatctcaccgtcaatggcgaggacctcggcgccgtcgactcggaccgatg

SEQ ID NO: 5273 - DNA, 203 bp, Homo sapiens
ggcgcgccagtcctcccccctgggaagttcgtcaccgccgccctcctcaacacccccccgccctaccaagtcagctgcgggggcgagagcgatcgcgcgaccgcgcgggtcatcgaccccgccgcgcaatcgtttaccggcgtggtgtatggcacacacaccactgctgtgtcggagacccggcagaccgactcggaccgatg

SEQ ID NO: 5274 - DNA, 203 bp, Homo sapiens
ggcgcgccagtcctctgggcggagtgggctgctgcccattggtggcagctcactctgggcgccatttgcgccctcccactcgctggcttactcgcttgctgtgccaaatgcttgtactacttgcgcggcgctatagcgcctcgctagtgggcccccgcgcgaaacccgcactaggccactagatcccccgactcggaccgatg

SEQ ID NO: 5275 - DNA, 203 bp, Homo sapiens
ggcgcgccagtcctgaacagggacttgagaagaggcatcggcaccgaccgctgagttgctgagcgtcggagagggacgactcaggtagggtgagagcctacgagttttttgctacctagtcagcgagaaaggctaggccgcgacaggggcgcgggtcccattagtggcaaccaacccagttggacgaacgactcggaccgatg

SEQ ID NO: 5276 - DNA, 203 bp, Homo sapiens
ggcgcgccagtcctgggttggtaggggacgggtcggagcaatgggcgggggtcactcagcactgtcagggagaagcctcgacacgttcgagaagattaggctacgtccgaacgggaaaaagaagtaccaaattaaacatttaatatgggcaggaaaagaaatggaacgatttgggttacatgagaaaccgactcggaccgatg

SEQ ID NO: 5277 - DNA, 203 bp, Homo sapiens
ggcgcgccagtcctttggacatatgcaaagggaatgcaaggcaccaagacagatcaaatgctttaagtgcggcaaaattggccatatggcaaaagactgcaagaatggacaggcaaattttttagggtatggccattggggaggagcgaaaccaagaaattttgtgcaatacagaggagacacagttgcgactcggaccgatg

SEQ ID NO: 5278 - DNA, 203 bp, Homo sapiens
ggcgcgccagtcctgtctggaaccaacagcccccccaatggaaacagcttacgatccagcaaagaagctcctccagcagtatgcagagaagggacagcgcctgagagaggagagagaacagacaaggaaacagaaggagaaagaagtggaggatgtttccttgagctccctctttggaggagaccaatcgactcggaccgatg

SEQ ID NO: 5279 - DNA, 203 bp, Homo sapiens
ggcgcgccagtcctattggaggacagtggagaaaatgtaaatatagtcacagattctcaatatgtaatgaacatcttgacagcatgtccacaggaaagtaactcacccttagtggaacagataatacaagccctaatgaaaaagaggcaggtctacttacaatgggtaccagctcataaggggataggcgactcggaccgatg

SEQ ID NO: 5280 - DNA, 203 bp, Homo sapiens
ggcgcgccagtcctcaaaagatgattacatagaagtgaatatttatcacaacctcaccccagaaagaggatggctctcaagtcatggagtagggttatcctattaccatcaaaagggatataagacagaagtagatccaggaacagcagacagaatgatacacctatattattttaactgttttacagcgactcggaccgatg

SEQ ID NO: 5281 - DNA, 203 bp, Homo sapiens
ggcgcgccagtcctatagagccatccaacaggctatcagaggggagaagtatacgtggtgcacattcaaggaaggacataaaggtcaggtacaatcactgcaacttttggcactagttgcatatacaaatggcatcaggaagagatccaagagaacctttaccaggatggctggaaatctgggatctacgactcggaccgatg

SEQ ID NO: 5282 - DNA, 203 bp, Homo sapiens
ggcgcgccagtcctcaaaagtctatgtttgtacatttcagatgtggttgtagaaggagaggacctttttccccttacgaagagaggagaaatggacaaggaggaggagccccaccccctcctccaggacttgcataggccattacaaccatgtactaataaatgctattgcaaaaaatgctgttatcacgactcggaccgatg

SEQ ID NO: 5283 - DNA, 203 bp, Homo sapiens
ggcgcgccagtcctctggtaaaacaagcagagagtaatatacatctactctttgaacaaacgatgaggccttgtgttaagctctcccccatatgtattaaaatgtcctgtgtagagctgaatggtacagccacgacaaaggccaccactactgcaactacaacaatgactaccccctgtcagaattgccgactcggaccgatg

SEQ ID NO: 5284 - DNA, 203 bp, Homo sapiens
ggcgcgccagtcctatacattgtaatgattcagtgataaaagaagcttgtgataaaacatattgggatactttaagagtaagatactgtgcaccagcagggtatgctttgctaaaatgtaatgataaggattatagaggctttgctccaaagtgcaagaatgtttcagtagtgcattgtactagattacgactcggaccgatg

SEQ ID NO: 5285 - DNA, 203 bp, Homo sapiens
ggcgcgccagtcctatcaatactactataactacagggataggattaaatggtagtagatcagaaaatagaacagagatatggcagaaaggaggaaatgataatgatacagttataataaagttgaataagttttacaacttgacagtgagatgccgaagacctggtaataaaacagtgttgccagtacgactcggaccgatg

SEQ ID NO: 5286 - DNA, 203 bp, Homo sapiens
ggcgcgccagtcctgttgcctgccatatacgacaagtagtaaatgattggtacactgtctctaaaaaggtatatgctccaccaagggaaggtcatttggagtgtaactcatcagtcacggcactatacgtggcaatagattataacaacaagtctggcccaataaatgtgaccctaagtcctcaggtacgactcggaccgatg

SEQ ID NO: 5287 - DNA, 203 bp, Homo sapiens
ggcgcgccagtcctaagaatctggatctgtaccagaaattggatgattggtcagggttctggtcatggttctcactgtcaacttggttaggctatgttaaaataggatttttagtgatagtgattattctaggattaagatttgcatgggtattatggggatgtatcagaaatattaggcagggatatcgactcggaccgatg

SEQ ID NO: 5288 - DNA, 203 bp, Homo sapiens
ggcgcgccagtcctaatcctctcccccagatccatatccacagttcagcggaacggccagacaacggaggagggcaagacagaggtggagaaagcagcagcagcaaattgataagattgcaggaagagtcctcaacaccttcgaggatcaacaactggtggctcaacttcaagagctgcagcttgagacgactcggaccgatg

SEQ ID NO: 5289 - DNA, 203 bp, Homo sapiens
ggcgcgccagtcctgtaccgcccggacatgtttaaggacatgcacgaacatgcaaagcgctagtgtcagcactttgcggttgggactttccgccagggactttccacagtgggtggatcggaggcggtacaggggcggtactgggagtggctttcccctcagagctgcataaaagcagatgctcgctgcgactcggaccgatg

SEQ ID NO: 5290 - DNA, 203 bp, Homo sapiens
ggcgcgccagtcctgcttgtaactcagtctcttactaggagaccagctagagcctgggtgttcgctggttagcctaacccggttggccaccgggggtaaggactccttggcttcatatagctcaataaacctgctcgcttagtcgctatattggagtcaagtgctcattgctgcgccgagcctctagacgactcggaccgatg

SEQ ID NO: 5291 - DNA, 203 bp, Homo sapiens
ggcgcgccagtcctgttagcctaacccggttggccaccgggggtaaggactccttggcttcatatagctcaataaacctgctcgcttagtcgctatattggagtcaagtgctcattgctgcgccgagcctctagaggtgaacctctcttactgggttctcctgtacccaggtgggagaaactccagcacgactcggaccgatg

SEQ ID NO: 5292 - DNA, 203 bp, Homo sapiens
ggcgcgccagtcctaactcacccagacacagcaggaggcctttctcgcacgcctcactggccagggcaacatatccctaaaggaaaatgttgcgccagtcgagaaaaggaagaacaaatcccaaaagatattttcccagtgactgaaaccgttgatgggcaaggtcaagcctggagacaccataatggcgactcggaccgatg

SEQ ID NO: 5293 - DNA, 203 bp, Homo sapiens
ggcgcgccagtcctgcgttaagcactggaatatatggaccactgcctcccaacacttttggattaatcctaggccgaagtagcattactatgaagggtctacaagtttatccaggagtaattgataatgactataccggagaaattaaaattatggcaaaagctgttaacaatattgttactgtctctcgactcggaccgatg

SEQ ID NO: 5294 - DNA, 203 bp, Homo sapiens
ggcgcgccagtcctcaaggcaacagaatagctcaattaatcctcctgcctctgatcgagacagacaataaggtacaacaaccttatagaggacaaggaagttttggatcctcagacatatattgggtccaacctattacttgtcaaaaaccttccttaacattatggttagatgacaaaatgttcacacgactcggaccgatg

SEQ ID NO: 5295 - DNA, 203 bp, Homo sapiens
ggcgcgccagtcctccccagaaaaagttcaattacaagatccctacacatatttaggatttgaacttaatggtcctaaaatcactaatcaaaaagcagtcattcgtaaagataaattacagactcttaatgatttccaaaaacttttaggagacatcaattggctcagaccatatctaaaactcactacgactcggaccgatg

SEQ ID NO: 5296 - DNA, 203 bp, Homo sapiens
ggcgcgccagtcctctggagacttaaaacccttattcgacacccttaaaggagactctgaccccaattcccatagatccttatcaaaagaagctcttgcctcacttgaaaaggtagagacagccattgcagaacaattcgttactcacataaattattcactaccattaattttcctcatattcaacacgactcggaccgatg

SEQ ID NO: 5297 - DNA, 203 bp, Homo sapiens
ggcgcgccagtcctacaatgccttattagtttttactgatggctcttccactgggatggccgcatatactcttactgataccaccatcaaattccaaactaatcttaattcggctcaactagtagaactacaagctttaattgcagtcttatcagccttccctaatcaacctcttaatatttacactgcgactcggaccgatg

SEQ ID NO: 5298 - DNA, 203 bp, Homo sapiens
ggcgcgccagtcctacagtgcttacttagcccactcaatacccctacttgaaactgtcgcacaaattaaacacatatcagaaacagctaaactgttcctacagtgccagcaactcatatacaatagatccatacctttttatattggacatgtcagggcccattctggactacctggacccatagctccgactcggaccgatg

SEQ ID NO: 5299 - DNA, 203 bp, Homo sapiens
ggcgcgccagtccttagttgaaagagcccacttatctcttaaaaccaccattgaaaagataaaaaagggggaatggtaccctaggaagggtacccccaggaacatcctcaatcatgcactctttattctaaattttttaaatttagatgatcaaaataaatcagcagctgatcgtttttggcataatacgactcggaccgatg

SEQ ID NO: 5300 - DNA, 203 bp, Homo sapiens
ggcgcgccagtcctaccccaaaaaacaatttgccatggtaaaatggaaagatccattagataatacatggcatggccccgatccagtgttaatttggggcagaggttcagtctgtgtttactctcaaacctatgatgccgctagatggctaccagaacggttagtaagacaggtgtctaacaataacccgactcggaccgatg

SEQ ID NO: 5301 - DNA, 203 bp, Homo sapiens
ggcgcgccagtcctgatctcatatgattctgtacatgcctcttgctataaccactatcaacaatgtaacattggtaataaaacatatctcactgccactataactggagatagaactcctgccattggtgacgggaatgtccctacagtactagggactagtcacaacctcattacagcaggctgtcccgactcggaccgatg

SEQ ID NO: 5302 - DNA, 203 bp, Homo sapiens
ggcgcgccagtcctacgccgaagacaactgatcgacaacccattttggaccagttttcatggattcctcccttatgttatgcccctattaggccctttgctttgcttattgcttgtgttatctttcggtccaattattttcaacaagcttatgacctttattaaacatcaaattgagagcatccaggccgactcggaccgatg

SEQ ID NO: 5303 - DNA, 203 bp, Homo sapiens
ggcgcgccagtcctccaatgacgggtaatagtgacaagaaatgtatcactccaacctaagacaggcgcagcctccgagggatgtgtcttttgttttttataattaaaaagggtgacatgtccggagccgtgctgcccggatgatgtcttggcctctgtttgctctagctccatgttatgaatttaagacgactcggaccgatg

SEQ ID NO: 5304 - DNA, 203 bp, Homo sapiens
ggcgcgccagtcctatgagacttgatcagaacactgtcttgtctccatttcttgtgtctcttgttcccttcaattcccactccctcctccaggttcctactgttgatcccgcgggtcgggacagttggcgcccaacgtggggcacgaacccacgaccctgggattaagagtcccatgctctaccgactcgactcggaccgatg

SEQ ID NO: 5305 - DNA, 203 bp, Homo sapiens
ggcgcgccagtccttccatgttatgaatttaagatggcgtatttcctggttcttctccgtcttactttcccgccggcgcgaatgtttcccgctcttgggcttacgtggctttccttgctctgctactgagcatgcgcccagtatctttcccctcccacttgctgcctgtgtatataaggcaacacattcgactcggaccgatg

SEQ ID NO: 5306 - DNA, 203 bp, Homo sapiens
ggcgcgccagtcctactgacgtgattaccattccaacagctgctgggaaaaacctgtgcatcgtaagggctatggacgtaggatacctttgtgaggatactatcacttatgaatgtccggtcctagctgctggaaatgaccctgaagacattgactgctggtgcacgaaatcatctgtttacgtgcgccgactcggaccgatg

SEQ ID NO: 5307 - DNA, 203 bp, Homo sapiens
ggcgcgccagtcctggcgatagttgtgtgaccataatgtcaaaagacaagccaaccattgatgtcaaaatgatgaacatggaagcagccaacctcgcagatgtgcgcagttactgttacctagcttcggtcagtgacttgtcaacaagagctgcgtgtccaaccatgggtgaagcccacaacgagaaacgactcggaccgatg

SEQ ID NO: 5308 - DNA, 203 bp, Homo sapiens
ggcgcgccagtcctggaacggtggtgttggaactgcaatataccggaacagacggtccctgcaaagtgcccatttcttccgtagcttccctgaatgacctcacacctgttggaagactggtgaccgtgaatccatttgtgtctgtggccacagccaactcgaaggttttgattgaactcgaacccccgcgactcggaccgatg

SEQ ID NO: 5309 - DNA, 203 bp, Homo sapiens
ggcgcgccagtccttttggtgactcttacatcgtggtgggaagaggagaacagcagataaaccatcactggcacaaatctgggagcagcattggaaaggcctttaccaccacactcagaggagctcaacgactcgcagctcttggagatactgcttgggattttggatcagttggaggggttttcacccgactcggaccgatg

SEQ ID NO: 5310 - DNA, 203 bp, Homo sapiens
ggcgcgccagtccttcagtggggaaagccatacaccaagtctttggaggagcttttagatcactctttggagggatgtcctggatcacacagggacttctgggagctcttctgttgtggatgggaatcaatgcccgtgacaggtcaattgctatgacgtttcttgcggttggaggagttttgctcttccgactcggaccgatg

SEQ ID NO: 5311 - DNA, 203 bp, Homo sapiens
ggcgcgccagtcctttcctgaggattcgggaaacgaacacaacggaatgcgactcgaagatcataggaaccgccgtcaagaacaacatggctgtgcatagtgatctatcatactggatagagagcggactcaacgacacctggaagcttgagagggcggttctaggagaagtcaaatcatgcacctggcgactcggaccgatg

SEQ ID NO: 5312 - DNA, 203 bp, Homo sapiens
ggcgcgccagtcctccagaaacccacactctgtggggtgatggagttctggaaagtgatctcatcatacccatcaccttggcaggacccagaagcaaccacaacaggagaccagggtacaaaactcagaaccaaggcccatgggatgaggggcgcgtcgagattgactttgactattgcccaggaacacgactcggaccgatg

SEQ ID NO: 5313 - DNA, 203 bp, Homo sapiens
ggcgcgccagtcctgaaaagaccctcgtgcaatcgagagtgaatgcatacaacgccgacatgattgatccttttcagttgggccttatggtcgtgttcttggccacccaggaggtccttcgcaagaggtggacggccaagatcagcattccagctatcatgcttgcactcctagtcctagtgtttgggcgactcggaccgatg

SEQ ID NO: 5314 - DNA, 203 bp, Homo sapiens
ggcgcgccagtcctggtattacgtacactgatgtcctgcgatatgtcattctcgtcggcgccgcgtttgctgaagcaaactcaggaggagacgtcgtgcacttggcacttatggctacattcaagattcaaccagtctttctggtggcttcctttttgaaggcaaggtggaccaaccaagagagtattcgactcggaccgatg

SEQ ID NO: 5315 - DNA, 203 bp, Homo sapiens
ggcgcgccagtcctcctggattgaaatgcttaaaccttgatgtgtacagaattttgctactcatggttggagttggaagcctcatcaaagaaaaaaggagctctgcagcaaaaaagaaaggagcttgcctcatctgcctagcgctggcgtctacaggagtgttcaatccaatgatacttgcagctgggcgactcggaccgatg

SEQ ID NO: 5316 - DNA, 203 bp, Homo sapiens
ggcgcgccagtccttcaacagacatgtggattgagaggacggctgacattacttgggagagtgatgctgaaatcacaggctctagcgaaagagtagatgtgaggctggatgatgatggaaattttcaactgatgaatgaccccggggcaccatggaaaatttggatgcttaggatggcctgcctggcgcgactcggaccgatg

SEQ ID NO: 5317 - DNA, 203 bp, Homo sapiens
ggcgcgccagtccttatgggaacggcgtcatcatgcctaatggttcatacataagcgccattgtgcaaggagagagaatggaagaaccggcaccagctggcttcgaacctgaaatgttgaggaagaaacagatcactgtccttgatctgcaccccggagcaggaaagacacgcaagatacttccccaacgactcggaccgatg

SEQ ID NO: 5318 - DNA, 203 bp, Homo sapiens
ggcgcgccagtcctatcatcaaggaggccatcaacaaaagattgaggacggctgtgctggcacccaccagggtcgttgctgctgagatgtctgaggccctgagaggacttcccattcggtaccaaacctcagcagtgcacagagagcacagtggaaatgagatcgttgatgtcatgtgccatgccacccgactcggaccgatg

SEQ ID NO: 5319 - DNA, 203 bp, Homo sapiens
ggcgcgccagtcctgacccctttccagagtctaatgctcctatctcggacatgcaaacagagatcccagacagagcctggaacactggatatgaatggataactgagtatgttggaaagaccgtttggtttgttccaagtgtgaaaatgggaaatgagattgccctctgtctgcaacgggcggggaagcgactcggaccgatg

SEQ ID NO: 5320 - DNA, 203 bp, Homo sapiens
ggcgcgccagtcctggaagagtcatcctgggggaaccctcagccatcacggctgccagcgctgctcagcggagaggacgcataggaagaaacccatcacaagttggtgatgagtattgctatggagggcacacaaatgaggatgattccaactttgctcactggacagaggctcgcatcatgctagaccgactcggaccgatg

SEQ ID NO: 5321 - DNA, 203 bp, Homo sapiens
ggcgcgccagtcctaggccagaagctagagagacgaccctgggagttgagagcttcttacttgatctgcggccggccacggcatggtcgctctatgccgtaacgacagccgttctcacccctttgctgaagcatctaatcacgtcagactacatcaacacttcgttgacctcaataaacgtccaagcccgactcggaccgatg

SEQ ID NO: 5322 - DNA, 203 bp, Homo sapiens
ggcgcgccagtcctagaaccgtcagagaggccggaattctgactacagcagcagcagtcaccctatgggagaatggtgctagttcagtgtggaatgcaacgacagctattggcctttgtcacatcatgcgaggaggatggctctcgtgtctctccatcatgtggactctcatcaaaaacatggagaaacgactcggaccgatg

SEQ ID NO: 5323 - DNA, 203 bp, Homo sapiens
ggcgcgccagtcctccagtctcacggggaaccgcgaaattacggtggttagtggaaaggcgtttcctcgagccagtgggaaaggttgtggatctcgggtgtggtagaggcggctggtgctattacatggctacccagaagagggtacaggaagtgaaagggtacacgaaaggaggacctggccatgaacgactcggaccgatg

SEQ ID NO: 5324 - DNA, 203 bp, Homo sapiens
ggcgcgccagtcctgaaccacaactggtgcagagctatggttggaatattgttaccatgaagagtggagtcgacgtcttctacagaccatcagaagcgagcgacacactgctctgtgacattggagagtcatcgtcaagtgccgaggtagaagaacaccgcaccgtccgtgtcctggagatggtggaacgactcggaccgatg

SEQ ID NO: 5325 - DNA, 203 bp, Homo sapiens
ggcgcgccagtcctgattggttgcacagaggaccgaaggaattctgcatcaaagtgctatgcccttacatgcccaaagtgattgagaagatggaaacactccaaaggcgatatggaggtggccttataagaaaccccctttcacgcaactctacccatgagatgtactgggtgagccacgcttcaggccgactcggaccgatg

SEQ ID NO: 5326 - DNA, 203 bp, Homo sapiens
ggcgcgccagtcctgccatgacagacaccactcctttcggtcaacaacgagtgttcaaggaaaaggtggacacaaaggctccagagcctccagaaggagtcaaatacgtcctcaatgagaccacgaactggctgtgggcttttttagcccgcgataagaaacccaggatgtgttcccgggaggaatttcgactcggaccgatg

SEQ ID NO: 5327 - DNA, 203 bp, Homo sapiens
ggcgcgccagtcctattggaaaagtcaacagtaatgccgccctaggagcgatgtttgaagaacagaaccaatggaagaacgcccgggaagctgtagaggatccaaagttttgggagatggtggatgaggagcgtgaagcgcatctccgtggagaatgcaacacctgcatctacaacatgatgggaaagcgactcggaccgatg

SEQ ID NO: 5328 - DNA, 203 bp, Homo sapiens
ggcgcgccagtcctcgacacaaagtcgtgaaagtgatgaggccagcggccgacgggaaaactgtgatggacgtcatctctagagaggatcagagaggaagcggtcaggtagtgacttacgccctgaacaccttcaccaatctagcagttcagctggtcagaatgatggagggggagggggtcattggacgactcggaccgatg

SEQ ID NO: 5329 - DNA, 203 bp, Homo sapiens
ggcgcgccagtcctcccgatgatgttgaaaaactgggaaaaggaaaaggccctaaggtcagaacctggctgtttgagaatggcgaggagcgtctcagtcgcatggccgtcagcggtgatgactgcgtggtgaaacctttggacgaccgcttcgccacatcactacacttcctaaatgctatgtcaaagcgactcggaccgatg

SEQ ID NO: 5330 - DNA, 203 bp, Homo sapiens
ggcgcgccagtcctgtccgcaaagacatccaggaatggaaaccctcgacggggtggtatgactggcagcaggttccattctgttcaaaccatttcacggaactgatcatgaaggacggcaggacgctggtggtcccgtgtcgtggacaagacgagttgattggacgtgccaggatctctccaggggctcgactcggaccgatg

SEQ ID NO: 5331 - DNA, 203 bp, Homo sapiens
ggcgcgccagtcctggatggaatgtgcgcgacaccgcctgcctggcgaagtcatacgcgcagatgtggctgctgctttatttccaccgtagagacctgagattgatggccaatgccatctgttccgctgtgcctgccaactgggttcccacagggcgtaccacttggtcgatccacgcaaaaggagaacgactcggaccgatg

SEQ ID NO: 5332 - DNA, 203 bp, Homo sapiens
ggcgcgccagtccttcgtccaagccctcattcacatggcattggtgcttcatgccttgtttgcctccatcgaccggcgaattcgctcattatcccgacgtgttaccgctcttgaatctcgccgaaccacaggaaatcccatgacgctagctttcatcttgggctttctcacagtgttatgtggatgcgcgactcggaccgatg

SEQ ID NO: 5333 - DNA, 203 bp, Homo sapiens
ggcgcgccagtcctcagattgcggatcaacgtggactgagttcacattgcggtatcggagatgcgtcgtgaagaaacgtgaaaagcgatcacgtgaacccccgaaagcggatttgctagctgaaatggagatcattgcgttcaagaccattcgcgaaaataagacaatcttcatcgtggccctattgtcgactcggaccgatg

SEQ ID NO: 5334 - DNA, 203 bp, Homo sapiens
ggcgcgccagtcctacggtctcctcgagtttaaaacaggaccggcggagatctacggggggcaatggctgcgcgagttactcgcagattgccacgtcaacgcatcctattcgactgacgtgtgtcccggtggatcgcagctcaacatggcagatatcatggccaaggaacgagtatgctcgacccaaccgactcggaccgatg

SEQ ID NO: 5335 - DNA, 203 bp, Homo sapiens
ggcgcgccagtcctgtcggcacggcatggagaaagttgttgtgtggggagatgctaggtccaatgagattctagtaaaaaacgtaattgaaccttcgttgtcctgggaagacgcgatcgccactcatggtggattccgtgacatctcctttgtttgtcagattatgctcgacaaactagtcagtggagcgactcggaccgatg

SEQ ID NO: 5336 - DNA, 203 bp, Homo sapiens
ggcgcgccagtcctaggatctggtcggaaagttttcggttggtgccttcttctccaacacagcccttctggtcattctcgtcctcgctgccttgattgacaaacgcatagcctttctattggttttaggggggtacttttactatgtgcgggctgatctggggtgtggaattgacaccacgagaaaaacgactcggaccgatg

SEQ ID NO: 5337 - DNA, 203 bp, Homo sapiens
ggcgcgccagtccttgcgcagagctgctttctctgctgttgggtcgatgggttctgaacgggtgtatgtaaatgacacattggcgcgtacattcaagttctccgaaacagcaaagagaaccatttccgtcaccattaacttaattcagtacaagttctcatcttatgttgcacatggacgcgctgaggcgactcggaccgatg

SEQ ID NO: 5338 - DNA, 203 bp, Homo sapiens
ggcgcgccagtcctcaaaggtcaaagtggactctcgatgccatgggcgaatgcacgcccaggtaattggaccgaatgacacggaatcttggtgttgccagtcatgcacaagaatagtccactttcgagtcggtgacctcctatattaccccatggagatccaacttggaaccatgtctgaagcgtcagcgactcggaccgatg

SEQ ID NO: 5339 - DNA, 203 bp, Homo sapiens
ggcgcgccagtcctcattgcagcttatcggggcaaaaactagaacatcgacactaactcgcctatttctgacgattctcgcaatggcgctctttggactccccaacttgttttcatctgtggggctatctgcgtgggtgttgctggtggcgtcctcatcggcgcaaccgcaagacctatcaatgaatccgactcggaccgatg

SEQ ID NO: 5340 - DNA, 203 bp, Homo sapiens
ggcgcgccagtcctagcttgagttcatctcagctggagagactcccgaaggagtgtcaaccgaaaatgatgacgggataaatattcctgacttaaaagggcgctatggagaggatgggatcgtcgtgggggcggcctcatcgtctggttacctacctgagctcgtgtttgtgttcctcctaggctttgcgactcggaccgatg

SEQ ID NO: 5341 - DNA, 203 bp, Homo sapiens
ggcgcgccagtcctccgtgacgtccacttcatactttttgggggcactctacctgctcatcgcaaccagcactaacctccccgtggtcataatacggatgctgcgtatgaagctcactgctagcaaccgatctgatgatctcttgggactcggcggacctgttgaaactgacctccagaccagctttccgactcggaccgatg

SEQ ID NO: 5342 - DNA, 203 bp, Homo sapiens
ggcgcgccagtcctgcgacgtggtgtcgtatggtggaccttggcagttggacacccccaccaccacggaagacctcgtgctgatggcttgcaaaccggataagaccattgagtaccataggtacaggccgggagtcatgagtattgacggtgagcctgtcatgttcattagtgatgatttcggaaaagcgactcggaccgatg

SEQ ID NO: 5343 - DNA, 203 bp, Homo sapiens
ggcgcgccagtcctgatcttctggctcaccgttcttcatcaatggcgagcccgtcgggttctatggttttgggttctatgtgaacggtatttaccgctcaacagtagcaggtggcaaaccaaccgatgtcacggagagcttgaactgtgattcgaccaggcggtttgtgacatggcatccaggaaaagcgactcggaccgatg

SEQ ID NO: 5344 - DNA, 203 bp, Homo sapiens
ggcgcgccagtccttcggcatgacttttatgctagaggaagctgcatacagccagcctccggggagattcaccctagtgggagaggatagaatgcgatttttaaagcttatggaccgggatgacattcccatttggctggcgtggcactgggcagaagctggagaccgacggcactcagccctgtttccgactcggaccgatg

SEQ ID NO: 5345 - DNA, 203 bp, Homo sapiens
ggcgcgccagtcctagggcgcaggaaccggaaagatcatcgaaaaccgatttggcaaacaagagtatcgaccacaatacgttgatgaccgctttgagagcattgagtgggagacgcgaaaggtgtccattgatttctacatgaactgccgcggggggcctaccctctatgagttttttacagtggttgcgactcggaccgatg

SEQ ID NO: 5346 - DNA, 203 bp, Homo sapiens
ggcgcgccagtcctccgggccatctttcccaagttgggaaatagcgcaaggaaagggagctacaatgttggactctctgcaggtattcttcttcataacagtgttgtcaacaaaattcctgtattggttccaggagaactggactgcacgaatgtacgctatgaaacatccggagatggttagctcgacgactcggaccgatg

SEQ ID NO: 5347 - DNA, 203 bp, Homo sapiens
ggcgcgccagtcctttggtggatttagatttgatgaaattcccttcagggctgtccttccctctggttttgccattgtcgcgattgctagcctcccaagcgtggtggtggggcttctggcagctggtgtgttcatggccatcatgtactgtcagaacaagtggaatgccaccccaaagatcttgacagcgactcggaccgatg

SEQ ID NO: 5348 - DNA, 203 bp, Homo sapiens
ggcgcgccagtcctcattggacgctcgcgaccagaggcatgatcgtcccactgaaatcactagtagagtgccactcgaaaacactcgatccatcatgtatgccttttgcctgatcttcagcctgttttgggctttctgcacacggtctcctggagattttctccgagggtcattggtggtcggggctacgactcggaccgatg

SEQ ID NO: 5349 - DNA, 203 bp, Homo sapiens
ggcgcgccagtccttggacgtcgttggccgtcgagaccaacgtgggtcagggcaagtagtcacatatgcgttgaacaccataacaaatggtaaggtccaggtggcgagagttttagaaagtgaaggactactgcaagcggatgaatcggtgttggatgcgtggttggaaaaacaccttgaagaagctccgactcggaccgatg

SEQ ID NO: 5350 - DNA, 203 bp, Homo sapiens
ggcgcgccagtcctatttgcgcctaggtttcattgctatctcatcggctgtgccaaccaattggttcccactaggacgcacctcgtggtcagtccaccagtatcacgaatggatgaccactgatgatatgcttcgggtttggaatgacgtgtgggtgcacaacaacccgtggatgctaaacaaggagtcgactcggaccgatg

SEQ ID NO: 5351 - DNA, 203 bp, Homo sapiens
ggcgcgccagtcctagctctcagtcatgagtcgatatcgaagaggaaatgatgtcatttagacgtgatcgaatagagccgtgaggaaccagcatcctcccggccacaggagcagggcatgaaaatgtcgggcatgacgaacccgctcccccgagtcccctggcaacagggtgtgttcccttatggagccgactcggaccgatg

SEQ ID NO: 5352 - DNA, 203 bp, Homo sapiens
ggcgcgccagtccttagccagctgatggtcttaagcatcccccccatggaatgggtaagagaagcctgtaaacaaaactggatggcaccagtgctcttataaaatggcagccaaagcgatccagagctttcaaaactggacggggcaacagggagaaatcccggggtagcgaacctcctccgtaaatgcgactcggaccgatg

SEQ ID NO: 5353 - DNA, 203 bp, Homo sapiens
ggcgcgccagtcctattatttgacacaaatcatcaggttagtatctgtaatcagataatagatgcaataaactcagggattgatcttggagatctcctagaagggggtttgctgacgttgtgtgttgagcattactataattctgataaggataaattcaacacaagtcctatcgcgaagtacttacgcgactcggaccgatg

SEQ ID NO: 5354 - DNA, 203 bp, Homo sapiens
ggcgcgccagtccttcaaggagtaaatttggtgacaggtcatgatgcctatgacagtatcattagtaattcagtaggtcaaactagattctcaggacttcttatcgtgaaaacagttctcgagttcatcttgcaaaaaactgattcaggggtgacactacatcctttggtgcggacctccaaagtaaacgactcggaccgatg

SEQ ID NO: 5355 - DNA, 203 bp, Homo sapiens
ggcgcgccagtcctaaatgaagttgctagtttcaagcaggcgttgagcaacctagcccgacatggggaatacgcaccatttgcacgggttctgaatttatcagggattaacaacctcgaacatggactctatcctcagctttcagcaattgcgctgggtgtggcaacagcacacggcagtacattggccgactcggaccgatg

SEQ ID NO: 5356 - DNA, 203 bp, Homo sapiens
ggcgcgccagtccttggtgtcaatgttggcgaacaatatcaacaactacgagaggcggcacatgatgcggaagtaaaactacaaaggcgacatgaacatcaggaaattcaagctattgccgaggatgacgaggaaaggaagatattagaacaattccaccttcagaaaactgaaatcacacacagtcacgactcggaccgatg

SEQ ID NO: 5357 - DNA, 203 bp, Homo sapiens
ggcgcgccagtcctgacactagccgtcctcagccagaaacgagaaaaattagctcgtctcgctgcagaaattgaaaacaatattgtggaagatcagggatttaagcaatcacagaatcgggtgtcacagtcgtttttgaatgaccctacacctgtggaagtaacggttcaagccaggcccatgaatcgcgactcggaccgatg

SEQ ID NO: 5358 - DNA, 203 bp, Homo sapiens
ggcgcgccagtccttgctcctcaggaagacacaaggatgagggaagcctatgaattgtcgcctgatttcacaaatgatgaggataatcagcagaattggccacaaagagtggtgacaaagaagggtagaactttcctttatcctaatgatcttctgcaaacaaatcctccagagtcacttataacagccgactcggaccgatg

SEQ ID NO: 5359 - DNA, 203 bp, Homo sapiens
ggcgcgccagtccttttatttgaatatttgaaccaccttttagtatcctattacttgttactattgtgtgagacaacataagccatcaaataacaatcacgggcaaggactgggcatactatggtggtcttagagcattgtccagtgctacaaattcttttttcaattgctataattatacaactacacgactcggaccgatg

SEQ ID NO: 5360 - DNA, 203 bp, Homo sapiens
ggcgcgccagtcctcaaggggatgtcagaaatgttagccaaatacgaccaccttgtaatttcaactggaagaaccactgcaccagctgctgcctttgatgcctacttaaatgagcatggtgtccctccccctcaacccgcgattttcaaagatcttggggttgcccaacaagcttgtagtaaggggaccgactcggaccgatg

SEQ ID NO: 5361 - DNA, 203 bp, Homo sapiens
ggcgcgccagtcctgggtgatttaaacctagatgatcagttcaaagggaatgtctgccatgctttcactttagaggcaataattgacatatctgcatataacgagcgaacagtcaaaggcgttccggcatggctgcctcttgggattatgagcaattttgaatatcctttagctcatactgtggccgccgactcggaccgatg

SEQ ID NO: 5362 - DNA, 203 bp, Homo sapiens
ggcgcgccagtcctcacctacaatctcactaatttagtattgagtgtgcaaaaacttcctgatgatgcctggcgcccatccaaggacaaattaattgggaacactatgcatcccgcagtctccatccacccgaatctgccgcctattgttctaccaacagtcaagaagcaggcttatcgtcagcacaacgactcggaccgatg

SEQ ID NO: 5363 - DNA, 203 bp, Homo sapiens
ggcgcgccagtcctagcacctgagaacttccctttgaatggcttcaataacagacaagttgtgctagcgtatgcgaatccaacgctcagtgccgtttgaaatgatgctcaaatgagacaggagtccatctgtataagaagtatggcttaaatggatatttgtcaaattcttacaagattagtttgtatcgactcggaccgatg

SEQ ID NO: 5364 - DNA, 203 bp, Homo sapiens
ggcgcgccagtccttaacatatgtcattgtgccctccattgctaagtcaactcaactgacgataatactccttctgaaatagtaagaaaaactaatgaagaacattaattgctgggtaaaagtgattaatttctttaaatttgaccagaataatattttgtcagtgaatatattctcatatcacttgacgactcggaccgatg

SEQ ID NO: 5365 - DNA, 203 bp, Homo sapiens
ggcgcgccagtcctttaaaaacagaaaattaccctaacatgaagaccacatgtttccttatcagtcttatcttaattcaagggacaaaaaatctccccattttagagatagctagtaataatcaaccccaaaatgtggattcggtatgctccggaactctccagaagacagaagacgtccatctgatgcgactcggaccgatg

SEQ ID NO: 5366 - DNA, 203 bp, Homo sapiens
ggcgcgccagtcctcctcctaccaacatccgtgactatcctaaatgcaaaactatccatcatattcaaggtcaaaaccctcatgcacaggggatcgcccttcatttatggggagcattttttctgtatgatcgcattgcctccacaacaatgtaccgaggcaaagtcttcactgaagggaacatagcacgactcggaccgatg

SEQ ID NO: 5367 - DNA, 203 bp, Homo sapiens
ggcgcgccagtcctaaaaaaggccccgccacaacggcaccaaacacgacaaatgagcatttcaccagtcctccccccacccccagctcgactgcacaacatcttgtatatttcagaagaaagcgaagtatcctctggagggaaggcgacatgttcccttttctggatgggttaataaatgctccaattcgactcggaccgatg

SEQ ID NO: 5368 - DNA, 203 bp, Homo sapiens
ggcgcgccagtcctttattgagagtcacaactgaggaaagaacattctccttaatcaatagacatgctattgactttctactcacaagatggggaggaacatgcaaagtgcttggacctgattgttgcatcgggatagaagacttgtccaaaaatatttcagagcaaattgaccaaattaaaaaggaccgactcggaccgatg

SEQ ID NO: 5369 - DNA, 203 bp, Homo sapiens
ggcgcgccagtccttaggactttaggacaattgctactgagccctttttctaatctactgaaatcaacttgggagatttttaagaagctgataacttaatgtgaatcaatagtttatgtattatcgattattatggtttgatattcaattgttattattgtcaggagtgaccttttctatttgatgcacgactcggaccgatg

SEQ ID NO: 5370 - DNA, 203 bp, Homo sapiens
ggcgcgccagtcctacgtgctgttcaaagagtcttaatttataaccaactattgcaagaattaatttactttttccgttatacttagttacattaatcttttgactgttcagcattattaacgacttgtcttaattcaatcgttcggatgaaattcataaggaaaaatgagcctccttccccctattccgactcggaccgatg

SEQ ID NO: 5371 - DNA, 203 bp, Homo sapiens
ggcgcgccagtcctcaacctcgcggaagaagtcgaacccgcaaccaccaagtcacaccgactatatatcatgaaactcaattgccctccaaacctcattataccaattatcatccacgtgcaagatcgatgagctcaacccgtagtagtgcagaaagtagtcccaccaatcatattccccgtgctcgacgactcggaccgatg

SEQ ID NO: 5372 - DNA, 203 bp, Homo sapiens
ggcgcgccagtccttaggaacagatttggagctgtttggaatagcagattttgttatttttaaggttccagtaaaaacaataatccgaaatgctgtaagcttacaagcttcaaaaccgggattaagaatatggtaccgtgaccaaaacttgaccccttatctatgcgacgatgagtttattgtaagcgcgactcggaccgatg

SEQ ID NO: 5373 - DNA, 203 bp, Homo sapiens
ggcgcgccagtcctaggacggtttcaaattgattaaacacttagaacccttgtgtgtcagctgtatacaaacacatggcatctttacaccaagaaaatactggttccaatcacagatgattaagtcatattatgatgaactccatgatctcaatttgaaacttcaaatttcagacaataaggctgagtcgactcggaccgatg

SEQ ID NO: 5374 - DNA, 203 bp, Homo sapiens
ggcgcgccagtcctccctgctagcagatggactggcaaaagcattccctagtaacatgatggttgtcactgagagggaacagaaagaagcattattacatcaggcttcttggcaccacaattcagcaagcataggggagaacgctatagtgaggggtgcaagttttgttactgatcttgagaaatacacgactcggaccgatg

SEQ ID NO: 5375 - DNA, 203 bp, Homo sapiens
ggcgcgccagtcctcaattgatgctcccaacgattatcaagagaacgaggctgaattgaatgcggcacgagttgctgtcgaattagctattactacaggttatagtggtatatttttaaagcctgaggaaacatttgtccattcagggttcatttattttggtaaaaagcaatatctcaacggtgttccgactcggaccgatg

SEQ ID NO: 5376 - DNA, 203 bp, Homo sapiens
ggcgcgccagtcctactcaaaatcaactataaacttgttgccgtatgactgtaaggaactgcgacttgaaggaagcaatgacacagagttaaattatgtcagttgtgctcttgaccggaaagttgtccagaaacatccctctgttaatcgtctagcttggacgataggaaatcgagcaccgtatattgcgactcggaccgatg

SEQ ID NO: 5377 - DNA, 203 bp, Homo sapiens
ggcgcgccagtcctagacggtgcttaactttttacctacacactactcaggcaacatagttcatagatataatgatcaatatggacaacattcctttatggcaaacaggatgagtaatacatctacacgtgcaattatatcaactaacacactgggtaaatatgctgggggaggtcaagctgctattgcgactcggaccgatg

SEQ ID NO: 5378 - DNA, 203 bp, Homo sapiens
ggcgcgccagtcctttaagaacctctcagatttgacattccttatatcatccacaatcaggaatttatcacatagatcacttcggattcttcaatctactttccgacatgaattggtgctcacccgactagcccaccacataccgttaatttctttaatgttagggggctctgcaggagagaagagttcgactcggaccgatg

SEQ ID NO: 5379 - DNA, 203 bp, Homo sapiens
ggcgcgccagtccttccttataaaatcactagatgcacatgaggactttgatgcctcgaagataatcttaaattctgaaataaataatcttaaccttacggagtatactcttaatacaaagttattgacaactcctaccaggacagaaattttagatacaagtccgttacaatcctctagatattcatcgactcggaccgatg

SEQ ID NO: 5380 - DNA, 203 bp, Homo sapiens
ggcgcgccagtccttgaagaatgctattcagtattatgggcaagttcaactcaagaaaccatatagctcaaatgcaaaaaactcagaatggtacttgtgttgcggtaaacgaagaattcaacggctccaaattgatttctcagaccaggtgggaatttttctgatttgtaaagcaatgtcacgccaaacgactcggaccgatg

SEQ ID NO: 5381 - DNA, 203 bp, Homo sapiens
ggcgcgccagtcctgcgggtcgccaagatatgtctcaggaccctaagaaatttacagaccctgtgatggatgtcatacacgagatggctcctcccttgaaatcacccagtgctgaagcttgtggttatagtgatcgagttgcccaactcacaattggaaactccacaatcactacacaagaagctgcacgactcggaccgatg

SEQ ID NO: 5382 - DNA, 203 bp, Homo sapiens
ggcgcgccagtcctgattcggccctaaaccattgcaactttggcttaattgtagtgcccgtagtaccactcgactttaacgctggagctacatcagaaataccaataactgtcaccatcgcacccatgtgcgctgaatttgcaggtttgcgacaggcaatcaaacaggggatacctaccgagttgaagcgactcggaccgatg

SEQ ID NO: 5383 - DNA, 203 bp, Homo sapiens
ggcgcgccagtcctatgcaacgactatgcttccctgtctcggtgcagagtaagacgggggaattgtgtgctgtttttagggccgaccctggtaggaatggaccgtggcagtcgactattttaggacagttgtgtaggtactatactcaatggtctggatctctggaagtcactttcatgtttgctggacgactcggaccgatg

SEQ ID NO: 5384 - DNA, 203 bp, Homo sapiens
ggcgcgccagtcctaacatccagggtgatggaattgcagacatgattgaccaggctgtcacttcccgagttggtcgtgcgctgacatccttacaggtagaacctaccgccgccaacaccaatgctagtgagcacagattgggcaccgggctcgtccccgccttgcaggctgcagagaccggcgcctctcgactcggaccgatg

SEQ ID NO: 5385 - DNA, 203 bp, Homo sapiens
ggcgcgccagtcctatgggttatgctcaaatgaggcgtaagtgtgagctattcacatacatgcgctttgatgcagagtttacatttgtagctgccaaaccaaacggtgagctagtaccacaattgttgcagtacatgtatgtgcctcccggagctccaaaacctacgtcccgggattcctttgcctggcgactcggaccgatg

SEQ ID NO: 5386 - DNA, 203 bp, Homo sapiens
ggcgcgccagtcctgtcgagcggcaccttaatagggcggtgttgatcatgcagtccattgccactgtggtagcagttgtttcactggtgtatgttatctacaaattgtttgcagggttccaaggtgcatactctggtgcccctaagcaaacactcaagaaacctatactccgcacagcgacagtgcaacgactcggaccgatg

SEQ ID NO: 5387 - DNA, 203 bp, Homo sapiens
ggcgcgccagtcctgctgttgagttggtggatgaacaaggggtcaacttagaactgaccctggttactcttgataccaatgagaagttcagagacatcaccaagttcatcccagaaaacattagcgctgccagtgatgccaccctagtgatcaacacagagcacatgccctccatgttcgtgccagtgcgactcggaccgatg

SEQ ID NO: 5388 - DNA, 203 bp, Homo sapiens
ggcgcgccagtcctaagaggagttattttgccagtgagcaaggagagatccagtgggtcaagcccaataaagagacaggcagactcaacatcaatgggccgactcgcactaagctcgaacccagtgtgttccatgatgtctttgaggggaacaaagaaccagcagtcttgcatagcagagacccacgccgactcggaccgatg

SEQ ID NO: 5389 - DNA, 203 bp, Homo sapiens
ggcgcgccagtcctcttgaagtggactttgagcaggctttattctccaagtatgtagggaacacactgcatgagcctgacgagtacatcaaagaggcggccctccactatgcaaatcagttgaagcaactggacatcaacacttctcaaatgagtatggaggaagcttgctatggtactgagaaccttcgactcggaccgatg

SEQ ID NO: 5390 - DNA, 203 bp, Homo sapiens
ggcgcgccagtcctctgcttccaggttcactctttgcatttgattactcaggctatgatgctagtctcagtccagtctggtttagagcactggagctggtcctcagggaggtgggctatagtgaggaggcagtctcccttatagaggggattaaccatacacaccatgtataccgcaataaaacttaccgactcggaccgatg

SEQ ID NO: 5391 - DNA, 203 bp, Homo sapiens
ggcgcgccagtcctgattgcctggaattggcaagaacaggcaaagagtatggtttgactatgactcctgcagacaaatctccttgcttcaatgaggtaaattggggcaatgcaacctttctcaaaagaggcttcttgcccgatgagcaattccctttcttgatccatcctaccatgccaatgaaggagcgactcggaccgatg

SEQ ID NO: 5392 - DNA, 203 bp, Homo sapiens
ggcgcgccagtccttgtttccccggtcaatgaggatatgctttacccaaggcaaaaaccttagagatcgttatccccacactgcctacacagagcccagtaccatttttgatataattgggttggtcgctccctgcaaacccagcagtagacctggcagatgaggctggacattccccactggcgacacgactcggaccgatg

SEQ ID NO: 5393 - DNA, 203 bp, Homo sapiens
ggcgcgccagtcctgtggtccagcctgcgtggctgcctgctcacccttcttgggtgagaagcctaattattgacaaggtgtgaagagccgcgtgtgctcagtgtgcttcctccggcccctgaatgtggctaaccttaaccctgcagccgttgcccataatccaatgggtttgcggtcgtaatgcgtaacgactcggaccgatg

SEQ ID NO: 5394 - DNA, 203 bp, Homo sapiens
ggcgcgccagtcctgtgcgggatgggaccaactactttgggtgtccgtgtttcctgtttttcttttgattgcattttatggtgacaatttatagtgtatagattgtcatcatgggtgcacaagtatctagacaaaatgttgggacacactccacacaaaattcagtgagcaatggatctagcttaaatcgactcggaccgatg

SEQ ID NO: 5395 - DNA, 203 bp, Homo sapiens
ggcgcgccagtcctttggcatctgcaacaagtggaaatgtatcagtcgggtacaatcacacccacccaggtgagcaaggtagagaagtagtaccatcacggacatctagtgataataaaagacctagtgatgacagttggttaaattttgatggaacattacttggtaacttacctatttatccccaccgactcggaccgatg

SEQ ID NO: 5396 - DNA, 203 bp, Homo sapiens
ggcgcgccagtcctcaatacattaatctaaggactaacaattcagctacccttattttaccttatgtcaatgctgtaccaatggactctatgcttagacataataattggagcttggttataatcccaatatgccctcttcaggtccaacctggggggacacaatccatacctataacagtatcaattcgactcggaccgatg

SEQ ID NO: 5397 - DNA, 203 bp, Homo sapiens
ggcgcgccagtcctcaagttaggaatttaattgaaatgtgccaagttgacacactcattcctgttaacaatacacaggaaaatgtaagatctgtgaatatgtacactgttgatttacgcacacaagttgatttagctaaagaagtcttttctataccagtagatattgcctcacaacctttagccactcgactcggaccgatg

SEQ ID NO: 5398 - DNA, 203 bp, Homo sapiens
ggcgcgccagtcctgtttctgcatgcaaagatttttgcttaagattagccagagatactaacctacacacacaagaaggagtactcacacaaaacccagttgaaaattatatagatagtgtattaaatgaagttcttgtggtgccaaatatccaacctagcacatctgtgtcaagtcatgcagcgcctcgactcggaccgatg

SEQ ID NO: 5399 - DNA, 203 bp, Homo sapiens
ggcgcgccagtcctattgccactctcacccttctaggttgttcaggctcaccatggaggtttcttaaagagaaactctgtgcgtggctccagcttagctatgtacataagcagtctgattcatggctcaagaaatttactgaagcgtgtaacgcagcacgtgggctagagtggattggacaaaagatacgactcggaccgatg

SEQ ID NO: 5400 - DNA, 203 bp, Homo sapiens
ggcgcgccagtccttccttaaaattcttaccactgtatgcatctgaagcacgtagaattaagaatttatatatcaaatgcagtaatgttattaaagggggaaagaggaatgaaccagttgcagttctaatacatggttctcctggtactggaaaatctcttgccacttctgttcttgctcgaatgctacgactcggaccgatg

SEQ ID NO: 5401 - DNA, 203 bp, Homo sapiens
ggcgcgccagtcctagctttcgaccatgtgatgttaatattaaaataggcaatgctaagtgctgtccatttatctgtggaaaagctgtagagtttaaagatagaaattcatgtacaaccttgtctttatctcaattgtatagtcatataaaggaagaagataggagaagaagcagtgcagcacaagcacgactcggaccgatg

SEQ ID NO: 5402 - DNA, 203 bp, Homo sapiens
ggcgcgccagtcctatggaggctatatttcaaggtatagacctccaatctcctccacctccagccatagctgacctccttaggtctgtgaaaacaccagagatcattaagtattgccaagataataattggattgttccagcagagtgttctattgaaagagatttagggatagcaaatatgactatacgactcggaccgatg

SEQ ID NO: 5403 - DNA, 203 bp, Homo sapiens
ggcgcgccagtcctaattgctgtgttgtgacaaccgacaaaggcaaattcacaggtcttggcatatatgaccaagtcatggtacttccaacacattctgacccaggctctgagatcttggtagatggagtaaaagttaaggtctctgattcctatgatttgcataaccatgagggtgttaagctagagcgactcggaccgatg

SEQ ID NO: 5404 - DNA, 203 bp, Homo sapiens
ggcgcgccagtcctaaagaacttcctgtatctgtaaagaacttaccatccgtacatgtttcatctaaaacccgactacaacctagtgtttttcatgatgttttccctggaacaaaagagcctgcagttcttagtagtaatgatccaagactagaaactgactttgactcagcacttttctccaaatatcgactcggaccgatg

SEQ ID NO: 5405 - DNA, 203 bp, Homo sapiens
ggcgcgccagtccttttaatacaataatcaacaatattatcattagaactttggtactagatgcttataagaacatagatctagataaactgaaaatcttagcatatggggatgatgtcatcttttcttataattttaaacttgacatggcagttcttgccaaagaaggagaaaaatatggactaacacgactcggaccgatg

SEQ ID NO: 5406 - DNA, 203 bp, Homo sapiens
ggcgcgccagtcctgaacacgtgctatctttgtgtcatttaatgtggcataatggtagacatgcataccaggaattcattaaaggtatacgcagtgtatctgccggtcgggcactgtatataccagcttatgaagttcttgaacatgaatggtatgaaaaattttagatataaaactgttaaatatagcgactcggaccgatg

SEQ ID NO: 5407 - DNA, 203 bp, Homo sapiens
ggcgcgccagtcctagacgtgattctggtcgcccggagatcaagcatggaagccgtcataaaggtgatttcgtccgcgtgtaaaacctattgcggaaaaacctctccttctaagaaggaaatcggggccatgttgtccctcttacaaaaagaagggttgcttatgtctccctcagacttatattcccccgactcggaccgatg

SEQ ID NO: 5408 - DNA, 203 bp, Homo sapiens
ggcgcgccagtcctgagctgctcccgagtggtaaagattggtgattttggacttgccagagatatctataaaaatgattactacaggaaaagaggagaaggcctactccctgtcagatggatggctcctgaaagcctcattgatggcgtctttacaaatcactctgatgtttgggcttttggagtcttcgactcggaccgatg

SEQ ID NO: 5409 - DNA, 203 bp, Homo sapiens
ggcgcgccagtcctagtgtgggaaacattaactttgggtcaacagccatatccgggtctctccaatatagaagttttacaccatgtacgatcaggaggaaggctggaatctccgaataactgtcctgatgacatacgtgatttaatgacaagatgctgggcccaagatcctcacaacagacctactttcgactcggaccgatg

SEQ ID NO: 5410 - DNA, 203 bp, Homo sapiens
ggcgcgccagtcctttctagctcacggtcatggctgtgaggacattgccggaatgtgttgtttcaatctgagtgatcacagtgagtctatacagaaaaagttccaactaatgaaggaacatgtcaataagatcggcgtggacagcgacccaatcggaagttggctgcgaggactattcggaggaatagcgactcggaccgatg

SEQ ID NO: 5411 - DNA, 203 bp, Homo sapiens
ggcgcgccagtcctcttgcgaatcgggctgtaacggggaaggcttgactaggggaccatggtatgtataggcggaaggcggggcttcggttgtacgcggttaggagtcccctcaggatatagtagttgcgcttctgcatagggagggggaaatgtagtcttatgcaatactcttatgtaacgatgaaacgactcggaccgatg

SEQ ID NO: 5412 - DNA, 203 bp, Homo sapiens
ggcgcgccagtcctcctcgacgagtgtcgaaagagaccgcaacgaagacgcgtcaacccagagtccaaatgccaaatgggcttgtgttgatgcgcatgatggggatcttgtggcatgccgtagccggcaccgcgagaaaccccgtattgaaggcgttctggaactcagtccctctgaaacaggcaacacgactcggaccgatg

SEQ ID NO: 5413 - DNA, 203 bp, Homo sapiens
ggcgcgccagtcctgcagcactgcggaagatcaaaaggacggtgagtgccctaatggttggcttgcaaaaacgtgggaaaaggaggtcagcgacggactggatgagctggttgctggtcatcactctgttggggatgacgcttgctgcaacggtgaggaaagaaagggatggctcaactgtgatcagacgactcggaccgatg

SEQ ID NO: 5414 - DNA, 203 bp, Homo sapiens
ggcgcgccagtcctcttgccttggcaatggttaccgttgtgtggttgaccctggagagtgtggtgaccagggttgccgttcttgttgtgctcctgtgtttggcaccggtttacgcttcgcgttgcacacacttggaaaacagggactttgtgactggtactcaggggactacgagggtcaccttggtgcgactcggaccgatg

SEQ ID NO: 5415 - DNA, 203 bp, Homo sapiens
ggcgcgccagtcctatccttgagcttgacaagacagtggaacaccttccaacggcttggcaggtccatagggactggttcaatgatctggctctgccatggaaacatgagggagcgcaaaactggaacaacgcagaaagactggttgaatttggggctcctcacgctgtcaagatggacgtgtacaaccgactcggaccgatg

SEQ ID NO: 5416 - DNA, 203 bp, Homo sapiens
ggcgcgccagtcctctcggagaccagactggagtgttactgaaggctctcgctggggttcctgtggcacacattgagggaaccaagtaccacctgaagagtggccacgtgacctgcgaagtgggactggaaaaactgaagatgaaaggtcttacgtacacaatgtgtgacaaaacaaagttcacatggcgactcggaccgatg

SEQ ID NO: 5417 - DNA, 203 bp, Homo sapiens
ggcgcgccagtcctagttcaattgggaaggcggtacatacggtccttggtggcgctttcaacagcatcttcgggggagtggggtttctaccaaaacttttattaggagtggcattggcttggttgggcctgaacatgagaaaccctacaatgtccatgagctttctcttggctggaggtctggtcttgcgactcggaccgatg

SEQ ID NO: 5418 - DNA, 203 bp, Homo sapiens
ggcgcgccagtccttcatggcctgctagccacactatcgataatgctgacgtggtggactcagagttattccttccggcgagcctggcaggacccagatcctggtacaacaggatacctggctattcagaacaggtgaaagggccatggaagtacacgcctatccgagttatcagagaggagtgtccccgactcggaccgatg

SEQ ID NO: 5419 - DNA, 203 bp, Homo sapiens
ggcgcgccagtcctggcacgaccgttaccatcaacgccaagtgtgacaaaagaggagcatctgtgaggagtaccacagagagtggcaaggttatcccagaatggtgctgccgagcgtgcacaatgccaccagtgacgttccggactggaactgattgctggtatgccatggaaatacggccagtccatcgactcggaccgatg

SEQ ID NO: 5420 - DNA, 203 bp, Homo sapiens
ggcgcgccagtcctgtcaccgggatggtcaggatagagagcctggtgcgctatgtggtggcagtggggatcacattccaccttgagctggggccagagatcgtggccttgatgctactccaggctgtgtttgagctgagggtgggtttgctcagcgcatttgcattgcgcagaagcctcaccgtccgacgactcggaccgatg

SEQ ID NO: 5421 - DNA, 203 bp, Homo sapiens
ggcgcgccagtcctcagcaggatgtggtgactgtgcaccatggactggtgtgcttcctaagtgtagcttcggcatgctcggtctggaggctgctcaagggacacagagagcagaagggattgacctgggttgtccccctggctgggttgcttgggggagagggctctggaatcagactgctggcgtttcgactcggaccgatg

SEQ ID NO: 5422 - DNA, 203 bp, Homo sapiens
ggcgcgccagtccttggggtcagaaccaggtgggagttggctacggttccaagggtgtcttgcacacgatgtggcacgtgacgagaggagcggcgctgtctattgatgacgctgtggccggtccctactgggctgatgtgagggaagatgtcgtgtgttacggaggagcctggagcctggaggaaaaacgactcggaccgatg

SEQ ID NO: 5423 - DNA, 203 bp, Homo sapiens
ggcgcgccagtcctagagtcctcccggagctcattcgccaatgcattgacaggcgcctgagaacgttggtgttggctccaactcgtgtggtactcaaagaaatggagcgtgctttgaatgggaaacgggtcaggttccactcaccagcagtcagtgaccaacaggctggaggggcaattgtcgatgtgcgactcggaccgatg

SEQ ID NO: 5424 - DNA, 203 bp, Homo sapiens
ggcgcgccagtcctatgtgtcacgcaacctatgtcaacagaaggctactcccacagggaagacaaaattgggaggtggcaatcatggatgaggcccactggacggacccccacagcatagctgccagaggtcatttgtatactctggcaaaagaaaacaagtgtgcactggtcttgatgacagcgacacgactcggaccgatg

SEQ ID NO: 5425 - DNA, 203 bp, Homo sapiens
ggcgcgccagtcctcctcctggtaagagtgaaccctttccggagtccaatggagccattactagtgaggaaagacagattcctgatggggagtggcgtgacgggtttgactggatcactgagtatgaagggcgcaccgcctggtttgtcccttcgattgcaaaaggtggtgctatagctcgcaccttgcgactcggaccgatg

SEQ ID NO: 5426 - DNA, 203 bp, Homo sapiens
ggcgcgccagtcctagacagaaggggaaaagtgtgatttgtttgaacagcaaaacctttgaaaaggactactccagagtgagggatgagaagcctgactttgtggtgacgactgatatctcggagatgggagctaaccttgacgtgagccgcgtcatagatgggaggacaaacatcaagcccgaggagcgactcggaccgatg

SEQ ID NO: 5427 - DNA, 203 bp, Homo sapiens
ggcgcgccagtccttttctgactatggttgagatgatggtgctgggtttggcaaccctgggtgtcatctggtgcttcgtcgtccggacttcaatcagccgcatgatgctgggcacgctggtcctgctggcctccttgctactcttgtgggcaggtggcgtcggctatgggaacatggctggagtggctcgactcggaccgatg

SEQ ID NO: 5428 - DNA, 203 bp, Homo sapiens
ggcgcgccagtcctctcatcttttacacgttgctgacggtgctgcagcctgaggcgggaaaacagagaagcagtgacgacaacaaactggcatatttcttgctgacgctctgcagccttgctggactggttgcagccaatgagatgggctttctggagaagaccaaggcagacttgtccacggcgctgcgactcggaccgatg

SEQ ID NO: 5429 - DNA, 203 bp, Homo sapiens
ggcgcgccagtccttggagtgaacgggaggaaccccggccatggagtgaatggacgaatgtggacatccagccagcgaggtcctgggggacctatgtgctggtggtgtctctgttcacaccttacatcatccaccaactgcagaccaaaatccaacaacttgtcaacagtgccgtggcatctggtgcacgactcggaccgatg

SEQ ID NO: 5430 - DNA, 203 bp, Homo sapiens
ggcgcgccagtcctcaggccatgagagaccttgggggaggtgcccccttctttggtgtggcgggacatgtcatgaccctcggggtggtgtcactgattggggctactcccacctcactgatggtgggcgttggcttggcggcactccatctggccattgtggtgtctggtctggaggctgaattaacacgactcggaccgatg

SEQ ID NO: 5431 - DNA, 203 bp, Homo sapiens
ggcgcgccagtcctaagatggtaacaagcctgggttggaacttgattaaattcagatcaggaatggacgtgttcagcatgcagccacaccgggctgacactgtcatgtgtgacatcggagagagcagcccagatgccgctgtggagggtgagaggacaaggaaagtgatactgctcatggagcaatggcgactcggaccgatg

SEQ ID NO: 5432 - DNA, 203 bp, Homo sapiens
ggcgcgccagtcctgtgaaatcaaatgcagccttgggagcttggtcagatgagcaaaacagatgggcaagtgcaagagaggctgtagaggatcctgcattctggcgcctcgtggatgaagagagagaaaggcacctcatggggagatgtgcgcactgcgtgtacaacatgatgggcaagagagaaaagcgactcggaccgatg

SEQ ID NO: 5433 - DNA, 203 bp, Homo sapiens
ggcgcgccagtcctgtcgtgaaggtcgcgaggccttcccgtgatggaggctgcatcatggatgtcatcacaagaagagaccaaagaggttcgggtcaggttgtgacctatgcccttaacaccctcaccaacataaaggtgcaattaatccgaatgatggaaggggaaggggtcatagaggcagcggatcgactcggaccgatg

SEQ ID NO: 5434 - DNA, 203 bp, Homo sapiens
ggcgcgccagtcctgaatgggagcactcagccggcttttcaagctgggaggaggtacccttttgttcacaccatttccacgagctagtgatgaaggatggacgcaccctggtggtgccgtgccgagaccaagatgaactcgttgggagggcgcgcatctcaccggggtgcggctggagtgtccgcgagcgactcggaccgatg

SEQ ID NO: 5435 - DNA, 203 bp, Homo sapiens
ggcgcgccagtcctacgtgggggagttgatcccccccccccggcactgggtgcaagccccagaaaccgacgcctatctaagtagacgcaatgactcggcgccgactcggcgaccggccaaaaggtggtggatgggtgatgacagggttggtaggtcgtaaatcccggtcaccttggtagccactatagcgactcggaccgatg

SEQ ID NO: 5436 - DNA, 203 bp, Homo sapiens
ggcgcgccagtcctagtggcccctttcatgcccccagtatgtctatgggtctgctacagtcacttgcgtgtggggttccgcttcttggtttgcctccaccagtggtcgcgactcgaagatagatgtgtggagtttagtgccagttggctctgccacctgcaccatagccgcacttggatcatcggatccgactcggaccgatg

SEQ ID NO: 5437 - DNA, 203 bp, Homo sapiens
ggcgcgccagtcctgcgacacggtgcctgggctctccgagtggggaatcccgtgcgtgacgtgtgttctggaccgtcggcctgcctcctgcggcacctgtgtgagggactgctggcccgagaccgggtcggttaggttcccattccatcggtgcggcgtggggcctcggctgacaaaggacttggaagcgactcggaccgatg

SEQ ID NO: 5438 - DNA, 203 bp, Homo sapiens
ggcgcgccagtcctctgtgcccttcgtcaacaggacaactcccttcaccattagggggcccctgggcaaccagggccgaggcaacccggtgcggtcgcccttgggttttgggtcctacgccatgaccaggatccgagataccctacatctggtggagtgtcccacaccagccattgagcctcccaccgcgactcggaccgatg

SEQ ID NO: 5439 - DNA, 203 bp, Homo sapiens
ggcgcgccagtcctgcctgatgttcctcgtgttgtggaagcttgctcggggagctttcccgctggccctcttgatggggatttcggcgacccgcgggcgcacctcagtgctcggggccgagttctgcttcgatgctacattcgaggtggacacttcggtgttgggctgggtggtggccagtgtggtagcgactcggaccgatg

SEQ ID NO: 5440 - DNA, 203 bp, Homo sapiens
ggcgcgccagtcctcttgggccattgcgctcctgagctcgatgagcgcaggggggtggaggcacaaagccgtgatctataggacgtggtgtaaggggtaccaggcaatccgtcaaagggtggtgaggagccccctcggggaggggcggcctgccaaacccctgacctttgcctggtgcttggcctcgtcgactcggaccgatg

SEQ ID NO: 5441 - DNA, 203 bp, Homo sapiens
ggcgcgccagtcctagtgcgtcatgggtttacccgtggttgcgcgccgtggtgatgaggttctcatcggcgtcttccaggatgtgaatcatttgcctcccgggtttgttccgaccgcgcctgttgtcatccgacggtgcggaaagggcttcttgggggtcacaaaggctgccttgacaggtcgggatccgactcggaccgatg

SEQ ID NO: 5442 - DNA, 203 bp, Homo sapiens
ggcgcgccagtcctctgacttacatccagggaacgtcatggtgttggggacggctacgtcgcgaagcatgggaacatgcttgaacggcctgctgttcacgaccttccatggggcttcatcccgaaccatcgccacacccgtgggggcccttaatcccagatggtggtcagccagtgatgatgtcacggcgactcggaccgatg

SEQ ID NO: 5443 - DNA, 203 bp, Homo sapiens
ggcgcgccagtccttcacaaggatcactgactcccccctgacgtattcaacctatgggaggtttttggccaaccctaggcagatgctacggggcgtttcggtggtcatttgtgatgagtgccacagtcatgactcaaccgtgctgttaggcattgggagagtccgggagctggcgcgtgggtgcggggcgactcggaccgatg

SEQ ID NO: 5444 - DNA, 203 bp, Homo sapiens
ggcgcgccagtccttgcaactagtgctctacgccaccgctacacctcccggatcccctatgacgcagcacccttccataattgagacaaaattggacgtgggcgagattcccttttatgggcatggaatacccctcgagcggatgcgaaccggaaggcacctcgtgttctgccattctaaggctgagtcgactcggaccgatg

SEQ ID NO: 5445 - DNA, 203 bp, Homo sapiens
ggcgcgccagtcctgcgagcgccttgctggccagttctccgctaggggggtcaatgccattgcctattataggggtaaagacagttctatcatcaaggatggggacctggtggtctgtgctacagacgcgctttccactgggtacactggaaatttcgactccgtcaccgactgtggattagtggtggcgactcggaccgatg

SEQ ID NO: 5446 - DNA, 203 bp, Homo sapiens
ggcgcgccagtcctgctgggcaaaagttcgcggcgtcaactggcccctcttggtgggtgttcagcggaccatgtgtcgggaaacactgtctcccggcccatcggatgacccccaatgggcaggtctgaagggcccaaatcctgtcccactcctgctgaggtggggcaatgatttaccatctaaagtggcgactcggaccgatg

SEQ ID NO: 5447 - DNA, 203 bp, Homo sapiens
ggcgcgccagtcctgagaagtgttgtccttggctcaggctaagacggccgaggcctacacagcaaccgccaagtggctcgctggctgctatacggggacgcgggccgttcccactgtatccattgttgacaagctcttcgccggagggtgggcggctgtggtgggccattgccacagcgtgattgctgcgactcggaccgatg

SEQ ID NO: 5448 - DNA, 203 bp, Homo sapiens
ggcgcgccagtcctgccttgcggggatcgctctcgggttggttttgtattcagctaacaactctggcactaccacttggttgaaccgtctgctgactacgttaccaaggtcttcatgtatcccggacagttactttcagcaagttgactattgcgacaaggtctcagccgtgctccggcgcctgagcccgactcggaccgatg

SEQ ID NO: 5449 - DNA, 203 bp, Homo sapiens
ggcgcgccagtccttcacccgcacagtggttgccctggtcaacagggagcctaaggtggatgaggtacaggtggggtatgtctgggacctgtgggagtggatcatgcgccaagtgcgcgtggtcatggccagactcagggccctctgccccgtggtgtcactacccttgtggcattgcggggaggggtcgactcggaccgatg

SEQ ID NO: 5450 - DNA, 203 bp, Homo sapiens
ggcgcgccagtcctcatcgccagcacttatctcggttactgagagcagctcagatgagaagaccccgtcggtgtcctcctcgcaggaggataccccgtcctctgactcattcgaggtcatccaagagtccgagacagccgaaggggaggaaagtgtcttcaacgtggctctttccgtattaaaagcctcgactcggaccgatg

SEQ ID NO: 5451 - DNA, 203 bp, Homo sapiens
ggcgcgccagtccttatttccacagagcgacgcgaccaggaagcttaccgtcaagatgtcgtgctgcgttgaaaagagcgtcacgcgctttttctcattggggttgacggtggctgatgttgctagcctgtgtgagatggaaatccagaaccatacagcctattgtgaccaggtgcgcactccgcttgcgactcggaccgatg

SEQ ID NO: 5452 - DNA, 203 bp, Homo sapiens
ggcgcgccagtcctaattgcaggttgggtgcttggtgggcaatgaacttacctttgaatgtgacaagtgtgaggctaggcaagaaaccttggcctccttctcttacatttggtctggagtgccgctgactagggccacgccggccaagcctcccgtggtgaggccggttggctctttgttagtggccgcgactcggaccgatg

SEQ ID NO: 5453 - DNA, 203 bp, Homo sapiens
ggcgcgccagtcctacactactaaggtgtatgttaccaatccagacaatgtgggacggagggtggacaaggtgaccttctggcgtgctcctagggttcatgataagtacctcgtggactctattgagcgcgctaagagggccgctcaagcctgcctaagcatgggttacacttatgaggaagcaataacgactcggaccgatg

SEQ ID NO: 5454 - DNA, 203 bp, Homo sapiens
ggcgcgccagtcctggactgtaaggccacatgctgccatgggctggggatctaaggtgtcggttaaggacttagccacccccgcggggaagatggccgtccatgaccggcttcaggagatacttgaagggactccggtcccctttactcttactgtgaaaaaggaggtgttcttcaaagaccggaaggcgactcggaccgatg

SEQ ID NO: 5455 - DNA, 203 bp, Homo sapiens
ggcgcgccagtcctgcgacgctttgggcagagccctagcgagctatgggtacgcgtgcgagccctcatatcatgcatcattggacacggcccccttctgctccacttggcttgctgagtgcaatgcagatgggaagcgccatttcttcctgaccacggacttccggaggccgctcgctcgcatgtcgacgactcggaccgatg

SEQ ID NO: 5456 - DNA, 203 bp, Homo sapiens
ggcgcgccagtcctgtgagtatagtgacccgatggcttcggcgatcggttacatcctcctttatccttggcaccccatcacacggtgggtcatcatccctcatgtgctaacgtgcgcattcaggggtggaggcacaccgtctgatccggtttggtgccaggtgcatggtaactactacaagtttccaccgactcggaccgatg

SEQ ID NO: 5457 - DNA, 203 bp, Homo sapiens
ggcgcgccagtccttggacaaactgcctaacatcatcgtggccctccacggaccagcagcgttgagggttaccgcagacacaactaaaacaaagatggaggctggtaaggttctgagcgacctcaagctccctggcttagcagtccaccgaaagaaggccggggcgttgcgaacacgcatgctccgctcgactcggaccgatg

SEQ ID NO: 5458 - DNA, 203 bp, Homo sapiens
ggcgcgccagtcctcgcgcggttgggctgagttggctaggggcttgttgtggcatccaggcctacggcttcctccccctgagattgctggtatcccggggggtttccctctctcccccccctatatgggggtggtacatcaattggatttcacaagccagaggagtcgctggcggtggttggggttctcgactcggaccgatg

SEQ ID NO: 5459 - DNA, 203 bp, Homo sapiens
ggcgcgccagtccttagccctgctcatcgtagccctcttcgggtgaactaaattcatctgttgcggcaaggtctggtgactgatcatcaccggaggaggttcccgccctccccgccccaggggtctccccgctgggtaaaaagggcccggccttgggaggcatggtggttactaaccccctggcagggcgactcggaccgatg

SEQ ID NO: 5460 - DNA, 203 bp, Homo sapiens
ggcgcgccagtccttgtataaatgtacccgcttcttgcattgtattcagtcgctctgcggagaggctggcagatcgagccctgagaggttctctccagcactagcaggtagagcctgggtgttccctgctggactctcaccagtacttggccggtactgggcagacggctccacgcttgcttgcttaacgactcggaccgatg

SEQ ID NO: 5461 - DNA, 203 bp, Homo sapiens
ggcgcgccagtcctagacctcttcaataaagctgccagttagaagcaagttaagtgtgtgttcccatctctcctagtcgccgcctggtcattcggtgttcatctgagtaacaagaccctggtctgttaggacccttctcgctttgggaatccaaggcaggaaaatccctagcaggttggcgcccgaaccgactcggaccgatg

SEQ ID NO: 5462 - DNA, 203 bp, Homo sapiens
ggcgcgccagtcctagggacttgaagaggactgagaagccctggaactcggctgagtgaaggcagtaagggcggcaggaacaaaccacgacggagtgctcctagaaaggcgcgggccgaggtaccaaaggcggcgtgtggagcgggagtgaaagaggcctccgggtgaaggtaagtacctacaccaaacgactcggaccgatg

SEQ ID NO: 5463 - DNA, 203 bp, Homo sapiens
ggcgcgccagtccttgaggaagcaaagaaactagcacagagacatctagtggcagaaactggaactgcagagaaaatgccaaatacaagtagaccaacagcaccacctagtgggaaaagaggaaactaccccgtgcaacaagcgggtggcaactatgtccatgtgccactgagcccccgaactctaaacgactcggaccgatg

SEQ ID NO: 5464 - DNA, 203 bp, Homo sapiens
ggcgcgccagtccttgcatgggtaaaattagtggaggaaaagaagttcggggcagaagtagtgccaggatttcaggcactctcagaaggctgcacgccctatgatattaatcaaatgcttaattgtgtgggcgatcaccaagcagctatgcaaataatcagagagattattaatgaagaagcagcagacgactcggaccgatg

SEQ ID NO: 5465 - DNA, 203 bp, Homo sapiens
ggcgcgccagtcctcccagactgcaagttagtactaaaaggactggggatgaatcccaccctagaagagatgctaaccgcctgccagggggtaggcggaccaggccagaaagccaggctaatggctgaagccctaaaagaggctatgggaccaagccctatcccatttgcagcagcccaacaaagaaacgactcggaccgatg

SEQ ID NO: 5466 - DNA, 203 bp, Homo sapiens
ggcgcgccagtcctccccgtgacccaagcccctcaggggctgataccaacagcacctccggcagatccagcagcggaactgttggagagatatatgcagcaagggagaaagcagagggagcagagggagagaccatacaaagaggtgacggaggacttgctgcacctcgagcagagagagacacctcacgactcggaccgatg

SEQ ID NO: 5467 - DNA, 203 bp, Homo sapiens
ggcgcgccagtccttttgtatctaccccaccactggtcaggttaacatttaacctagtaggagatcctataccaggcgcagagaccttctacacagatggatcatgcaatagacagtcaaaagagggaaaagcaggatatgtaacagatagaggaaaagacaaagtaaaagtattagaacaaactacccgactcggaccgatg

SEQ ID NO: 5468 - DNA, 203 bp, Homo sapiens
ggcgcgccagtcctcttctagtagcaagacagatagtaaactcatgtgcccaatgccaacagaaaggagaagccatacatgggcaagtaaatgcagaaataggcgtttggcaaatggactacacacacttagaaggaaaaatcattatagtagcagtacatgttgcaagtggattcatagaagcagaacgactcggaccgatg

SEQ ID NO: 5469 - DNA, 203 bp, Homo sapiens
ggcgcgccagtcctgtcatcccacaggaatcaggaaggcagacagcactcttcctattaaaactggccagtaggtggccaataacgcacttgcacacagacaatggccccaacttcacttcacaggaagtgaagatggtggcatggtgggtaggtatagaacaatcctttggagtaccttacaacccacgactcggaccgatg

SEQ ID NO: 5470 - DNA, 203 bp, Homo sapiens
ggcgcgccagtcctattaccacagaacaagaaatacaattcctccaaagaaaaaattcaaattttaaaaatttccaggtctattacagagaaggcagagatcagctgtggaaaggacctggtgaactactgtggaagggagaaggagcagtcatagtcaaggtagggacagacataaaagtagtaccacgactcggaccgatg

SEQ ID NO: 5471 - DNA, 203 bp, Homo sapiens
ggcgcgccagtcctagaaggaaggccaagattatcagggactatggaggaagacaggaactggatagtagtccccacctggagggtgccagggaggatggagaaatggcatgcccttgtcaagtacctgaaatacagaacaaaagacctagaggaggtgcgctatgttccccaccacaaggtgggatgcgactcggaccgatg

SEQ ID NO: 5472 - DNA, 203 bp, Homo sapiens
ggcgcgccagtcctcctaatacatagcacttatttctcttgctttacggcaggtgaagtaagaagagccatcagaggggaaaagttattgtcctgctgcaactatccccaagctcataaagcacaggtaccatcacttcaatacctagccctagtagtagtacaacaaaatgacagaccccagagaaacgactcggaccgatg

SEQ ID NO: 5473 - DNA, 203 bp, Homo sapiens
ggcgcgccagtcctgggtaccgccaggaaacagtggagaagagaccattggagaggccttcgagtggctagagaggaccatagaagccttaaacagggaggcagtgaaccatctgccccgagagctcattttccaggtgtggcaaaggtcctggagatattggcatgatgaacaagggatgtcagcaacgactcggaccgatg

SEQ ID NO: 5474 - DNA, 203 bp, Homo sapiens
ggcgcgccagtcctgctacacaaagtatagatatttgtgcctaatgcaaaaagctatatttacacatttcaagagagggtgcacttgctggggggaggacatgggccgggaaggattggaagaccaaggacctccccctcctccccctccaggtctagtctaatgactgaagcaccaacagagtttcccgactcggaccgatg

SEQ ID NO: 5475 - DNA, 203 bp, Homo sapiens
ggcgcgccagtcctcccagaagatgggaccccacggagggacttagggagtgactgggtaatagaaactctgagggaaataaaggaagaagccttaagacattttgatccccgcttgctaattgctcttggctactatatccataatagacatggagacacccttgaaggcgccagagagctcattaacgactcggaccgatg

SEQ ID NO: 5476 - DNA, 203 bp, Homo sapiens
ggcgcgccagtcctggctcggaatatcatatgagcgaaagggcagacgaagaaggactccaaggaaaactaagactccttcgccttctgcaccagacaagtgagtatggagcctggtaggaatcagctgtttgttgtcattttactaacaagtgcttgcttagtatattgtagccagtatgtgactgtcgactcggaccgatg

SEQ ID NO: 5477 - DNA, 203 bp, Homo sapiens
ggcgcgccagtcctagtagaagatgtctggcatctatttgagacatcaataaaaccatgtgtcaagctaacacctctatgtgtggcaatgaattgtagcagggttcaagggaataccacgaccccgaatcccaggacctcgagttccacaacctcgagaccacccacatccgcagcctccataataaacgactcggaccgatg

SEQ ID NO: 5478 - DNA, 203 bp, Homo sapiens
ggcgcgccagtccttgaaacttctaactgcatagaaaacaacacatgcgcaggattagggtatgaggagatgatgcaatgtgagttcaatatgaaggggttagaacaagataagaaaaggaggtataaggacacatggtatttagaagatgtggtttgtgacaacacaacagctggcacatgttacatcgactcggaccgatg

SEQ ID NO: 5479 - DNA, 203 bp, Homo sapiens
ggcgcgccagtcctgagacattgcaacacatcaatcatcaaagagtcatgtgataagcactattgggatgctatgaggtttagatactgtgcaccaccgggctttgccctattaagatgtaatgataccaactattcaggctttgaacctaagtgcactaaagtagtagctgcttcatgcacaaggatcgactcggaccgatg

SEQ ID NO: 5480 - DNA, 203 bp, Homo sapiens
ggcgcgccagtcctgtttgacttaacctcctgggtcaagtatattcaatatggagtgcatatagtagtgggaataatagctttaagaatagcaatctatgtagtgcaattgttaagtagatttagaaagggctataggcctgttttctcttccccccccggttatctccaacagatccatatccacaacgactcggaccgatg

SEQ ID NO: 5481 - DNA, 203 bp, Homo sapiens
ggcgcgccagtcctcaggaagtagctactaagaaacagctgaggctgcagggactttccagaaggggctgtaaccaagggagggacatgggaggagctggtggggaacgccctcatacttactgtataaatgtacccgcttcttgcattgtattcagtcgctctgcggagaggctggcagatcgagcccgactcggaccgatg

SEQ ID NO: 5482 - DNA, 203 bp, Homo sapiens
ggcgcgccagtcctgaaaaatttgtacctttgtttgtggtcaccatgtcccaagcagtaccatattggcggcagaccatgcaggcacgcaatcaaaatggtaaaaagcaaaagaaccgcattgctgaactagaaaaagaggtagcagacttaactagcgccggtaggggagctgatcaggttatagcacgactcggaccgatg

SEQ ID NO: 5483 - DNA, 203 bp, Homo sapiens
ggcgcgccagtcctttgactatgcccaccagatcaaaaggaccgaagaaacggggccctgatttgaaacagattagatcgttgcacgtgatggctgattcattgggcatggacagtgatggcatagactgggattggttggctagacaagcctgggactatgaaggagatgaggatccacatgttaagcgactcggaccgatg

SEQ ID NO: 5484 - DNA, 203 bp, Homo sapiens
ggcgcgccagtcctgaagcagaggaggaggcatggcgtgagagacaaacatctcaaccatcccaaccctctcagttgagaccttttgtagccgcagggaacggtcatagggaagatcaatggagacccctgacagtcacagaattacccgcagccgttaccgcagtaggaggagcatgggatcccacgcgactcggaccgatg

SEQ ID NO: 5485 - DNA, 203 bp, Homo sapiens
ggcgcgccagtcctaagcagggacccggaggaggacagggtttgttggaatttactaagttaagacaaggacccactgagaatcctagtaactacttggaaaaggctctagaattgtacctagactctcaacccggtgatagagacggtaacaaagatgaccccgcatttctgcagcaggctactcaacgactcggaccgatg

SEQ ID NO: 5486 - DNA, 203 bp, Homo sapiens
ggcgcgccagtcctggccacaagatcgagtgtctagtggacacaggagcagaggtgtcattaacatcccttcaattacaggcacaacgatttgaacaggtggttggtttgggaggcaaaccggtgagagtagggatagcggatcatgtcgataccacagtaggacaagtaaaaggaaaaggctgctggcgactcggaccgatg

SEQ ID NO: 5487 - DNA, 203 bp, Homo sapiens
ggcgcgccagtcctcatgcttcaccaggcatattccaccaagccctgtacaatggactggcctcctgtaaaacagcgattgaaagtcagggttgtaaactattgcaatatgtagatgatatcctgttgatgagtgaagatagggaccatcatttaaggtcgctggcaatattactgcaaggcctcaagcgactcggaccgatg

SEQ ID NO: 5488 - DNA, 203 bp, Homo sapiens
ggcgcgccagtcctatccaaggatggtttgtcccggagccttatgagggggaacagcaccagtgccgacctcatgatgacacaataacatggagagtcagcactagagctatgcccacgggtgagaagtggtggatagacggaagtagatattgggatcatgataagggaggctacgttacaggatggcgactcggaccgatg

SEQ ID NO: 5489 - DNA, 203 bp, Homo sapiens
ggcgcgccagtccttggaaaaggaggggtatggtcaatgcagatggatcacagatcagcaaccagaatatcctacaagaaatttggcaattgattgaacatgattctacacaaacgcttggtatagtcaaggtaaaagcacatacccagcgtaaatgtagcacgcatgaacaacaactgaataatgatcgactcggaccgatg

SEQ ID NO: 5490 - DNA, 203 bp, Homo sapiens
ggcgcgccagtcctgtagatcagccggcaaaacaatatgctaaggaagaacctaacatgtcagtcatagcacctctgcaagtctatccattatggataggtttggtaccatgtaaagaaccaaaattgtgggaaaatatacaacatcacatcacaaaggttgacctgcccgacttccagaaacaacttcgactcggaccgatg

SEQ ID NO: 5491 - DNA, 203 bp, Homo sapiens
ggcgcgccagtcctggaaaagtacaaggctacgtcattaagacaaccttaggcatgaaaacatggataatgaatgatcacctggtgactcagagtgaacagactgagggtagggctaagctaagcagcacggaaggctacgccttagcccaacaataccatcatctgtacggtcacccctcagaggaacgactcggaccgatg

SEQ ID NO: 5492 - DNA, 203 bp, Homo sapiens
ggcgcgccagtcctgtgggacctttgggacctggtacccatggatacaggtacctcacaaccatggttgatgtgtacacaggttggttctgggccaaaccctgtagaggtccaactacgggtgccactatagcggccttagaggaacacatcagtatttggggggtaccctattctatacaatctgatcgactcggaccgatg

SEQ ID NO: 5493 - DNA, 203 bp, Homo sapiens
ggcgcgccagtcctcaaaataagaagtgggaagaacagttagaaaaggtcactaaagcagaagcccactcacactggactcagaggagccctaatttagaacctggctgcattgtgttagtaagaaagttcaccggggatgccttctcacctaaatgggaaggaccatatgtgataacagaaactacccgactcggaccgatg

SEQ ID NO: 5494 - DNA, 203 bp, Homo sapiens
ggcgcgccagtcctaccaaggcaaaaacgtagcctaaggaaccaacccacagaatggcatctccatatgtgtggaccaccaggtgattacatatgcatgtggaccaataagaaaccagtgtgtactacctatcatgaaggacaggatacatactccttagggacgcataggaaggtgctccccaaagtcgactcggaccgatg

SEQ ID NO: 5495 - DNA, 203 bp, Homo sapiens
ggcgcgccagtcctaactgaagcctgtgcggttggacaacctcctcagatacccggaacctatgtagccagtagtaaaggatggactatgtttaataaatttgaagtccattcctaccccgctaatgtcacccagattaaaacaaacagaacactgcatgacgtaacattatggtggtgtcatgacaacgactcggaccgatg

SEQ ID NO: 5496 - DNA, 203 bp, Homo sapiens
ggcgcgccagtcctcaccgccacccgtgtccaaatgcagaaaataggaccaggggaatggaaaatagcaactagcatggtagggctatgcctggacgaatgggaaatagagtgcaccggcttctgtagtggtcctcctccttgcagtttaagcataactcaacagcaggatacagtgggaggatcttacgactcggaccgatg

SEQ ID NO: 5497 - DNA, 203 bp, Homo sapiens
ggcgcgccagtcctactgatattaccttttactgtagcaccaaaatatagacgacaacgaaggggacttaacccctcaaccacacctgattattacactaatgaagattatagtggatcaggggggtgggaaataaatgacgagtgggaatatataccaccaacagtgaaaccaaccacgcctagtgtcgactcggaccgatg

SEQ ID NO: 5498 - DNA, 203 bp, Homo sapiens
ggcgcgccagtccttacacttatagggaaacactggattaaggtaattcagcggcttttacgggaatatcagaagacaggggttacctttaatctcccacaggttcaatcattacccaattgggaaaccaaaaacaaagataatcctggacatcacattcccaaaagccggcggaagagaattaggcgcgactcggaccgatg

SEQ ID NO: 5499 - DNA, 203 bp, Homo sapiens
ggcgcgccagtcctaggattaggtgaagctttaggattaggtaactttgctgataacagatggaaggatttacagatagcaggattaggggtagaacagcagaaattaatgggattaactagagaagccacgtttgaggcatggaatgccctgaagggtatttctaacgaattaattaaatgggaagacgactcggaccgatg

SEQ ID NO: 5500 - DNA, 203 bp, Homo sapiens
ggcgcgccagtcctagatatggtagccactctcagacagcttctattacaaattaaaggcactaatactaccctctgtagtgcgatgggaccgttaatggctaccaatatacaacaaataatgttcgcattacaacatggtaatctacctgaaatgtcttactctaaccctgtgttgaaggaaatagccgactcggaccgatg

SEQ ID NO: 5501 - DNA, 203 bp, Homo sapiens
ggcgcgccagtcctaaattcaggaacatggtcatcactgaaaaatgagacactgtatgtaagtggacgaaattgctccttctctctcaccagtaggcggcgacctgtgtgttttcacctaaatagcaccgcccaatggcgaggacacgttttgccttttgtaggtaactcccaggaagcacccaacaccgactcggaccgatg

SEQ ID NO: 5502 - DNA, 203 bp, Homo sapiens
ggcgcgccagtcctccaaaccagaagaagtgataagtttatataatcctgaattatttgcttgggggggaacactgggagattatgtatggtgtaaaactactactattcgatggggacctattgtaatgaagtatcgtgtgtgtgggcacctcgaatcagattataccacgagtcagtattacagagcgactcggaccgatg

SEQ ID NO: 5503 - DNA, 203 bp, Homo sapiens
ggcgcgccagtcctacatatgctcttaatgtacttgtttactgtttatacgcacccaagtaacaactgtatttaattataacctatgtgaatcataaggccaatcacgctaggaggcggcctctagtacttttccattgtatgaactattgttattagcccctccctgaaggaggagccacttgcctacgactcggaccgatg

SEQ ID NO: 5504 - DNA, 203 bp, Homo sapiens
ggcgcgccagtcctgaatcataaggccaatcacgctaggaggcggcctctagtacttttccattgtatgaactattgttattagcccctccctgaaggaggagccacttgcctatatattgtagagcacggctgtgctcattgtcttttgctgcacccaacttgaagaataaagattattgcatctgacgactcggaccgatg

SEQ ID NO: 5505 - DNA, 203 bp, Homo sapiens
ggcgcgccagtccttgtttagtctaactcaatagacatgtgtttattaccattttagttaatataaaaactcatcaaagggaaatggggcaaataaactcacctaatcaatcaaactatgagcactacaaatgacaacactactatgcaaagattaatgatcacggacatgagacccctgtcgatggacgactcggaccgatg

SEQ ID NO: 5506 - DNA, 203 bp, Homo sapiens
ggcgcgccagtccttgaatataatacaaaatatggcactttccccatgcctatatttatcaatcatggcgggtttctagaatgtattggcattaagcctacaaaacacactcctataatatacaaatatgacctcaacccgtaaattccaacaaaaaaaaccaacccaaccaaaccaagctattcctccgactcggaccgatg

SEQ ID NO: 5507 - DNA, 203 bp, Homo sapiens
ggcgcgccagtcctaggaatgctccatacattagtagttgcaagtgcaggacccacttcagctcgcgatggaataagagatgctatggttggtctgagagaagaaatgatagaaaaaataagagcggaagcattaatgaccaatgataggttagaggctatggcaagacttaggaatgaggaaagcgacgactcggaccgatg

SEQ ID NO: 5508 - DNA, 203 bp, Homo sapiens
ggcgcgccagtcctaaaaatggcaaaagacacctcagatgaagtgcctcttaatccaacttccaaaaaattgagtgacttgttggaagacaacgatagtgacaatgatctgtcacttgatgatttttgatcagtgatcaactcactcagcaatcaacaacatcaataaaacagacatcaatccattgacgactcggaccgatg

SEQ ID NO: 5509 - DNA, 203 bp, Homo sapiens
ggcgcgccagtcctgctagacctagagtgcgaataggtaaataaaaccaaaatatggggtaaatagacattagttagagttcaatcaatctcaacaaccatttataccgccaattcaatacatatactataaatcttaaaatgggaaatacatccatcacaatagaattcacaagcaaattttggccccgactcggaccgatg

SEQ ID NO: 5510 - DNA, 203 bp, Homo sapiens
ggcgcgccagtcctcacaagaatcaacgcactgccaggactctagaaaagacctgggatactctcaatcatctaattgtaatatcctcttgtttatacagattaaatttaaaatctatagcacaaatagcactatcagttctggcaatgataatctcaacctctctcataattgcagccataatattccgactcggaccgatg

SEQ ID NO: 5511 - DNA, 203 bp, Homo sapiens
ggcgcgccagtcctatcatctctgccaatcacaaagttacactaacaacggtcacagttcaaacaataaaaaaccacactgaaaaaaacatcaccacctaccttactcaagtcccaccagaaagggttagctcatccaaacaacctacaaccacatcaccaatccacacaaattcagccacaacatcacgactcggaccgatg

SEQ ID NO: 5512 - DNA, 203 bp, Homo sapiens
ggcgcgccagtcctaccctcacgaccacagaaagagacaccagcacctcacaatccactgtgctcgacacaaccacattagaacacacaatccaacagcaatccctccactcaaccacccccgaaaacacacccaactccacacaaacacccacagcatccgagccctctacatcaaattccacccaacgactcggaccgatg

SEQ ID NO: 5513 - DNA, 203 bp, Homo sapiens
ggcgcgccagtcctaatacccaatcacatgcttagttattcaaaaactacatcttagcagaaaaccgtgacctatcaagcaagaacgaaattaaacctggggcaaataaccatggagctgctgatccacaggttaagtgcaatcttcctaactcttgctattaatgcattgtacctcacctcaagtcacgactcggaccgatg

SEQ ID NO: 5514 - DNA, 203 bp, Homo sapiens
ggcgcgccagtcctaccaaaaataatgatattaccggataaatatccttgtagtatatcatccatattgatttcaagtgaaagcatgattgctacattcaatcataaaaacatattacaatttaaccataaccatttggataaccaccagcgtttattaaataatatatttgatgaaattcattggaccgactcggaccgatg

SEQ ID NO: 5515 - DNA, 203 bp, Homo sapiens
ggcgcgccagtcctgataataatctcaataatttgagtgagctatattttctcttcagaatctttggacatccaatggttgatgaaagacaagcaatggatgctgtaagaattaactgtaatgaaactaagttctacttattaagtagtctaagtacgttaagaggtgctttcatttatagaatcatacgactcggaccgatg

SEQ ID NO: 5516 - DNA, 203 bp, Homo sapiens
ggcgcgccagtcctaaattcaatcaagcatttagatatgaaacatcatgtatctgcagtgatgtattagatgaactgcatggagtacaatctctgttctcttggttgcatttaacaatacctcttgtcacaataatatgtacatatagacatgcacctcctttcataaaggatcatgttgttaatcttcgactcggaccgatg

SEQ ID NO: 5517 - DNA, 203 bp, Homo sapiens
ggcgcgccagtcctaatgaagttgatgaacaaagtggattatacagatatcatatgggtggtattgagggctggtgtcaaaaactgtggaccattgaagctatatcattattagatctaatatctctcaaagggaaattctctatcacagctctgataaatggtgataatcagtcaattgatataagtcgactcggaccgatg

SEQ ID NO: 5518 - DNA, 203 bp, Homo sapiens
ggcgcgccagtcctaaaccagttagacttatagagggtcagacccatgctcaagcagattatttgttagcattaaatagccttaaattgctatataaagagtatgcaggtataggccataagcttaagggaacagagacctatatatcccgagatatgcagttcatgagcaaaacaatccagcacaatcgactcggaccgatg

SEQ ID NO: 5519 - DNA, 203 bp, Homo sapiens
ggcgcgccagtcctaaaaagcaaagagaccaaatagatttattagcaaaattagactgggtatatgcatccatagacaacaaagatgaattcatggaagaactgagtactggaacacttggactgtcatatgaaaaagccaaaaagttgtttccacaatatctaagtgtcaattatttacaccgtttacgactcggaccgatg

SEQ ID NO: 5520 - DNA, 203 bp, Homo sapiens
ggcgcgccagtcctagaaacaaggcagtcaaccacctaccaatcccacaaacagaacgaatcaggacgaaatagatgatctgtttaatgcatttggaagcaactaatcgaatcaacattttgatccaaattaataataaataagaaaaacttaggattaaagaatcctattataccagaatatagggtcgactcggaccgatg

SEQ ID NO: 5521 - DNA, 203 bp, Homo sapiens
ggcgcgccagtcctggtaaatttagagtttgcttgcaactcaatcaatagagagttgatggaaagcgatgctaaaaactatcaaatcatggattcttgggaagaggaatcaagagataaatcaactaatatctcctcggccctcaatatcattgaattcatacttagcaccgacccccaagaagacctcgactcggaccgatg

SEQ ID NO: 5522 - DNA, 203 bp, Homo sapiens
ggcgcgccagtcctaatgaaaaatagtaggacaaagaaaagttcttcaatacaccaagaagatgacaaaagaattaaaaaagggggaaaagggaaagactggtttaagaaatcaaaagatactgacaaccagataccaacatcagactacagatccacatcaaaagggcagaagaaaatctcaaaaaccgactcggaccgatg

SEQ ID NO: 5523 - DNA, 203 bp, Homo sapiens
ggcgcgccagtccttctctcacaaagcacaaaacaatcatatataaacgaactcaaacattgcaaaaatgatgaagaagtatctgaattaatggacatgttcaatgaagatgtcaataattgccaatgatccaacaaagaaacgacaccgaacaaacagacaagaaacaacagtagatcaaaatctatcgactcggaccgatg

SEQ ID NO: 5524 - DNA, 203 bp, Homo sapiens
ggcgcgccagtcctacaaagtttgtggctctggatcattaccaatcggattggctaaatacactgggaatgaccaggaattattacaagctgcaaccaaactggacatagaagtgagaagaacagtcaaagcgaaagagatggttgtgtatacagtacaaaatataaaaccagaactatacccatggtcgactcggaccgatg

SEQ ID NO: 5525 - DNA, 203 bp, Homo sapiens
ggcgcgccagtcctacacaatatcaatcaatctgcaggtacatatcaaaacaggggttcagactgattccaaagggatagttcaaattttgaatgagaagggcgaaaaatcactgaatttcatgatccatctcggattgatcaagagaaaaataggcagaatgtactctgttgaatactgtaaacagacgactcggaccgatg

SEQ ID NO: 5526 - DNA, 203 bp, Homo sapiens
ggcgcgccagtcctccctttattaactaggctgctgaacactcagatctacaaagtagattccatatcatataatatccacaatagagaatggtatattcctcttcccagccatatcatgacgaaaggggcatttctaggtggagcagatgtcaaagaatgtatagaagcattcagcagttatatatgcgactcggaccgatg

SEQ ID NO: 5527 - DNA, 203 bp, Homo sapiens
ggcgcgccagtccttatgagacaaaattactgggggtcagaaggaaggttgattctactaggtaacaagatctatatatatacaagatctacaagttggcatagcaaattacaattaggaataattgatattactgattacagtgatataaggataaaatggacatggcataatgtgctatcaagacccgactcggaccgatg

SEQ ID NO: 5528 - DNA, 203 bp, Homo sapiens
ggcgcgccagtcctataattaaccataatatgcattaacctatctataatacaagtatatgataagtaatcagcaatcagacaatggacaaaaggaaaatataaaaaacttaggagcaaagcgtgctcggaaaatggacactgaatctaacaatggcactgtatctgacatactctatcctgagtgtccgactcggaccgatg

SEQ ID NO: 5529 - DNA, 203 bp, Homo sapiens
ggcgcgccagtccttcacttttaatgttgggaaagattataacttgttagaagaccagaagaatttcttattgatacatccagaattggttttgatattagataaacaaaactataatggttatctaattactcctgaattagtactgatgtattgtgacgtagtcgaaggccgatggaatataagtgcgactcggaccgatg

SEQ ID NO: 5530 - DNA, 203 bp, Homo sapiens
ggcgcgccagtcctgaggagcttttttaaatcatgtgttatccgaaatggaattgatatttgaatctggagaatcgattagggaatttctgagtgtagattacattgataaaatcttagatatttttaatgaatctacaatagatgaaatagcagagattttctctttttttagaacatttgggcatccgactcggaccgatg

SEQ ID NO: 5531 - DNA, 203 bp, Homo sapiens
ggcgcgccagtcctttctagataattctctcacaggaattagaaatgctatagctggaatgttagatacgacaaaatcattaattcgggttggcataaatagaggaggactgacatatagtttgttgagaaaaatcagtaattatgatctagtgcaatatgaaacactaagtaggactttgcgattaacgactcggaccgatg

SEQ ID NO: 5532 - DNA, 203 bp, Homo sapiens
ggcgcgccagtcctctgcaactcagatgaaattctccagtacatcattaatcagagtcagcagattcataacaatgtccaatgataacatgtctattaaagaagctaatgaaaccaaagataccaatcttatttaccaacaaataatgttaacaggattaagtgttttcgaatatttatttagattaacgactcggaccgatg

SEQ ID NO: 5533 - DNA, 203 bp, Homo sapiens
ggcgcgccagtccttattaaaagtattatctaatgcattatctcatcctaaagtatttaagaggttctgggattgtggagttttaaaccctatttatggtcctaatactgctagtcaagaccagataaaacttgctctctctatatgtgaatatgcactagatctatttatgagagaatggttgaatgcgactcggaccgatg

SEQ ID NO: 5534 - DNA, 203 bp, Homo sapiens
ggcgcgccagtcctatgatgatgttgttttagtttccaaaattatacctacaatcactccgaattggtctagaatactttatctatataaattatattggaaagatgtaagtataatatcacttaaaacttctaatcctgcatcaacagaattatatctaatttcgaaagatgcatattgtactataacgactcggaccgatg

SEQ ID NO: 5535 - DNA, 203 bp, Homo sapiens
ggcgcgccagtcctaaatctttggatttcaaatcaacttaaatcatctggcgaaagaatttttatcaactccagatctgaccaatatcaacaatataatccaaagttttcagcgaacaatcaaagatgtcttgtttgaatggattaatataactcatgatgacaagagacataaattaggcgggagatcgactcggaccgatg

SEQ ID NO: 5536 - DNA, 203 bp, Homo sapiens
ggcgcgccagtcctaatcattaaaattattgtcgaaaaacatcattaagaattatagagagtgtataggatcaatatcatattggtttctaaccaaagaagttaaaatacttatgaaattgattggtggtgctaaattattaggaattcccagacaatataaagaacccgaagaacagttattagaaacgactcggaccgatg

SEQ ID NO: 5537 - DNA, 203 bp, Homo sapiens
ggcgcgccagtcctccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcgactcggaccgatg

SEQ ID NO: 5538 - DNA, 203 bp, Homo sapiens
ggcgcgccagtccttaggaggacccggccataaggcaagagttttggctgaagcaatgagccaagtaacaaattcagctaccataatgatgcagagaggcaattttaggaaccaaagaaagattgttaagtgtttcaattgtggcaaagaagggcacacagccagaaattgcagggcccctaggaaaacgactcggaccgatg

SEQ ID NO: 5539 - DNA, 203 bp, Homo sapiens
ggcgcgccagtcctagggctgttggaaatgtggaaaggaaggacaccaaatgaaagattgtactgagagacaggctaattttttagggaagatctggccttcctacaagggaaggccagggaattttcttcagagcagaccagagccaacagccccaccagaagagagcttcaggtctggggtagagacgactcggaccgatg

SEQ ID NO: 5540 - DNA, 203 bp, Homo sapiens
ggcgcgccagtcctaaattttcccattagccctattgagactgtaccagtaaaattaaagccaggaatggatggcccaaaagttaaacaatggccattgacagaagaaaaaataaaagcattagtagaaatttgtacagagatggaaaaggaagggaaaatttcaaaaattgggcctgaaaatccatacgactcggaccgatg

SEQ ID NO: 5541 - DNA, 203 bp, Homo sapiens
ggcgcgccagtcctaataatagagcagttaataaaaaaggaaaaggtctatctggcatgggtaccagcacacaaaggaattggaggaaatgaacaagtagataaattagtcagtgctggaatcaggaaagtactatttttagatggaatagataaggcccaagatgaacatgagaaatatcacagtaacgactcggaccgatg

SEQ ID NO: 5542 - DNA, 203 bp, Homo sapiens
ggcgcgccagtcctggttttatagacatcactatgaaagccctcatccaagaataagttcagaagtacacatcccactaggggatgctagattggtaataacaacatattggggtctgcatacaggagaaagagactggcatttgggtcagggagtctccatagaatggaggaaaaagagatatagcacgactcggaccgatg

SEQ ID NO: 5543 - DNA, 203 bp, Homo sapiens
ggcgcgccagtccttaacaccaaaaaagataaagccacctttgcctagtgttacgaaactgacagaggatagatggaacaagccccagaagaccaagggccacagagggagccacacaatgaatggacactagagcttttagaggagcttaagaatgaagctgttagacattttcctaggatttggctcgactcggaccgatg

SEQ ID NO: 5544 - DNA, 203 bp, Homo sapiens
ggcgcgccagtcctagactagagccctggaagcatccaggaagtcagcctaaaactgcttgtaccaattgctattgtaaaaagtgttgctttcattgccaagtttgtttcataacaaaagccttaggcatctcctatggcaggaagaagcggagacagcgacgaagagctcatcagaacagtcagactcgactcggaccgatg

SEQ ID NO: 5545 - DNA, 203 bp, Homo sapiens
ggcgcgccagtcctaagaggtaaggtgcagaaagaatatgcatttttttataaacttgatataataccaatagataatgatactaccagctataagttgacaagttgtaacacctcagtcattacacaggcctgtccaaaggtatcctttgagccaattcccatacattattgtgccccggctggtttcgactcggaccgatg

SEQ ID NO: 5546 - DNA, 203 bp, Homo sapiens
ggcgcgccagtccttaacactttaaaacagatagctagcaaattaagagaacaatttggaaataataaaacaataatctttaagcaatcctcaggaggggacccagaaattgtaacgcacagttttaattgtggaggggaatttttctactgtaattcaacacaactgtttaatagtacttggtttaacgactcggaccgatg

SEQ ID NO: 5547 - DNA, 203 bp, Homo sapiens
ggcgcgccagtccttagtacttggagtactgaagggtcaaataacactgaaggaagtgacacaatcaccctcccatgcagaataaaacaaattataaacatgtggcagaaagtaggaaaagcaatgtatgcccctcccatcagtggacaaattagatgttcatcaaatattacagggctgctattaaccgactcggaccgatg

SEQ ID NO: 5548 - DNA, 203 bp, Homo sapiens
ggcgcgccagtcctgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctgcgactcggaccgatg

SEQ ID NO: 5549 - DNA, 203 bp, Homo sapiens
ggcgcgccagtcctgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccgactcggaccgatg

SEQ ID NO: 5550 - DNA, 203 bp, Homo sapiens
ggcgcgccagtcctcattcgattagtgaacggatccttggcacttatctgggacgatctgcggagcctgtgcctcttcagctaccaccgcttgagagacttactcttgattgtaacgaggattgtggaacttctgggacgcagggggtgggaagccctcaaatattggtggaatctcctacagtattgcgactcggaccgatg

SEQ ID NO: 5551 - DNA, 203 bp, Homo sapiens
ggcgcgccagtcctgagaagtgttagagtggaggtttgacagccgcctagcatttcatcacgtggcccgagagctgcatccggagtacttcaagaactgctgacatcgagcttgctacaagggactttccgctggggactttccagggaggcgtggcctgggcgggactggggagtggcgagccctcacgactcggaccgatg

SEQ ID NO: 5552 - DNA, 203 bp, Homo sapiens
ggcgcgccagtcctgagactataataatatcactaaccagagacatcataacacacagatttatatacttgataaatcatgaatgtatagtgagaaaacttgatgaaagacaggccacatttacattcctggtcaactatgaaatgaaactattgcacaaagtgggaagcactaaatacaaaaaatatcgactcggaccgatg

SEQ ID NO: 5553 - DNA, 203 bp, Homo sapiens
ggcgcgccagtcctttcctcacttctccagtgtagtattaggcaatgctgctggcctaggcataatgggagaatacagaggtacaccaaggaatcaagatctatatgatgctgcaaaagcatatgctgaacaactcaaagaaaatggtgtgattaactacagtgtattagacttgacagcagaagaaccgactcggaccgatg

SEQ ID NO: 5554 - DNA, 203 bp, Homo sapiens
ggcgcgccagtcctagacgatgaccctgcatcacttacaatatgggtgcccatgttccaatcatccatgccagcagatttacttataaaagaactagctaatgtcaacatactagtgaaacaaatatccacacccaatggaccttcattaagagtcatgataaactcaagaagtgcagtgctagcacacgactcggaccgatg

SEQ ID NO: 5555 - DNA, 203 bp, Homo sapiens
ggcgcgccagtcctaataatctctttgctaatcataatctccatcatgattgcaatactgaacaaactctgtgaatataacgtattccataacaaaacctttgagctaccaagagctcgagtcaatacatagcattcaccaatctgatggcacaaaacagtaaccttgcatttgtaagtgaacaaccccgactcggaccgatg

SEQ ID NO: 5556 - DNA, 203 bp, Homo sapiens
ggcgcgccagtcctcagtcaagaccaaaaacacaacaacaaccaaaatacaacccagcaagcccaccacaaaacaacgccaaaacaaaccaccaaacaaacccaataatgattttcactttgaagtgttcaactttgtaccttgcagcatatgcagcaacaatccaacctgctgggctatctgtaaaacgactcggaccgatg

SEQ ID NO: 5557 - DNA, 203 bp, Homo sapiens
ggcgcgccagtcctctcatgcaaagcacaccggcaaccaacaatcgagccagaagagaactaccaaggtttatgaattatacactcaacaataccaaaaataccaatgtaacattaagcaagaaaaggaaaagaagatttcttggctttttgttaggtgttggatctgcaatcgccagtggcattgctcgactcggaccgatg

SEQ ID NO: 5558 - DNA, 203 bp, Homo sapiens
ggcgcgccagtcctaataagggggttgacactgtgtctgtaggtaatacattatattatgtaaataagcaagaaggcaaaagtctctatgtaaaaggtgaaccaataataaatttctatgacccattagtgttcccctctgatgaatttgatgcatcaatatctcaagtcaatgagaagattaaccagcgactcggaccgatg

SEQ ID NO: 5559 - DNA, 203 bp, Homo sapiens
ggcgcgccagtcctgtgttcaatgcaacatcctccatcatggttaatacattggtttaatttatacacaaaattaaacaacatattaacacagtatcgatcaagtgaggtaaaaaaccatggttttatattgatagacaatcatactctcaatggattccaatttattttgaatcaatatggttgtatcgactcggaccgatg

SEQ ID NO: 5560 - DNA, 203 bp, Homo sapiens
ggcgcgccagtcctagtttatcataaggaactcaaaagaattactgtgacaacctataatcaattcttgacatggaaaaatattagccttagtagattaaatgtttgtttaattacatggattagtaactgtttgaacacattaaataaaagcttaggcttaagatgcggattcaataatgttatcttcgactcggaccgatg

SEQ ID NO: 5561 - DNA, 203 bp, Homo sapiens
ggcgcgccagtcctgaatgctattgttttacccttaagatggttaacttactataaactaaacacttatccttccttgttggaacttacagaaagagatttgattgttttatcaggactacgtttctatcgtgagtttcggttgcctaaaaaagtggatcttgaaatgatcataaatgataaggctatcgactcggaccgatg

SEQ ID NO: 5562 - DNA, 203 bp, Homo sapiens
ggcgcgccagtcctgggtggtatcgaagggtggtgtcaaaaactatggaccatagaagctatatcactattggatctaatatctctcaaagggaaattctcaattactgctttaattaatggtgacaatcaatcaatagatataagtaaaccagtcagactcatggaaggtcaaactcatgctcaagccgactcggaccgatg

SEQ ID NO: 5563 - DNA, 203 bp, Homo sapiens
ggcgcgccagtcctcattaatttgaaagttttcttcaatgcttataagacctatctcttgtgttttcataaaggttacggcagagcaaagctggagtgtgatatgaatacttcagatctcctatgtgtattggaattaatagacagtagttattggaagtctatgtctaaggtatttttagaacaaaacgactcggaccgatg

SEQ ID NO: 5564 - DNA, 203 bp, Homo sapiens
ggcgcgccagtcctcaattacagcaaacaagatttgtataatttatttcctacggttgtgattgataaaattatagatcattcaggtaatacagccaaatctaaccaactttacactactacttctcatcaaatacctttagtgcacaatagcacatcactttattgcatgcttccttggcatcatatcgactcggaccgatg

SEQ ID NO: 5565 - DNA, 203 bp, Homo sapiens
ggcgcgccagtcctaagtctgaaggattgcaatgatcatagtttacctattgagtttttaaggctgtacaatggacatatcaacattgattatggtgaaaatttgaccattcctgctacagatgcaaccaacaacattcattggtcttatttacatataaagtttgctgaacctatcagtctttttgtcgactcggaccgatg

SEQ ID NO: 5566 - DNA, 203 bp, Homo sapiens
ggcgcgccagtcctttatgtatgcttaggcagtaagttaaaggggtctgaagtttacttagtccttacaataggtcctgcaaatgtgttcccagtatttaatgtagtacaaaatgctaaattgatactatcaagaaccaaaaatttcatcatgcctaagaaggctgataaagagtctattgatgcaaacgactcggaccgatg

SEQ ID NO: 5567 - DNA, 203 bp, Homo sapiens
ggcgcgccagtccttattaaaagtttgataccctttctttgttaccctataacaaaaaaaggaattaatactgcattgtcaaaactaaagagtgttgttagtggagatatactatcatattctatagcaggacgtaatgaagttttcagcaataaacttataaatcataagcatatgaacatcttaaacgactcggaccgatg

SEQ ID NO: 5568 - DNA, 203 bp, Homo sapiens
ggcgcgccagtcctgcacttcggaagataaagaggacagtgagtgctttgatggttggcttgcaaaggcgcggaaaaaggaggtcagtgacgaactggatgaactggttgctggtcattgctctgctggggatgacacttgcagcgacagtaaggaaagaaggggacggcaccactgtgatcagggctcgactcggaccgatg

SEQ ID NO: 5569 - DNA, 203 bp, Homo sapiens
ggcgcgccagtccttcaattggaaaggcggtgcacacggttcttggtggtgccttcaacagcatctttggaggagtggggttcctgccaaagctcctaatgggagtggcactggcctggttgggactgaacacaaggaaccccacaatgtccatgagctttctcttggctggaggtctggtcttggcccgactcggaccgatg

SEQ ID NO: 5570 - DNA, 203 bp, Homo sapiens
ggcgcgccagtcctaaggacatgaaggtctcttggaggagctggggccactcaatgatctggagtatccctgaggctcctcggcgtttcatggtgggtacagagggacaaagtgagtgcccactagagagacgaaaaacaggtgtgttcacggttgcagagtttggggtcggtctgagaacaaaagtccgactcggaccgatg

SEQ ID NO: 5571 - DNA, 203 bp, Homo sapiens
ggcgcgccagtccttttctggactttagacaggaaccaacacacgagtgtgacacaggagtgatgggggccgccgtcaaaaacgacatggcggtccacacagatcaaagcctctggatgaaatcgatgagaaatgacacaggtacctacatagttgaactcctggtcactgacctgaggaactgctctcgactcggaccgatg

SEQ ID NO: 5572 - DNA, 203 bp, Homo sapiens
ggcgcgccagtcctactggaatggtcaggattgagagcctcgtgcgctacgtggtggcggtggggattgcgttccaccttgagctgggaccagagactgtggccttgatgctgctccaggccgtgtttgagctaagagttgggcttctcagcgcctttgcattgcgcagaggcctcaccgtccgagagcgactcggaccgatg

SEQ ID NO: 5573 - DNA, 203 bp, Homo sapiens
ggcgcgccagtcctctccattggtcaggcatccttggtgtgatgggactgtggacactcacagaaataatgaggtcatccagagggtccgacctggtctactcaggacagggaggccaagaacgtggcgacaggccttttgaggtcaaggatggagtttacagaattttcagtcccggcttgttctggcgactcggaccgatg

SEQ ID NO: 5574 - DNA, 203 bp, Homo sapiens
ggcgcgccagtcctaaaggtgaaacagtacaggtccatgccttcccaccggggagggcgcacgaggtgcaccagtgccagcccggagaattgatccttgacacaggaaagaggcttggggcaataccaattgacttggcaaagggaacatctggtagccctattcttaacgctcagggagtggttgttcgactcggaccgatg

SEQ ID NO: 5575 - DNA, 203 bp, Homo sapiens
ggcgcgccagtcctgggctatacggaaatggtccaaaaaccaatgagagctacgtcagcagcatcgctcagggagaggcggagaagagtcgacccaaccttccacaggcagttgtgggcacgggctggacgtcaaagggtcagatcacagtgttggatatgcacccaggctctggaaagacccacagacgactcggaccgatg

SEQ ID NO: 5576 - DNA, 203 bp, Homo sapiens
ggcgcgccagtcctgtcctcccggagctcatccgccaatgcattgacaggcgcctgagtacgttggtgctggctccaactcgcgtggtactgaaggagatggagcgcgctctcagtgggaagcgggtccggttccattcgccagcagtcagtgaccaacaggctggaggggcaattgtcgatgtgatgcgactcggaccgatg

SEQ ID NO: 5577 - DNA, 203 bp, Homo sapiens
ggcgcgccagtcctaacataacaaccttgcgggggcccgtggccaccttttatggccctgagcaggacaagatgccggaggtggccggtcactttcgactcactgaggagaagaggaagcacttccgccaccttctcacccattgtgatttcacgccctggctggcatggcacgttgcagcgaacgtgcgactcggaccgatg

SEQ ID NO: 5578 - DNA, 203 bp, Homo sapiens
ggcgcgccagtcctctgacggtggttgagatgatggttctgggtctggcgaccctgggtgtcgtctggtgtttcgtcgtccgaacatcaatcagtcgcatgatgctcggcacgctggtcttgctggcctccctgctactcttgtgggcaggtggcgtcggctatgggaacatggctggagtggctctccgactcggaccgatg

SEQ ID NO: 5579 - DNA, 203 bp, Homo sapiens
ggcgcgccagtcctgccatgagagacttgggggggggagctcccttctttggtgtggcaggacatgttatgactctcggggtggtgtccctggttggggccacccccacctcactgatagtgggcattggcttagcagctttccatttggccatcgtggtatctggactggaggctgagctgacacagcgactcggaccgatg

SEQ ID NO: 5580 - DNA, 203 bp, Homo sapiens
ggcgcgccagtcctaggcgtggtggctctgatggagacacgcttggtgacctctggaagcgcaggctgaacaactgcaccaaggaggaattcttcgtttacaggcgcactggcattctggaaaccgaacgtgacaaggccagagagctgctcaggagaggagagacaaacatgggactggcggtctcgcgactcggaccgatg

SEQ ID NO: 5581 - DNA, 203 bp, Homo sapiens
ggcgcgccagtcctcgtggcacggcaaagctcgcttggcttgaagaacgcggatatcgcaccctcaagggagaggtggtagatctcgggtgtggaaggggcggctggtcctactatgcggcttctcgaccggcagtcatgagtgttagggcatataccattggtggaagagggcatgaggttccaaagcgactcggaccgatg

SEQ ID NO: 5582 - DNA, 203 bp, Homo sapiens
ggcgcgccagtcctatccgaaacccagcggcggcctgcgtgttcaaggtgctggctccataccgcccagaggtaatagaggcattgcacagattccagctgcagtggggtgggggtctagtgaggactcccttctcaaggaactcaactcacgagatgtactactcgacagctgtcacaggcaatatacgactcggaccgatg

SEQ ID NO: 5583 - DNA, 203 bp, Homo sapiens
ggcgcgccagtcctacgacagcctttgggcagcagagagtgtttaaagagaaagttgacacaaaagcacaggagccccaaccggggacaagagtgatcacgagagcagtgaatgattggattctagagcgtctggcccagaaaagcaaaccacgcatgtgcagcagagaggaattcatagcaaaagtgcgactcggaccgatg

SEQ ID NO: 5584 - DNA, 203 bp, Homo sapiens
ggcgcgccagtcctcaacccaacttccgcgttcttgtcttattctccgccgaaatcgaaagcacagtgcccctccctgcaccactggcccggggccagcatcctgccagggacgcgcgcctgctaaacccgagggtgttttgggcctctccgggaggggtacccagccacttcgggtccttgttctctcgactcggaccgatg

SEQ ID NO: 5585 - DNA, 203 bp, Homo sapiens
ggcgcgccagtcctccgggagagacaaacaagtgggggctcgtccgggatacctacccctgccctctcgcattatgggacaaacctacggcctctcgtccagcccaatccccaaggcccccagggggttatcaacccaccattggttaaacttcctccaagccgcctaccggctacaacctgggccctcgactcggaccgatg

SEQ ID NO: 5586 - DNA, 203 bp, Homo sapiens
ggcgcgccagtcctctcctgccccgtctctacccgaaccagctaacccaccgcccctccaacagccctcggctcctccggaaccccatacaccccccccctatataaagcctcccgctacccattgccttcccatactacacccacatggggccccctcggctcacagcccttggcaaatgaaagacccgactcggaccgatg

SEQ ID NO: 5587 - DNA, 203 bp, Homo sapiens
ggcgcgccagtccttgcaggccatcaagcaggaggtcagcacctcagcccccgggagtccccagttcatgcaaacagtccggctcgcaattcagcaattcgaccccacggccaaagacttacaagatctcttgcagtacctctgctcctccctagtcgtctcccttcaccatcaacaattccataccccgactcggaccgatg

SEQ ID NO: 5588 - DNA, 203 bp, Homo sapiens
ggcgcgccagtcctccctaggggacatgctccgagcctgccaagcatggacacccaaggacaaagcccgggtcctcgtcgtccaaccacgaaagcccccgcccacgcagccctgcttccgctgcgggaaaacagggcattggagccgagactgcaccctcccacgccccccccctggtccgtgtccctcgactcggaccgatg

SEQ ID NO: 5589 - DNA, 203 bp, Homo sapiens
ggcgcgccagtccttccgttagagcaacagcaccagccccttctagacgttcaagtctccattgcaggcgccccccctcgacctacccaggcactcttagacacgggggctgatctcaccgtcctgccccaggcccttgcccccgagtcagtaagtgtttctgatacaacggttctgggcgctggcggcgactcggaccgatg

SEQ ID NO: 5590 - DNA, 203 bp, Homo sapiens
ggcgcgccagtcctacagaccagctcccagttcaaactccttcaatcccccctgtgcgtctacctacccttccggagggcccctgttaccctcccatcatgccttgtagacaccaatagcaaatgggccattattggccgtgatatcctccagaaatgccagagtgtcctgtaccttccggaggacaacgactcggaccgatg

SEQ ID NO: 5591 - DNA, 203 bp, Homo sapiens
ggcgcgccagtccttctgtgcaagggtaccccccggctccccgatggaataactcctccccgattattacccgtgaccacccccaatgtcattggccttgagcacttcccaccacccccacagatagatcagttccctttaaacctgagcgcctccaggccttgactgacctggtctccaaggccctgcgactcggaccgatg

SEQ ID NO: 5592 - DNA, 203 bp, Homo sapiens
ggcgcgccagtcctgaggctagctacattgaaccttactctggaccaggtaataaccccgtctttccagtcaaaaaaccaaacggcaaatggagatttattcatgacctaagggccaccaatgccatcacgaccaccttggcctccccgtcccccggacctcccgatctcaccagcttatcaacagcccgactcggaccgatg

SEQ ID NO: 5593 - DNA, 203 bp, Homo sapiens
ggcgcgccagtcctctcccatacctgcaaactatagaccttactgacgccttcttccaaatcccccttccaaaacagttccagccatacttcgccttcaccatcccccagccatgtaattatggccctggggctcggtatgcctggactgtccttccacagggatttaaaaacagccccaccctgttccgactcggaccgatg

SEQ ID NO: 5594 - DNA, 203 bp, Homo sapiens
ggcgcgccagtcctgaacaacagctggccgccgtcctttcccccatcaggaaaaccttccctatgtctactatcatccaatatatggatgatatactcttggccagtcctacacaagaggaactgcaacaactctccaagatgaccctccaagcgctagtcacccacggccttccagtctctcaggagcgactcggaccgatg

SEQ ID NO: 5595 - DNA, 203 bp, Homo sapiens
ggcgcgccagtcctaaaacccaacaaacccctgggcaaatacgtttcctgggtcaagttatatctcccaaccatattacctatgaaaccacccccaccattcccatcaaatcccaatggactctcactgaactacagactgtactaggagagattcaatgggtctcaaaaggaacccccattctccgccgactcggaccgatg

SEQ ID NO: 5596 - DNA, 203 bp, Homo sapiens
ggcgcgccagtccttcgtctggcacaacctccgtcctcttccaagcccgacagcgatggcccctggtttggctgcacaccccccatcccccaaccagcctgtgcccctggggtcacttgctggcctgcactatcctgaccttggacaaatactccctccagcactatggccagctgtgccagtccttccgactcggaccgatg

SEQ ID NO: 5597 - DNA, 203 bp, Homo sapiens
ggcgcgccagtcctctccaccatattcgtagccacaccaatctccccgaccccatctccactcttaacgaatacacagactcactcattatagcccctctcattcccctaacacctcaggatctgcataaacttacccattgcaactccagggcccttgtttcctcaggggccaccccacagcaagcccgactcggaccgatg

SEQ ID NO: 5598 - DNA, 203 bp, Homo sapiens
ggcgcgccagtcctaacgcagtctccattacctgcaagacaaaagagactagttctgaaactgtcagcgccctcctgcacgctatcactatcttaggcaagcccctttctataaacactgacaatggttctgccttcctatctcaagaattccaggccttttgcgcctcatggcacatcaaacattcccgactcggaccgatg

SEQ ID NO: 5599 - DNA, 203 bp, Homo sapiens
ggcgcgccagtcctacccatgtgccttacaactctaccagctccgggctagtagaaaggaccaatggcattgttaaggccctcctcaacaaatatcttttagacagcccaaacctccccctagacaatgccatcagtaaagccctatggaccctaaaccaactcaatgtcatgtcgtcccagtggaaacgactcggaccgatg

SEQ ID NO: 5600 - DNA, 203 bp, Homo sapiens
ggcgcgccagtcctcacgcttacggtaggtgtctcctcgtatcactctagtccctgcagtcttgcccaacctatctgcacctgggatctcgaccttcattccttaactacagaccaacgtctgtaccctccatgccccaatctagtttcttactctaacttccacaagtcctactccttatatttgttcgactcggaccgatg

SEQ ID NO: 5601 - DNA, 203 bp, Homo sapiens
ggcgcgccagtcctagaggtcaaccatgtaaccctccggctacacttctcccgatgtggctcttctatgaccctcctcatagacgccccaggctacgaccccctgtggttcatctcttcggaacccactcagcccccccccacttccccaccattagtccgcgactctgaccttgaacatatcttaaccgactcggaccgatg

SEQ ID NO: 5602 - DNA, 203 bp, Homo sapiens
ggcgcgccagtcctcccctcctcctcctgggctactaggatgctaaccctcatccaactaactctacaaagtaccaattattcttgcatggtttgtatagacagaaccagcttgtcgtcctggcacgtactctatacccctaatatctctgcctcacctgggggcgactccttgcctatactttatcccgactcggaccgatg

SEQ ID NO: 5603 - DNA, 203 bp, Homo sapiens
ggcgcgccagtcctctccttggccctaccggccccccaaccccagccgttttcctggtctcactgttaccagccccacctacaggcagtaactacagccaattgcaacaattccattgtcctgcccccattctctctcaccccggtgccttcccctgggacaagaagccgccgggctattccagtggccgactcggaccgatg

SEQ ID NO: 5604 - DNA, 203 bp, Homo sapiens
ggcgcgccagtccttgtatggctcgtctcagccctagcggccgggactggtattgcagggggaataaccggatccctgtccctagcatcaagccgcagcctgctttttgaagttgacaaagatatttcccacctcacacaagccatcgttaaaaaccatcaaaacatcctccgcgtagcacaatatgccgactcggaccgatg

SEQ ID NO: 5605 - DNA, 203 bp, Homo sapiens
ggcgcgccagtcctgctccccctccaagacactgatatatccctctaacatctcacaatacccttcaaaccccagcaaccctatacactctaactgttgatgtctcttttcgcgctctcgacgcttttcttccttctcccgcagccgctcccttctgcgctgctccttctcctcgcgttgtttcagaacgactcggaccgatg

SEQ ID NO: 5606 - DNA, 203 bp, Homo sapiens
ggcgcgccagtccttttccatgatttccttctgctcttccgccagcgccctccggcgaccatcccgtacatcctctccgaccgaccctgatcctaagggtcgcccccgtgttgtctttctcaggcctcctccagaacacgatacaccagtcaccaccacctcaggatcccccaatggcagccttctgacgactcggaccgatg

SEQ ID NO: 5607 - DNA, 203 bp, Homo sapiens
ggcgcgccagtcctaatactctaaacaaaatacatgcctttcttcagcccactttccaggtttcggacagagcctcctctatggatacccagtctacgtgtttggcgattgtgttcaagccgattggtgtcccgtttcaggtgggctttgttccacccgcctgcaccggcatgcccttctcgccacctcgactcggaccgatg

SEQ ID NO: 5608 - DNA, 203 bp, Homo sapiens
ggcgcgccagtcctgcccggagcaccagctcacctgggaccccatcgatggacgcgttgtcggctctcctctccaataccttatccctcggctcccctccttccccacccagagaacctccaagaccctcaaggtcctcactccccctaccactcctgtctcccccaagattccacccgcctttttcccgactcggaccgatg

SEQ ID NO: 5609 - DNA, 203 bp, Homo sapiens
ggcgcgccagtcctaatccatgcgtaaactctccccctaccggaacgggtgcctatacccaactctcggagaccagctcccctcccttgccttccccgaccccggtctccggccccaaaacatctacaccacctggggaagaaccgtagtttgcttgtacctctaccaactatctcccccgatgacctcgactcggaccgatg

SEQ ID NO: 5610 - DNA, 203 bp, Homo sapiens
ggcgcgccagtcctccccctgcgtccagacggcttgggacacggggcttttaccctaccactctctcataactactccaggcctaatatggacgttcaatgacggttcgcccatgatttccggcccctgccccaaaccggggcagccatctttggtggtacaatcctccctgttaatctttgaaaaatcgactcggaccgatg

SEQ ID NO: 5611 - DNA, 203 bp, Homo sapiens
ggcgcgccagtccttttatatcgtgtgtacatataaatatgtacacacggcttttaggtagaatattgttttcaatgttgattttaaaggtaactttggttattatgctttacggttttcattgttgatggtatttgtggcctgcggtccctaattgttgaattatttattctgatacgttgttttcacgactcggaccgatg

SEQ ID NO: 5612 - DNA, 203 bp, Homo sapiens
ggcgcgccagtccttgtgtatgatctatacgcacatttagttcccagagggcgttgtcgtctccccctaagcaagggagaaacacgtggcacatgatcttgcgcttaacgataaaaatggaatctgataaaagtatggcctgtttaaatagaattttgatgaataagatgatgtttgtggaagataagcgactcggaccgatg

SEQ ID NO: 5613 - DNA, 203 bp, Homo sapiens
ggcgcgccagtcctatctctacccttaagatggttgctgattattatcaaaaagaagtaaagtatgattttgatgcagttgaatctccccgtgaggcacctgtatttagatgtacttgtcgattccttggttataccattatgactcaaggcatcggtaagaagaatccgaaacaggaagctgcacgtcgactcggaccgatg

SEQ ID NO: 5614 - DNA, 203 bp, Homo sapiens
ggcgcgccagtcctcagatgttgctcttgttatcaggagatgttgagactaaccctggacccgttcaatcgcgccccgtgtattatcgttacaacgaccctagatatacacggttggaaaaagctattgaacgtcgagacgataaaattaaaacattaattaaagagttgcgtcgacaaatcaaaaatcgactcggaccgatg

SEQ ID NO: 5615 - DNA, 203 bp, Homo sapiens
ggcgcgccagtcctgaattggatcaacggaataaaattgatctagatactgaaaccgcaaatcgtgttgaacaactttggataaagggcttgaaattcaagagtgaaccccttttgagtaaggaaatgtcagctttagttcatacaactcttttaccagctaagcaattgtacgagtatgtatcgtgtcgactcggaccgatg

SEQ ID NO: 5616 - DNA, 203 bp, Homo sapiens
ggcgcgccagtccttctcctgttaaagggggaggaccacgtatgcgtccaatttgtttatggttggtaggtgaatcaggagttggtaagactgaaatggtatatccattgtgcattgatgttcttcgggaaatggggatgattaagaaagatgattttcatcatcaagtttatggtcgtcaagttgaacgactcggaccgatg

SEQ ID NO: 5617 - DNA, 203 bp, Homo sapiens
ggcgcgccagtccttggttaggtcgattctttttgagtcgagatcgcaagaataaggttggaatttgggccgaagtgggacaatcaggtgatgttaaaacaaataaagctcagattaaacgtgttgaagctggagccgaagaattagttactgttgctttaactcaaggttgttctgatgatgctgcacgactcggaccgatg

SEQ ID NO: 5618 - DNA, 203 bp, Homo sapiens
ggcgcgccagtcctcaggcagttaattcgtccataattccttctcgaatttatgggaagttgtctgttcctacaatgaaaccagcactactcaagccaacgattctgaataacaaagtacataatcctttattgtcgggacttaagaaatgtggtgtagacactgcggtcttgagtgatgatgaagttcgactcggaccgatg

SEQ ID NO: 5619 - DNA, 203 bp, Homo sapiens
ggcgcgccagtcctatgaaaagaaatgctccaggtaaacagcaatggatgggttttggtgaagaatttgattttacaagtaattatgcactagctttgcggaaagatgttgaacaactcattgaagattgtgctagcggaaaaatatctaatgtcatttttgtagatacattgaaagatgagcgacgccgactcggaccgatg

SEQ ID NO: 5620 - DNA, 203 bp, Homo sapiens
ggcgcgccagtcctgcaaaacgtcttaaaacaaaaggtagtcacgtcattgcgggggactttggaaatttcgatggatctttagtagcacaaattttgtgggccatattttgggaaatttttgttgtatggcttaagcaatttattgatatagagaattcagaaggaaaacgtattttatgtatctgtcgactcggaccgatg

SEQ ID NO: 5621 - DNA, 203 bp, Homo sapiens
ggcgcgccagtcctaaatctcgtaaattagaagatattttctttttgaagagaaaatttcgttttagcccagaattacaacgccatgttgctccattgaagatcgaagttatttatgaaatgttgaattggtctcgccgctctatagatccagatgaaatcttgatgtcgaacattgaaacggcttttcgactcggaccgatg

SEQ ID NO: 5622 - DNA, 203 bp, Homo sapiens
ggcgcgccagtcctgtgaatcgaaactgcgtggtcaagttcgaatggcgaattttgatggcgctgatacatcacataaattggctttgtctgcccaaaacgaaattgaaacaaaatctggactttctggaacttctcctgatgaaatggatttatcacacgtcctttccataccaaatttttgggatccgactcggaccgatg

SEQ ID NO: 5623 - DNA, 203 bp, Homo sapiens
ggcgcgccagtcctaatttgttaagactcaatttcattctggacgtttacgcattagttttattccattttattataatacgactatatctgcaggagttcccgatgtttctcgtacccaaaaagtaatcgttgatctgcgcacctctacagaagtctctttcactattccgtatgtgtcttcacgaccgactcggaccgatg

SEQ ID NO: 5624 - DNA, 203 bp, Homo sapiens
ggcgcgccagtccttgggtgaagatttagctattcaaagaaacgatgctcaacatggtgttcatccaatgactatagacactcataagatcgactcaaattggtctccggaagcgcattgtattggtgaaaagattatgtctattcgccaattgattaagcgttttggcatggctttgaactccttgacgactcggaccgatg

SEQ ID NO: 5625 - DNA, 203 bp, Homo sapiens
ggcgcgccagtcctaagtttctttttggttttgggttttattcagtaactatctgccctgcttacacgggtattatttttaattcttgtcccttctggactcttttattttgtattttcaaaatttttactaatttttagtcagagtccttaggggctaccaggtttttcgcaattttcctgcttactcgactcggaccgatg

SEQ ID NO: 5626 - DNA, 203 bp, Homo sapiens
ggcgcgccagtcctgccgggtggaaggcccggaaccgccccaccacctcaactaggtggtaagggtacgtctatgggtccggctggcccgaaaggcggtggatcctgtgtgttagggttcgtaggtggtaaatcccagcacaggtggtaatcgctatagggcaggcttatcccggtgaccgcttccctcgactcggaccgatg

SEQ ID NO: 5627 - DNA, 203 bp, Homo sapiens
ggcgcgccagtcctactgtgtgtacacagtcttgctggactctctacagacctggagttgctacgcggcctggctcccagcccggagagcttcttgggaagtttggcggagccttaggcccggtggcctcagctgcttacacagcaggggtcttgggcctgggtgaaccattctccctcgctttctgtcgactcggaccgatg

SEQ ID NO: 5628 - DNA, 203 bp, Homo sapiens
ggcgcgccagtccttttggcgactgggtgccattgtatgatgagctgcccaggagtgctctttgcaccttctatgcggggaccggcaggtatccggctgatgttgatgtcttgaatccctccggtcctccatgtgctagttgtgtcgtggaccagagaccacggaaatgtggtgactgtgtccgcgaccgactcggaccgatg

SEQ ID NO: 5629 - DNA, 203 bp, Homo sapiens
ggcgcgccagtcctaagaagcttggggtcaacatgactgtgagccagataggaggttattggcacgcccttcagtgtccatgtgattttacacctggtccgctaccagagcggattcccggaatcccagtgaatgcttgcatcaccggaaaggccgcgcacccattctctgcgtgggcgccggggggtcgactcggaccgatg

SEQ ID NO: 5630 - DNA, 203 bp, Homo sapiens
ggcgcgccagtcctgtcaagcctttgccctgcccgaactcgaccacgggcttgggtgattcagtcagtaacgccgcctgcttcgctggttccgacttgtggctcggggtcggtggtgcttggtcggccctttctggcgccacgtccgctgtcgccagttgggtcggctcggcctaccggaccttgcaccgactcggaccgatg

SEQ ID NO: 5631 - DNA, 203 bp, Homo sapiens
ggcgcgccagtcctaatgtgggtctcggcgtgagatggttggcatcggtgggctcttacctaccgaccgtggaggccgcgctggctcctgagctggtgtgtgctcccgtggttggttggggggcacaggagtcttggttcgtggggttcctagcagtgtgttgtgtggtcgcttaccttggggttctccgactcggaccgatg

SEQ ID NO: 5632 - DNA, 203 bp, Homo sapiens
ggcgcgccagtcctggcactgccagatgctgcgtgctggtggcgatgcacttcgcaagaggtgcgctgcccctagtcatgctagtgttggcaggggtgtcgcgagagcggcattccgtcttgggtctcgaggtttgcttcaacttggagggcactggttgggactggagtgactactggtggtgtgtgcgactcggaccgatg

SEQ ID NO: 5633 - DNA, 203 bp, Homo sapiens
ggcgcgccagtcctgctggggtggtgtcttgggcccttgtcaccatgggtctcttgacccacggtggcaaggaggtgaagcttaggtggtatcgcacctggtgcgtgttctaccaaaaggttcgcctgcgcctgttggacactcccataggcaaccgcccccgccggcctttgtgcaaactgtggctgcgactcggaccgatg

SEQ ID NO: 5634 - DNA, 203 bp, Homo sapiens
ggcgcgccagtcctggtgccacacacctggccgagcgcctacgtcgcaggggggtattcctgtttgagcacgctggacatgtcacacggccagcggcagagcggttgcgggaatggggttttgccctagagcccgtcgctgtgaagccagaggactgtgccatagttcgggatgccgcacgagtgttgcgactcggaccgatg

SEQ ID NO: 5635 - DNA, 203 bp, Homo sapiens
ggcgcgccagtcctggttgtggtcagagagtgaatggtgtgcctgtggtcgcccgtaggggagacgaagtgctcatagggtgcttgtccagcaggttcgacctcccacccgggttcgtgccgacggctcctgtcgtcgtgcaccaccaggggaaggggttttttggggtcgtcaagacctcaatgacccgactcggaccgatg

SEQ ID NO: 5636 - DNA, 203 bp, Homo sapiens
ggcgcgccagtcctgatgtgtgtgtatacccattgccaatgggggctacctgcttggaaccttgcaaatgctcaccgcagggcgtttgggtcgtgagaaacgacggagcgctctgccatggcactctcgggaagactgttgagctggacctaccagctgagctgtgtgacttccgggggtcgtctggccgactcggaccgatg

SEQ ID NO: 5637 - DNA, 203 bp, Homo sapiens
ggcgcgccagtcctactgcttattctaggactactcaatctaacctgacttactgtacttatggaagattcatggcaaatcccagaaagtacctccgcggccatgacgtggtgatctgcgacgagtgtcactcgactgacggcgttagtgttctgggcatgggacgtgcccggttgctggcgaaagaacgactcggaccgatg

SEQ ID NO: 5638 - DNA, 203 bp, Homo sapiens
ggcgcgccagtccttgtcgggttcgcttgttgctgtttgccactgcgacccctccgggggccccaatggccgcacatgacaatattactgaggagccccttgacaccgaaggggagatcaccttttatggacacaggttgccagttgcaagatacgccactgggagacacctgcttttctgccactcacgactcggaccgatg

SEQ ID NO: 5639 - DNA, 203 bp, Homo sapiens
ggcgcgccagtcctatggtggaggaggtggtcgaggtcaccttggaccccaccataacaatttcactgcggacagtgccagcaccagcagagttgaggatgcaacgcagggggcggtgtggacgtggtaggaccggacactactactccgcgctggctgctgcagcgccggcaggtaccgtgcgctctcgactcggaccgatg

SEQ ID NO: 5640 - DNA, 203 bp, Homo sapiens
ggcgcgccagtcctcaggcctcaacgggtctggccatggcgggtgcttacttcgccggggggtcgataaccagctcttggttgagcatcatcataaccctgcttggtggttgggagggcgccgttaacgcggcctctctcacttttgacctcctttctggcaaggcagaggccaaggacgcctggtgccgactcggaccgatg

SEQ ID NO: 5641 - DNA, 203 bp, Homo sapiens
ggcgcgccagtcctgctgttaaagccagtccctgcttcgccggtgatttgcctgtctcttgggaggccccaatctgtaggccagcaatggtctataggggaggccagactatccagctggatggagtgcgccgtacgttgccttgtggcttgccacttggagcgcgcccccctcctcggcaggagcaacgactcggaccgatg

SEQ ID NO: 5642 - DNA, 203 bp, Homo sapiens
ggcgcgccagtcctcccacccatgtgagcaactggagcaaggaggaggaagctgagcttcagtgtgcgaaggctgctgctattgaggctatagggtctgcactgcatctccctagccaagaggctgcggaagcagccttgcaggctctggaggatgctgctgtgtccctactgccccatgtgcctgtccgactcggaccgatg

SEQ ID NO: 5643 - DNA, 203 bp, Homo sapiens
ggcgcgccagtcctcgtgcggaatcaatcaacgatctgcgcgcgcccctcgcgagcttcgacagcatgccaagccttgaaacgtcagactccatgccatcattggagtccagctctggatccagctttgaggttgtctcgttgaccgagtctgaaccagaaactgtgatcgagggaggtttgaccctccgactcggaccgatg

SEQ ID NO: 5644 - DNA, 203 bp, Homo sapiens
ggcgcgccagtcctaagaaacatccggctgcgataactgtggatgccacttgctttgattcgtcaatcgacgaacatgacatgcaggtggaagctgcaatcttcgcggccgctagtgacgaccccgtccgggtgcatgctttgtgcaggtactatgtcgagggccccatggtgtcaccggatggcgtgcgactcggaccgatg

SEQ ID NO: 5645 - DNA, 203 bp, Homo sapiens
ggcgcgccagtcctaggacccttctacggattggtatgagttccccaccccgtaacttagaagtactagcaaaaccgaccaataggagcgtggcacccagctgcgttaaggtcaagcacttctgtctccccggccagaaatggtcgtcacccgccctctctactacgagaagcctattaaccattgaacgactcggaccgatg

SEQ ID NO: 5646 - DNA, 203 bp, Homo sapiens
ggcgcgccagtcctattcagcaaccctgatattaccatacgtgaatgccattccgatggactcggccattaggcattcaaattggacactagctatcattccagttgcacccttgaaatatgcagccgagaccacgccgcttgtccccattactgtgactatcgcaccgatggagacggagtacaacgcgactcggaccgatg

SEQ ID NO: 5647 - DNA, 203 bp, Homo sapiens
ggcgcgccagtcctttgagtctatccttgaggccaacaacagggaaggggtagagggtgttgagcggtatgtcatcccagtaagtgttcaggacgcattggatgcccagatttatgccctaagacttgagcttggcggaagtggccctctctcctccagccttctaggtaccttagcaaagcattatacgactcggaccgatg

SEQ ID NO: 5648 - DNA, 203 bp, Homo sapiens
ggcgcgccagtcctcccaatggagtgggtcagtggagatcacctgcatgttcactggcaccttcatgacaacaggaaaggtcctcttggcatacacacctccaggtggagatatgcctaggaatagagaagaagccatgcttggaacgcatgttgtctgggactttggtctacaatcatcaataacctcgactcggaccgatg

SEQ ID NO: 5649 - DNA, 203 bp, Homo sapiens
ggcgcgccagtccttggtcataccttggatctctgcatcacattttagaggagtcagtaatgacgatgtgctgaattaccaatattatgcagcaggtcatgtcaccatctggtaccaaacaaacatggtaatccctccgggattccctaacacggcaggcataatcatgatgattgccgcacagccaacgactcggaccgatg

SEQ ID NO: 5650 - DNA, 203 bp, Homo sapiens
ggcgcgccagtcctaggccgctgagactggtgccacgtcaactgccagggatgagagcatgattgagacccgcactattgtgccgactcacggtatccacgagacaagtgtggagagtttctttggacgctcctcactcgtgggtatgccgctgctggccactggcaccagtatcaccaactggcgcacgactcggaccgatg

SEQ ID NO: 5651 - DNA, 203 bp, Homo sapiens
ggcgcgccagtcctatcaagactcatttcagtggcaatctgggtgcaacccctcggtattcgcggacacggacggaccacctgcccaattctcagtacccttcatgagctcagccaatgcgtattccacggtttatgatgggtacgcacgattcatggacactgacccagatagatatggcatcctcccgactcggaccgatg

SEQ ID NO: 5652 - DNA, 203 bp, Homo sapiens
ggcgcgccagtcctacgggtgtgacaccatcgctcgatgcaattgcagatctggtatctattactgcaaatccacagccaagcactatcctattgtagtcacgcccccatctatctacaagattgaggccaacgattattacccagaaagaatgcaaactcacatccttcttgggattggcttcgctgcgactcggaccgatg

SEQ ID NO: 5653 - DNA, 203 bp, Homo sapiens
ggcgcgccagtcctttctaggttgtgaaggctctccatggaaatggctgaagagaaaggtttgccaaattcttggaatcaacatggcagaaaggcagtcagacaactggatgaaaaagttcactgagatgtgcaacgccttcagaggcctagactggatcgcagcaaaaatctccaagtttattgattcgactcggaccgatg

SEQ ID NO: 5654 - DNA, 203 bp, Homo sapiens
ggcgcgccagtcctagaacgccccgctttatgccgcagaagctaagcgcgtctaccatctagagaagcgcgtcctccgtgccatgcagttcaagaccaagaaccgcattgaacctgtatgtgcactgattcatggctcacctggtaccggtcagtcgttggctactatgatagtaggaagaaaactggcgactcggaccgatg

SEQ ID NO: 5655 - DNA, 203 bp, Homo sapiens
ggcgcgccagtccttcactgaacttaagcttgagcgcaacgtgaaccgtgcgctggcagtcattcagagtgtgtctctcattgctgcagtggctgggaccatttacatagtttatcgcctcttttctggtatgcagggcccttactcaggtatcggcacaaactacgccacaaagaaaccagtggtaacgactcggaccgatg

SEQ ID NO: 5656 - DNA, 203 bp, Homo sapiens
ggcgcgccagtcctagctttttacctgcgtggggcgtgtcaaggactacggattcctgaaccttgctggcaggccaacacatagagttttgatgtatgaattccccaccaaggcaggccaatgcggtggtgtggttattagcatgggtaagatagtgggtgtccacgtaggaggtaacggtgcccaagcgactcggaccgatg

SEQ ID NO: 5657 - DNA, 203 bp, Homo sapiens
ggcgcgccagtcctgttttgccgcctcccttctacgcaggtactttacagcagaacaaggacaaattgaatatatcgagaagagtaaagatgccgggtaccccgtgatcaatgcacccacccaaaccaaattagagcccagtgttttctttgatgttttccccggggtgaaagaaccagcggtactcccgactcggaccgatg

SEQ ID NO: 5658 - DNA, 203 bp, Homo sapiens
ggcgcgccagtcctatgaactcagggcgccagataagatcaggaaaggaaaaagccgtttgatagaggcatctagcttgaatgattcagtagccatgcggtgctactttgggaacctctacaaggttttccacaccaaccctggaaccatctccggctgtgccgttggatgcgaccctgaaaccttctcgactcggaccgatg

SEQ ID NO: 5659 - DNA, 203 bp, Homo sapiens
ggcgcgccagtcctctaacgattacgcgaacctgaatgaagcagaaggcttcatttggtgaccccgacgtgatcgttagggaatagtggtcggccacaggcgtggcgatcctgccctcatccgtctcgcttaacggagcaggacgatgaccctagtagagggggctgcggcttaggagggcagaagctcgactcggaccgatg

SEQ ID NO: 5660 - DNA, 203 bp, Homo sapiens
ggcgcgccagtcctgagtgacgtcggagggagctccacggccggggggcaagataacctaccgagaactcagagagtcgttggaagacgggaaggaagcccgacgactgagcagtccaccccaggcgttgattctggtcgcccggtggatcaaagcatggaagccgtcataaaggtgatttcgtccgccgactcggaccgatg

SEQ ID NO: 5661 - DNA, 203 bp, Homo sapiens
ggcgcgccagtcctacctgccccatatgccttatggatggacgcttggggagtccaactccagacggttatagcggcggccactcgcgacccccgacacccagcgaacggtcaaggacggggggaacggactaacttggatcgcttaaagggcttagctgatgggatggtgggcaacccacagggtcacgactcggaccgatg

SEQ ID NO: 5662 - DNA, 203 bp, Homo sapiens
ggcgcgccagtcctagacctcccgccttccgcgcgggctccggtgatcattgactgctttaggcagaagtcacagccagatatccagcagcttatacgggcagcaccctccacagtgcacggccaggcagcagccgccgcgatgccgctcagcgccagcctccccagcaagaactacgattacgactacgactcggaccgatg

SEQ ID NO: 5663 - DNA, 203 bp, Homo sapiens
ggcgcgccagtcctcgactcggtgcagccctacttctacttcgaggaggaggaggagaacttctacctggcggcgcagcagcggggcagcgagctgcagcctcccgccccgtccgaggacatctggaagaagtttgagctcctgcccatgccgcccctctcgcccagccgccgctccagcctggccgccgactcggaccgatg

SEQ ID NO: 5664 - DNA, 203 bp, Homo sapiens
ggcgcgccagtcctcgagtctgaatccagcacagagtccagcacagaagcatcagaggagcactgtaagccccaccacagtccgctggtcctcaagcggtgtcacgtcaacatccaccaacacaactacgctgctcctccctccaccaaggtggaatacccagccgccaagaggctaaagttggacagcgactcggaccgatg

SEQ ID NO: 5665 - DNA, 203 bp, Homo sapiens
ggcgcgccagtcctcgagaaggcgcccaaggttgtcatcctgaaaaaagccacggagtacgttctgtctctccaatcggacgagcacaaactgatcgcagagaaagagcagttgaggcggaggagagaacagttgaaacacaaccttgagcagctaaggaactctcgtgcataggaactcttggacatcgactcggaccgatg

SEQ ID NO: 5666 - DNA, 203 bp, Homo sapiens
ggcgcgccagtcctaaaactgcctcataattgatactttgggcataagggatgatgggacattcttcatgcttggggatgaactcttcaacttttttcttttaaaattttgtatttaaggcattcctggtggccctgataacagcacaaccctcacctatcggaaggtttcgtgcttgttgttaaagccgactcggaccgatg

SEQ ID NO: 5667 - DNA, 203 bp, Homo sapiens
ggcgcgccagtcctttaaaattttgtatttaaggcattcctggtggccctgataacagcacaaccctcacctatcggaaggtttcgtgcttgttgttaaagctgaacgtttctctttagacgagccatcagaactacaactattaggttcccagtctctccccattataactaatattactcggatcccgactcggaccgatg

SEQ ID NO: 5668 - DNA, 203 bp, Homo sapiens
ggcgcgccagtcctggtctcactccctcacagttgctgtggtgttgtgattcctcttctgcagaagatattaataaagtgtataacagacaaatgtgactggcctgggctgctttcctttcttcgaacatggatataatttagataagtgaatttgaattaacattttggtgccgtgacccggattctcgactcggaccgatg

SEQ ID NO: 5669 - DNA, 203 bp, Homo sapiens
ggcgcgccagtcctcatacccctcatgcagcattacctaaacttgcaaagcagacaggatgcaaaaattaaacaaactcccctagtcttacagcttgcgatgccagcgcagaccatgaacgggaataaaggatatgtaggctcttaccctacaaacgaaccatattattcgttccagcaacaacagcgcgactcggaccgatg

SEQ ID NO: 5670 - DNA, 203 bp, Homo sapiens
ggcgcgccagtcctacctgcaccaagggccccacctggaaatgtacccagcaatacctgcttcttttgcaaacaaccgggtcattggaaagctgactgccccaataaaacacgtaatcttagaaacatgggaaatatgggacgaggcggaaggatgggaggccctccgtataggtcacaaccataccccgactcggaccgatg

SEQ ID NO: 5671 - DNA, 203 bp, Homo sapiens
ggcgcgccagtcctcgcatttatacaacctcctcaaaaccaccaaaaccaatataatggccgcatggaccggtcacagctacaagcctctgctcaagagtggcttcccggtacatatcctgcataggatccaattgactgtccttatgaaaaatctggtacaaaaacaacccaagatgtaattaccaccgactcggaccgatg

SEQ ID NO: 5672 - DNA, 203 bp, Homo sapiens
ggcgcgccagtccttaaaaatgctgaaattatggttacagtaaaccacacgaaaattcctatgttggtagatacaggcgcctgcctgactgcaataggaggggcggccacagtggttcccgacctcaaattaacaaacacagaaattatagctgttggtatttccgctgaaccagttccacatgtcttcgactcggaccgatg

SEQ ID NO: 5673 - DNA, 203 bp, Homo sapiens
ggcgcgccagtccttaaagataaaaccgaaggactaaggccattaattagttcactagaaaatcaaggaatattgataaaatgccatagcccatgtaatacaccaatctttcctattaagaaagcaggtcgggatgagtatcgaatgatacatgacttacgcgcaataaataatatagttgcccccctcgactcggaccgatg

SEQ ID NO: 5674 - DNA, 203 bp, Homo sapiens
ggcgcgccagtccttccggcgcacttatatatgcagtcttgtgaaaataatattccgcctcatgactgcgttttacttacccacacgatctccaggccccgacctgatttatctgatctcccaatacctgaccctgatatgactctgttttctgatggctcttatacaaccggcagaggaggagcggccgactcggaccgatg

SEQ ID NO: 5675 - DNA, 203 bp, Homo sapiens
ggcgcgccagtcctaccttttctgatcctcctctctacaccaacggcggtaaaagttgaaggacgaccaacatggatacacctggatcattgcaagttattgcgatcatctctctcctcctcgttgggggggccagtcaaccagctactttcttagagaaagcacttccgactgatggtcccagcctgcgactcggaccgatg

SEQ ID NO: 5676 - DNA, 203 bp, Homo sapiens
ggcgcgccagtcctttcgtaataaaacaatgcagaaagaaacgaggaaaaagacagatcacggtacctaacagcaccctttcccccacaggtactacagacttcacaaaatttacccctaatcctatatctcccaacagtacggccctgaatgagcttgagcaaaagactacaccaataggaacagagcgactcggaccgatg

SEQ ID NO: 5677 - DNA, 203 bp, Homo sapiens
ggcgcgccagtcctctaaaacagggccagatagcattgattcgacatcacgaggctattactaccattcttggacaagaggcaacatatagcattaaagaaacacaggcattaatttcatctatcgaacaagaggcatggtataataatttattctcttggtatgacggctctgtatggtcacagctacgactcggaccgatg

SEQ ID NO: 5678 - DNA, 203 bp, Homo sapiens
ggcgcgccagtcctttcactctggcttatggatgtgacgagtcagcaggatgggttaaccaacatgctgaatacatgggaaagccggtaatcgtgacattggcgggcctagtaattacgcctgtgggtttggcttggataccactcccacaacaagaaccattggaaaagttatttatggtccccaatcgactcggaccgatg

SEQ ID NO: 5679 - DNA, 203 bp, Homo sapiens
ggcgcgccagtcctagcatgccacatgtcaccgtggccatggccgattatcatgagacaaaagaaatgggcaaaattgtgaaagacataaacaacgaagaacttcttttggtaaaaccacaactctttaagtgggaccgaagggttttttgtagcctgtccccttgttataagaggagttgtcactggcgactcggaccgatg

SEQ ID NO: 5680 - DNA, 203 bp, Homo sapiens
ggcgcgccagtcctccaagccgaaaatgacttactacacccttacatgtaccattacattaaactatcttatcgacacagaacacccgactatcactccagtccggcccttcgagcggcagtagttattgctgcggccgtaaaaggtgcagatctgttagaaatgaatatgctcttcataatgatgtacgactcggaccgatg

SEQ ID NO: 5681 - DNA, 203 bp, Homo sapiens
ggcgcgccagtcctattagatgatgtgatggcagtactggaggcagaggttgcaatcacgataaccacagccactgaaggcacggacgctgaagacacgagtgaggtcgacgtcatcaacgtcgtcgatccaataggataactatgttttcagactcagattcctcggacgaggaactaagcagaatacgactcggaccgatg

SEQ ID NO: 5682 - DNA, 203 bp, Homo sapiens
ggcgcgccagtccttacacaatcatgaatagatacacgggggaatcaatagcagaaatgcacactgggtttaggtgtttcagggatcaaatgatagcctatgatatggagtttaccaattttctcagggatctgacagaggaagaaactccagtattagagataaccgaaccagagcccagccctacgcgactcggaccgatg

SEQ ID NO: 5683 - DNA, 203 bp, Homo sapiens
ggcgcgccagtcctgtttgtcattatattgttgacacttaggaaagtgctgtataggcctaaagtagaaataacaactgatcgtggaacagttggtgctgaatgcatgttgccttcaaacagtgttttcttcaaacagtatttacttctgagaatccatgaaagtatataacggttgcttgttggtaacgactcggaccgatg

SEQ ID NO: 5684 - DNA, 203 bp, Homo sapiens
ggcgcgccagtcctcattatattgttgacacttaggaaagtgctgtataggcctaaagtagaaataacaactgatcgtggaacagttggtgctgaatgcatgttgccttcaaacagtgttttcttcaaacagtatttacttctgagaatccatgaaagtatataacggttgcttgttggtaagaacggcgactcggaccgatg

SEQ ID NO: 5685 - DNA, 203 bp, Homo sapiens
ggcgcgccagtcctggaccttaccttactgaggaaggatggctcgagaattaaatcctctccaattacagcaactgtatataaataatggcttacaacctaatccaggacatggagatattattgctgtcagatttacaggaggaccttggggtccaggtgatagatgggctagagtgacaatacgatcgactcggaccgatg

SEQ ID NO: 5686 - DNA, 203 bp, Homo sapiens
ggcgcgccagtccttagtagcatctcatcccggcctaacgttgactgagaatgaggccgggagctggaatgctgccatatcagctttatggaggaaagctcacggtgctgcagctcagcatgaattggcaggagtattaagtgatattaataaaaaggaaggcatacaaactgcattcaacctaggaacgactcggaccgatg

SEQ ID NO: 5687 - DNA, 203 bp, Homo sapiens
ggcgcgccagtcctagagagatcagagaggaccgtcgcaacctcctcgtggaagtggaggaggatataattttagaagaaatccgcagcagcctcagcgctacggccaaggaccaccaggaccaaacccgtaccgacgattcggagacggcggtaatcctcaacagcagggaccaccaccaaaccgagcgactcggaccgatg

SEQ ID NO: 5688 - DNA, 203 bp, Homo sapiens
ggcgcgccagtcctgatttatccaatggtttctgggcacaccccatagtcccagaggattattggattactgcattcacttggcaaggaaaacaatattgttggactgttttaccacaaggttttttaaacagccctgggttgtttactggagatgttgtagatcttctacagggaattcccaacgtgcgactcggaccgatg

SEQ ID NO: 5689 - DNA, 203 bp, Homo sapiens
ggcgcgccagtcctcccacctgctctggttggtcaccatacgttggccagctggtccaggagagggtgtacaggccgtcacaattaaggcctaagtggaggaagcctacaaaggtcttggaaatattgaatcctagaactgtgattatagtggaccatctaggccaacggaaatctgtgagtattgaccgactcggaccgatg

SEQ ID NO: 5690 - DNA, 203 bp, Homo sapiens
ggcgcgccagtccttttggttttatcaagtactacagactgtggcataccagcttacgtgcctgtggttataacggtgaatgacacaatcagctgttttgataaagagtttaaaaggccacttaaacaggaactaaaagtaacaaaatatgcaccatccgttcctcaattagaactaagagttcctcgcgactcggaccgatg

SEQ ID NO: 5691 - DNA, 203 bp, Homo sapiens
ggcgcgccagtcctttatcctttggagggaagcaaaagttgtattatatatgcaaccaatgtcataaaggaattcctgaaagtggatacataactctcaatactaaatattatctatatgagaaaggacctactgagactggcaccaaaggtctaactcttatgagaaggcatgtgcaaaattcccctcgactcggaccgatg

SEQ ID NO: 5692 - DNA, 203 bp, Homo sapiens
ggcgcgccagtccttgtttcctgaacagtcggaaagaatccggaacacccaagacggatcctactcgtcctgcaacatcttatagcctatgccgaagcgactatcaagaagcaggatgttcccggcccactccttccaattctgagtccgtatgtaatggcttgggacaaccctcagaacgtggtcaccgactcggaccgatg

SEQ ID NO: 5693 - DNA, 203 bp, Homo sapiens
ggcgcgccagtccttccatactcagaaaacgaatgcaagagcgtttgttttttttttatagaggttcccgaactattgtacctttgaatatggtttatcccttatttaaagatacgttaaatagtatcaggcatccagcgaattatacgcggtggggtttcgaatatttggacggaacagatattcgtcgactcggaccgatg

SEQ ID NO: 5694 - DNA, 203 bp, Homo sapiens
ggcgcgccagtcctcaacgtttacagattgaatcattgaattgtccggaagcggtgtcacgtcgtatagattttgcttttaacgttcgtatagtaccagaataccaaatggaatatatgagcgctaatggtgataaattgtatagactagacgctgccaaggcaaggcaagattttggagacgttttacgactcggaccgatg

SEQ ID NO: 5695 - DNA, 203 bp, Homo sapiens
ggcgcgccagtccttcttgtcctggaatacttgccaaatattattttgccaatgcggaaactgaaaagtcccgtgtttgcatcagtgctattggtgtttcagaacgagatgaagttgatgtaatgtctgtacctggatgcatggagatagtgcgtaatcgtgacttctacacttacacggcgccaactcgactcggaccgatg

SEQ ID NO: 5696 - DNA, 203 bp, Homo sapiens
ggcgcgccagtccttttgatcaagccatattgggtatcgatggtgacccgtttatcaattctttggatcgtaatacggcacctgggttcccttactcaactatgaggaagggaacgaaaggtaaaacgttatggttcggcaatggtatggattatgaccttacgggaccgtatgcggttgcgttacgacgactcggaccgatg

SEQ ID NO: 5697 - DNA, 203 bp, Homo sapiens
ggcgcgccagtcctccttttgttgctcatttatcacgtatgcgtattagaaatacgatatgtgtgggtgtcaaccctttttctagtgaatggagtgctgtagcacaaaaactcttagttaaaggaccgcacgttatagctggcgactattctaattttgacggttcgttacccgcccaactagtctatcgactcggaccgatg

SEQ ID NO: 5698 - DNA, 203 bp, Homo sapiens
ggcgcgccagtccttgctgacgtgaaaacgttgcgtattgctacaacacttggttagctatttagctttactaatcaagacgccgtcgtgcagcccacaaaagtctagatacgtcacaggagagcatacgctaggtcgcgttgactatccttatatatgacctgcaaatataaacgaaaacactacaacgactcggaccgatg

SEQ ID NO: 5699 - DNA, 203 bp, Homo sapiens
ggcgcgccagtcctcaaaaatacaacagcaaatcctttcttttagttcggaaggtgaatccccgtcgtcatccacagttttagcaccactcaaattgcaagatcctatattggattgcgcgagagatggaaaaactcatacagttaattcttttcttgagaggcctataaactttagaaccgcgacttcgactcggaccgatg

SEQ ID NO: 5700 - DNA, 203 bp, Homo sapiens
ggcgcgccagtcctggagtaatcaaccagctggcgaaaggttattttcttttaattacccttctaatgttgttacgaatcctatgtacagcagaaaattgcaaaattttctaggtttgcgtgctgatttagttgttcgcgttcaagtcaacgctcaaccatttcatgcaggtagattaatgctgtcctcgactcggaccgatg

SEQ ID NO: 5701 - DNA, 203 bp, Homo sapiens
ggcgcgccagtccttgacggggtcaggcgatattggaactttccaattaatcgtttattctccgttagtcgatttagtctcgggaggtaatatagactatacgatatgggttaatatgacaaacgtaagaacagagtttccaaccggtatgccaacttctatcgctcaggtgggagaagaaggcagtacgactcggaccgatg

SEQ ID NO: 5702 - DNA, 203 bp, Homo sapiens
ggcgcgccagtcctggttacatgtcaactctacaccttgggtcactgcattttcgcagatccatgcgtgtaggtcgattgtcgtcgaggttcttaatgagctagttaacacatctaccgtatctgatactattgaagttttagtggaagtatgtgctgctgaagatattgaatttgccattcctatagcgactcggaccgatg

SEQ ID NO: 5703 - DNA, 203 bp, Homo sapiens
ggcgcgccagtccttgccatctttaacaccgcgtgctgccccgcaaggttcatctcgtcgtactgcttacgatttgatcacaagcattgcgcaagtaggaactgatacgggagatacaccactcgaggtatctcgtgaagagccaacaacttttaacgatgtacctctccaaccaactacgactacatcgactcggaccgatg

SEQ ID NO: 5704 - DNA, 203 bp, Homo sapiens
ggcgcgccagtccttcgaggcgggccctcatgtgttccacatgcagacttaaagaagtctacccccggcccgtctgggggatctaagtttttatcagttttcttagacctgaccttaattggttgggaggcgtaactgttactttatgtctggcgaacatgagaggtgctgtaatgtcatttttcgtccgactcggaccgatg

SEQ ID NO: 5705 - DNA, 203 bp, Homo sapiens
ggcgcgccagtcctccgggtgaatcactctgcgagtgacgtgtgagtagcgaacagacgtgttcggggctcaccgcctggtaatccagggagacgtcccaggatcaggggaggaccagggacgcctggtggacccctcggtaacgggtcgttgtgacccgatttcatcgcccgtctggtaagacgcgccgactcggaccgatg

SEQ ID NO: 5706 - DNA, 203 bp, Homo sapiens
ggcgcgccagtcctcccccgccctatccggcggcactgccaccccctctggcccctcaggcgatgggaccgccgtcaggccagatgcccgatagtagcgatcctgaggggccagccgctgggaccaggagtcgccgtgcccgcagtccagcagacaactcgggtcctgactccactgtgattttgccccgactcggaccgatg

SEQ ID NO: 5707 - DNA, 203 bp, Homo sapiens
ggcgcgccagtcctctccgagccataggacccccggccgagcccaatggcctggtccctctacaatattggcctttttcctcagcagatctttataattggaaatctaatcatccctctttttctgaaaacccagcaggtctcacggggctccttgagtctcttatgttctcccatcagcccacttggcgactcggaccgatg

SEQ ID NO: 5708 - DNA, 203 bp, Homo sapiens
ggcgcgccagtcctgacgattgccaacagctcctacagattcttttcaccactgaggaacgggaaagaattctcctggaggcccgcaaaaatgtccttggggacaatggggcccctacacagctcgagaacctcattaatgaggccttccccctcaatcgacctcactgggattacaacacagccgcacgactcggaccgatg

SEQ ID NO: 5709 - DNA, 203 bp, Homo sapiens
ggcgcgccagtcctggtagggagcgtcttctggtctaccgccggactctagtggcaggtctcaaaggggcagctcggcgtcctaccaatttggctaaggtaagagaggtcttgcagggaccggcagaacccccttcggttttcttagaacgcctgatggaggcctataggagatacactccgtttgatcgactcggaccgatg

SEQ ID NO: 5710 - DNA, 203 bp, Homo sapiens
ggcgcgccagtcctgacaaagaccagtgcgcatactgtaaagagaagggccattgggcaagagaatgtccccgaaaaaaacacgtcagagaagccaaggttctagccctagataactaggggagtcagggttcggaccccctccccgaacctagggtaacactgactgtggaggggacccccattgagcgactcggaccgatg

SEQ ID NO: 5711 - DNA, 203 bp, Homo sapiens
ggcgcgccagtcctttcctggtcgacaccggagctgaacattcagtattgacccaacccatgggaaaagtagggtccagacggacggtcgtggaaggagcgacaggcagcaaggtctacccctggaccacaaaaagacttttaaaaattggacataaacaagtgacccactccttcctggtcataccccgactcggaccgatg

SEQ ID NO: 5712 - DNA, 203 bp, Homo sapiens
ggcgcgccagtcctgagtgccctgctcctctgttgggcagggacctcctaaccaaactaaaggcccagatccagttttccgctgagggcccacaggtaacatggggagaacgccctactatgtgcctggtcctaaacctggaagaagaataccgactacatgaaaagccagtaccctcctctatcgaccgactcggaccgatg

SEQ ID NO: 5713 - DNA, 203 bp, Homo sapiens
ggcgcgccagtcctccatcctggctccagcttttccccactgtatgggcagaaagagccggcatgggactagccaatcaagtcccaccagtggtagtagagctaagatcaggtgcctcaccagtggctgttcgacaatatccaatgagcaaagaagctcgggaaggtatcagaccccacatccagaagcgactcggaccgatg

SEQ ID NO: 5714 - DNA, 203 bp, Homo sapiens
ggcgcgccagtcctcttccgcctagctatacttggtactcagtcttagatctcaaggatgcctttttctgcctcaggctacatcccaacagccagccgctgttcgcgttcgagtggaaagacccagaaaaaggtaacacaggtcagctgacctggacgcggctaccacaagggttcaagaactctccccgactcggaccgatg

SEQ ID NO: 5715 - DNA, 203 bp, Homo sapiens
ggcgcgccagtccttcggctaagaaggcccagctctgccagagagaagtcacctatctggggtacctactcaaggaaggaaaaagatggctaaccccagcccgaaaggctactgttatgaaaatccctgttcctacgacccccagacaggtccgtgaatttctaggcactgccggattctgcaggctccgactcggaccgatg

SEQ ID NO: 5716 - DNA, 203 bp, Homo sapiens
ggcgcgccagtccttggatccctgggtttgcttccctggctgcacccttgtaccccctaacaaaagagagcatcccttttatttggactgaggaacatcagcaggcttttgaccacataaaaaaagccttgctgtcagcccctgcattggccctcccagacctcaccaagccattcactctatatatacgactcggaccgatg

SEQ ID NO: 5717 - DNA, 203 bp, Homo sapiens
ggcgcgccagtcctagggccaggaatacccctggccggtttggtttaactccttatgaaattctctatggaggaccaccccccatacttgagtctggagaaactttgggtcccgatgatagatttctccctgtcttatttactcacttaaaggctttagaaattgtaaggacccaaatctgggaccagcgactcggaccgatg

SEQ ID NO: 5718 - DNA, 203 bp, Homo sapiens
ggcgcgccagtcctatcaaagaggtgtataagcctggtaccgtaacaatccctcacccgttccaggtcggggatcaagtgcttgtcagacgccatcgacccagcagccttgagcctcggtggaaaggcccatacctggtgttgctgactaccccgaccgcggtaaaagtcgatggtattgctgcctggcgactcggaccgatg

SEQ ID NO: 5719 - DNA, 203 bp, Homo sapiens
ggcgcgccagtcctgtccatgcttctcacctcaaacctgcaccaccttcggcaccagatgagtcctgggagctggaaaagactgatcatcctcttaagctgcgtattcggcggcggcgggacgagtctgcaaaataagaacccccaccagcccatgaccctcacttggcaggtactgtcccaaactggcgactcggaccgatg

SEQ ID NO: 5720 - DNA, 203 bp, Homo sapiens
ggcgcgccagtccttctccccgactctaactccacagccctggcgactagtgcacaaactcccacggtgagaaaaacaattgttaccctaaacactccgcctcccaccacaggcgacagactttttgatcttgtgcagggggccttcctaaccttaaatgctaccaacccaggggccactgagtcttgcgactcggaccgatg

SEQ ID NO: 5721 - DNA, 203 bp, Homo sapiens
ggcgcgccagtcctctggctttgtttggccatgggccccccttattatgaagcaatagcctcatcaggagaggtcgcctactccaccgaccttgaccggtgccgctgggggacccaaggaaagctcaccctcactgaggtctcaggacacgggttgtgcataggaaaggtgccctttacccatcagcacgactcggaccgatg

SEQ ID NO: 5722 - DNA, 203 bp, Homo sapiens
ggcgcgccagtcctgttgctcatcctcgggccatgcatcatcaataagttagttcaattcatcaatgataggataagtgcagttaaaattctggtccttagacagaaatatcaggccctagagaacgaaggtaacctttaattttgctctaagattagagctattcacaagagaaatgggggaatgaacgactcggaccgatg

SEQ ID NO: 5723 - DNA, 203 bp, Homo sapiens
ggcgcgccagtccttttgaaaggggtctcctagagagcttggccgtcgggccttacaccccgacttgctgagtttctctaggagagtccctttcccagccagaggtggctggtcaaacaataccaaacgtaactaaacatctaagataacatagccctatgcctggtctccaccagttgaaggcatctcgactcggaccgatg

SEQ ID NO: 5724 - DNA, 203 bp, Homo sapiens
ggcgcgccagtcctaacttagttcatttaaatctatttccaaatttgaaggtctttgaaaacagttattcatacttcagaggttctcttataatcaggttaagtgtttatgctagtacattcaacagaggccgtttgaatgggttctttccaaattccagtacagatgaaacttctgaaattgataatcgactcggaccgatg

SEQ ID NO: 5725 - DNA, 203 bp, Homo sapiens
ggcgcgccagtcctcaagatgatggccctttaggaaatgacaaaccaaattattttcttaactttaagtctatgaatgttgatatctttactgtcagtcacaccaaagtagacaatatttttggacgtgcttggtttgcccatgttcatgacttcactaatgatggcctatggagacagggattggaacgactcggaccgatg

SEQ ID NO: 5726 - DNA, 203 bp, Homo sapiens
ggcgcgccagtccttttccaaaggaagggcacggtgccctatcacttctgtttgcctactttactggtgaattaaacatccatgttctatttcttagtgataggggttttctcagagttggacatacatatgacactgagacaaacagaaccaattttttatcatccagtggcataattacagtaccacgactcggaccgatg

SEQ ID NO: 5727 - DNA, 203 bp, Homo sapiens
ggcgcgccagtcctgcaggagaacagatgacactatctgtcccctcttattccaacaagccattacggacagttagatcatccaatgctttaggttatttactgtgtaaaccattgctaactggtaccagctctggtagaatagagatattccttagcttgagatgtccaaatttcttctttcccttacgactcggaccgatg

SEQ ID NO: 5728 - DNA, 203 bp, Homo sapiens
ggcgcgccagtcctcttgattatgcttctgacattatagttaagtcaaaggaccagacaaaaatgaaaacacaagaattttatcagcgttacaatgattgtttgtctaaatttaaacccattatggcaatgtgctttagaagctgtcacaatagtattagtaacacagtctacagattattccaggaacgactcggaccgatg

SEQ ID NO: 5729 - DNA, 203 bp, Homo sapiens
ggcgcgccagtcctagtgaattcatggatggatatgataatcaggatatacatttgattgatgatttgggccaaacaaggaaggagagggacattgagatgttgtgtaattgtatatcatcagatcccgatatagtccctatggcccaccttgaggaaaaaggcaaattctacacaagcaaattagttcgactcggaccgatg

SEQ ID NO: 5730 - DNA, 203 bp, Homo sapiens
ggcgcgccagtcctatagccaccacaaataaacctgatttttccagtacagtcttattagattcaggtgctctgaggagaaggtttccatacattatgcatattagagctgctaaacattatagcaaatcaggcaaactaaatgtctcccaagctatgccacatatgtcaaccggcgagtgttgggaacgactcggaccgatg

SEQ ID NO: 5731 - DNA, 203 bp, Homo sapiens
ggcgcgccagtcctgtggaagttaaaatgggcccagctgtactgagtaaatcggacactagactagaagaaccagtggattgtttggtcaagaagtcagcatcaaaatatagggtcaataaatttcaggtcaacaatgagctatggcagggggttaaagcttgtgttaagtcaaagtttagagaaatacgactcggaccgatg

SEQ ID NO: 5732 - DNA, 203 bp, Homo sapiens
ggcgcgccagtcctcaagagaaattccacaacctcctaaaaggaaatcagattacaaccatttttaatacatgtctcaaggatgagttgaggaagctggataaaatcgcaaccggtaaaactcgatgtattgaggcttgtgaaatagactattgcattgtttacagaatgattatgatggagatatatcgactcggaccgatg

SEQ ID NO: 5733 - DNA, 203 bp, Homo sapiens
ggcgcgccagtccttgggcgggcaagtgcggcaacagctactttgactactaagataagaatttttgtaccagcaactaatagcccagaactgagatgggagttgactttgttcgctctcgatgtaatcagatcaccaagtgcagcagaatcaatgaagattggtgctgctttcactctgatatcaatcgactcggaccgatg

SEQ ID NO: 5734 - DNA, 203 bp, Homo sapiens
ggcgcgccagtcctgtactcagaaagacctggcgctttaatcaggagcctccttaacgacccagacatagaagctgtcatcatagatgtgggttccatgctcaacgggatccctgtgatggaaaggagaggggacaaagcacaagaggagatggaaggtttgatgaggattctgaagactgcacgtgacgactcggaccgatg

SEQ ID NO: 5735 - DNA, 203 bp, Homo sapiens
ggcgcgccagtcctaagcagcaagggaaagaccccgtttgtagatagcagagcctatggactgaggatcaccgatatgagcactcttgtgtcagccgtcattaccatcgaagcccaaatttggatcctgattgcaaaggcagtgactgctccagatacagccgaggaaagtgagaccagaagatgggccgactcggaccgatg

SEQ ID NO: 5736 - DNA, 203 bp, Homo sapiens
ggcgcgccagtccttgacataggaaattatgtcgaggaaacaggaatggccggcttctttgcgactatcagattcggtcttgaaacaagataccctgcacttgccctcaatgagttccagagtgatctcaataccatcaaagggctgatgctgctctacagagaaatagggcctcgagcgccatacatcgactcggaccgatg

SEQ ID NO: 5737 - DNA, 203 bp, Homo sapiens
ggcgcgccagtcctggtgctccttgaggaatctattcagacaaagtttgcaccaggtggttatccactcctgtggagctttgctatgggtgttgcaaccactatcgaccgatccatgggtgctctcaacatcaatcgtggttatcttgaacctatgtatttcagacttggacagaaatcagcaagacacgactcggaccgatg

SEQ ID NO: 5738 - DNA, 203 bp, Homo sapiens
ggcgcgccagtcctagatattgatgaggaagaagagcctatcgaacatagtggtaggcagtcagtgactttcaagagagaaatgagcatgtcatctctcgcagacagtgtcccaagcagttcagtgagtacatccggaggaacgagattgacaaattctctattgaatctcagatccagattagctgccgactcggaccgatg

SEQ ID NO: 5739 - DNA, 203 bp, Homo sapiens
ggcgcgccagtcctcattatattaagaaaaacttaggatccaagaccataaatctaggatcctttacaatctcagaccctggtgcaaggttatatatagagcccaattctcctaattaaacagtgtctcaggttgacaaatggacaagttggatctagtcaatgatggcctcgatattattgactttacgactcggaccgatg

SEQ ID NO: 5740 - DNA, 203 bp, Homo sapiens
ggcgcgccagtcctttcagaagaaccaaaaagaaatacaaaagacatacggacgatcaagcatccaacaaccaagtaccaaagacaggacaagagcatgggaggacttcttgcagagcaccagtggagaacatgaacaggctgaggggggaatgcctaagaatgatggaggtactgaaggaagaaatgcgactcggaccgatg

SEQ ID NO: 5741 - DNA, 203 bp, Homo sapiens
ggcgcgccagtccttggaggatctatccagtgttacttcctcagatggaactattggacaaagagtgtcaaacacccgagcttgggcagaagacccagatgacatacaactggacccaatggttacagacgttgtataccatgatcatggaggagaatgtaccggacatggaccttcttcaagccctgcgactcggaccgatg

SEQ ID NO: 5742 - DNA, 203 bp, Homo sapiens
ggcgcgccagtcctttccctttgtccccaagaatcaatcaaccccaactgaggagcctccagtcatcccggagtattactatggatctgggaggagaggagatctctcaaaatctcctcctagaggtaatgtcaatctggacagcatcaagatttacacttcggacgacgaggatgaaaatcagctggcgactcggaccgatg

SEQ ID NO: 5743 - DNA, 203 bp, Homo sapiens
ggcgcgccagtcctagtatgaggatgagtttgccaaaagctcaagtgaggttgtcattgacactactcctgaggacaatgattctatcaaccaggaggaagtagttggggacccgtctgatcagggtttagagcatcctttccctttggggaaattcccggagaaagaagaaactcctgatgtacgcacgactcggaccgatg

SEQ ID NO: 5744 - DNA, 203 bp, Homo sapiens
ggcgcgccagtcctattttgctaacactttcttaccccatgacactgataggttaaattatcatgcagaccatctcaatgattacgatttagagaccttgtgtgaggagtcagtattgatgggcatcgttaacgcaatcaaactcatcaacattgatatgaggttgaatcacattgaggaacagatgacgactcggaccgatg

SEQ ID NO: 5745 - DNA, 203 bp, Homo sapiens
ggcgcgccagtcctttgatagagtagcagtcagaccaagatcatatattagaggtacacatcataatggccagtgtcttaatctcaaccattcataaaccgtcagtgtttcccttataaactccattatgtagtttattaatatctagagctattctttattaagtaataaatctgtattagattattcgactcggaccgatg

SEQ ID NO: 5746 - DNA, 203 bp, Homo sapiens
ggcgcgccagtcctggatcttttagaagagctatgttctttgaaagtcactgtcagaagaacagctggggctacagagaaaattgtgttcgggtcctctggcccgcttcatcatctcttaccatggaagaagattctgactggcggatcaatattcaatgctgtcaaggtttgccgcaatgtggatcacgactcggaccgatg

SEQ ID NO: 5747 - DNA, 203 bp, Homo sapiens
ggcgcgccagtcctgatctatgacgatgtgttcattgacaacacagggaagatcctaaaggggtgaaataaaacattcacttggttattgtagattgataaattaaccagataaccactttaatcttcattctaaagaatgccacagtgtcagtaagttacacaggtacaatacataatctaaattcacgactcggaccgatg

SEQ ID NO: 5748 - DNA, 203 bp, Homo sapiens
ggcgcgccagtcctaagcaatggctacacaagaggtcaggctaaagtgtttgctctgtgggatcatagttctggttttgtcattagaagggctagggatactacattatgagaaacttagtaagatagggctggttaaaggtattacaagaaagtacaagattaagagtaaccctttgaccaaggatacgactcggaccgatg

SEQ ID NO: 5749 - DNA, 203 bp, Homo sapiens
ggcgcgccagtcctttgtgatcaaaatgatccctaatgtctcgaatgtctcaaagtgcaccgggactgttatggagaattacaaaagcagactcacagggattctctcaccaatcaaaggcgccatcgaactgtacaataataacacgcatgacctagttggtgatgtcaagcttgcaggtgtggtgacgactcggaccgatg

SEQ ID NO: 5750 - DNA, 203 bp, Homo sapiens
ggcgcgccagtccttggcagggattgcaatcgggatagctactgctgcacaaatcacagcaggtgttgccttatatgaggcaatgaagaacgcagacaatatcaataaactcaagagcagcatagagtctacaaatgaggctgttgtcaaattacaggaaacagctgagaaaacagtctacgtccttacgactcggaccgatg

SEQ ID NO: 5751 - DNA, 203 bp, Homo sapiens
ggcgcgccagtcctctgctcttcaagattacatcaacactaaccttgttcctacaatagatcaaattagctgcaagcaaacagagctcgcattagacttggcgttgtctaagtatctgtctgatctgctctttgttttcggacctaacttacaggatccagtctctaattccatgactatccaagcaacgactcggaccgatg

SEQ ID NO: 5752 - DNA, 203 bp, Homo sapiens
ggcgcgccagtcctaacaggcttatgtgcaggagttgcttccagtgagttttaataacgataattcagaatggatcagcattgtcccgaatttcgtgctgattaggaacacgctgatttcaaatatagaagtcaagtactgcttaatcaccaagaaaagtgtgatttgtaatcaggactatgctacaccgactcggaccgatg

SEQ ID NO: 5753 - DNA, 203 bp, Homo sapiens
ggcgcgccagtcctagataggccccaaagtctcactaattgacacatccagcaccatcacaattcctgctaacatagggttactgggatccaagataagtcagtctaccagcagtattaatgagaatgttaacgataaatgcaaatttactcttcctcctttaaagattcatgagtgtaatatctcttcgactcggaccgatg

SEQ ID NO: 5754 - DNA, 203 bp, Homo sapiens
ggcgcgccagtcctctataactaaagttgaaagagggaagtacgataaggtgatgccttacggtccatcaggtatcaagcaaggggatacattgtactttccggccgtcggttttttgccaaggaccgaatttcaatataatgactctaattgtcccataattcattgcaagtacagcaaagcagaaacgactcggaccgatg

SEQ ID NO: 5755 - DNA, 203 bp, Homo sapiens
ggcgcgccagtcctttttctaccaggcatcatattcttgggatacgatgattaaattaggcgatgttgataccgttgaccctctaagagtacagtggagaaataacagtgtgatttctagacctggacagtcacagtgtcctcgatttaatgtctgtcccgaggtatgctgggaagggacatataatgcgactcggaccgatg

SEQ ID NO: 5756 - DNA, 203 bp, Homo sapiens
ggcgcgccagtcctcttataatatactcaaaaaattaaaaattcccccaagaaaatactaaatgtaatcaaactcaataaaccctgaaatattgatagtttacagagatcatatgactctttgtataattctttatagaactcctaaatatcaaagagcgataaacttgctaccctgtacacttaaagcgactcggaccgatg

SEQ ID NO: 5757 - DNA, 203 bp, Homo sapiens
ggcgcgccagtcctttttaggtatttatgagcaggacagactcagtaacatagggaaatacatgagtcaatcgcaatggtatgagtgttttctcttctggttcacaatcaagacagagatgagagctgttatcaagaactcacagaaacctaagtttagatctgactcttgtattattcatatgaaagcgactcggaccgatg

SEQ ID NO: 5758 - DNA, 203 bp, Homo sapiens
ggcgcgccagtcctttagagagcatatgctagcagataaggtccttgaatacgggccaatcatgaaagcacacgcagtcttttgtggtacaattataaatgggtaccgtgacaggcatcggggagcttggcctccactttatctgccatcgcatgcatcgaaacacataataagactcaagaattctgcgactcggaccgatg

SEQ ID NO: 5759 - DNA, 203 bp, Homo sapiens
ggcgcgccagtcctatcgccacaagtgtgataacactagccaaacattccttgactatcatatggaattcagtccctacaagtcagacagaatggataggacagagacatctgatttctcgaaatatgatgatggaacaggaacaaaatttgacacggtgagtgctttcctaactactgacttgaagacgactcggaccgatg

SEQ ID NO: 5760 - DNA, 203 bp, Homo sapiens
ggcgcgccagtcctaattctgtctcaattggcgatatgaatccatggctatttttgcagaaagacttgacgaaatttatggcttacccggtttctttaactggatgcacaaacgattagagaagtcagtcatttatgtcgcagatcctaattgcccaccagacatcgggaaacatataaaccttgatgcgactcggaccgatg

SEQ ID NO: 5761 - DNA, 203 bp, Homo sapiens
ggcgcgccagtcctaggtccaccctaatttaccttacaaagtcaagaaagaaatttgtgcaaggcaagctcaattatattttgacaggctcagaatgaatcttagggccttaggactcaacttaaaagcaacagagaccattataagtacacacttatttgtctactctaagaaaatacattatgatgcgactcggaccgatg

SEQ ID NO: 5762 - DNA, 203 bp, Homo sapiens
ggcgcgccagtcctgagaggaaattgctggattacttgacacaacaaaggggctaataagatcaggattgaaaaagagcgggatacaacctaagttagtgtctagactgtctaaccatgattataatcagttcctgatactcaatagacttttgtccaataaaaagagaaacgatcttatatcccctacgactcggaccgatg

SEQ ID NO: 5763 - DNA, 203 bp, Homo sapiens
ggcgcgccagtcctgttggtttttcgtgccacgagattcacaattagaccaagtgaataaagagcactcatccattagagtaccttacgtcggctcaagcactgatgagaggtcagatatcaaactaggaaacgtcaagagaccgacaagagcactgagatctgccatcgaattgcaactgtttataccgactcggaccgatg

SEQ ID NO: 5764 - DNA, 203 bp, Homo sapiens
ggcgcgccagtccttggatcctgagctttttgccctttatttaggtcaatcaatttcagtcaagtgggcatttgaaatccatcatagacgcccacatggacgacatacaatggtagatttgttgtctgatctcatatccaatacatcgaaacatacatacaaagtcttgtctaatgcactgtcacatccgactcggaccgatg

SEQ ID NO: 5765 - DNA, 203 bp, Homo sapiens
ggcgcgccagtccttactagatattagaggttgcataatatataatctagaagaaatcttatcaatgaatactaagtccacgtcaagaaaggtgttcaatttgggttcaaagttgtcagttgaaaaccacaaatatagaaggataggattaaattcgtcttcttgctacaaggcattaaatctgtcaccgactcggaccgatg

SEQ ID NO: 5766 - DNA, 203 bp, Homo sapiens
ggcgcgccagtcctctaaaagcccggaactttataacatcaaaaattacataaggagaaaagttttgattctagacttcagatcccatactatgattaaactgctacctaaaggaatgaaagagagaagagagaaaagcggattcaaagaaatttggatatttgacttatctaatagggaagtcaaaacgactcggaccgatg

SEQ ID NO: 5767 - DNA, 203 bp, Homo sapiens
ggcgcgccagtccttcaccctctttcccggtggtctggtcccggaccaccgttactccattcagcttcttcggaacctgttcggaggaattaaacgggcacccatactccccccacccccctttggtaactaagtatgtgtgctcgtgatcttggctcccacggaggggaccgatccgttggtgaacacgactcggaccgatg

SEQ ID NO: 5768 - DNA, 203 bp, Homo sapiens
ggcgcgccagtcctaacagctaggtccacatcctcccttcccctgggagggcccccgccctcccacatcctccccccagcctgacgtatcacaggctgtgtgaagcccccgcgaaagctgctcacgtggcaattgtgggtccccccttcatcaagacaccaggtctttcctccttaaggctagccccgcgactcggaccgatg

SEQ ID NO: 5769 - DNA, 203 bp, Homo sapiens
ggcgcgccagtcctgcgtgtgaattcacgttgggcaactagtggtgtcactgtgcgctcccaatctcggccgcggagtgctgttccccaagccaaacccctggcccttcactatgtgcctggcaagcatatctgagaaggtgttccgctgtggctgccaacctggtaacaggtgccccagtgtgcgtacgactcggaccgatg

SEQ ID NO: 5770 - DNA, 203 bp, Homo sapiens
ggcgcgccagtcctaccttcttccgtctccggacggtagtgattggttaagatttggtgtaaggttcatgtgccaacgccctgtgcgggatgaaacctctactgccctaggaatgccaggcaggtaccccacctccgggtgggatctgagcctgggctaattgtctacgggtagtttcatttccaatccgactcggaccgatg

SEQ ID NO: 5771 - DNA, 203 bp, Homo sapiens
ggcgcgccagtcctcttttatgtcggagtcatggctgcaacacgggtttcacgatctgtgctcgctgctgtggctcactctgccgctcaccgcacctaccacactgtccttgactgctatgataggctttacctcaacaccaacccccatctctcttatccccttcccaaaaactcttccttcccttgcgactcggaccgatg

SEQ ID NO: 5772 - DNA, 203 bp, Homo sapiens
ggcgcgccagtcctaacatactactctgaccttcagcaaaagttctttgacaaattggctctcctctctcttccaggtgcctaccaagcaaagaccccggaggagcgtgccctcgcgggcgcgctcacccaactcctcaacttcccctccaccccccctctcacactccctaccactaacctccaacgcgactcggaccgatg

SEQ ID NO: 5773 - DNA, 203 bp, Homo sapiens
ggcgcgccagtcctccgcacctggttgttggatacagtcacctggtcccaggagttcacccgcggctggaacatcgcaggctccaatggcatgcaatggaccggcctggaatcccttatcttccctgtctccactgacaccaattggacctccacctccagtcctaccgcatatcccctccctttctccgactcggaccgatg

SEQ ID NO: 5774 - DNA, 203 bp, Homo sapiens
ggcgcgccagtcctcttcgtgcgtgcttacccagactcctcctgggctgccatgtacaacacccactccatgtggaattgcggttggcgcgttcaagtgaccgtcaacggctcacagttccatgccggagcccttatcctctacatggtccctgaagccaccacccatgccatccaaacggctcgggacgactcggaccgatg

SEQ ID NO: 5775 - DNA, 203 bp, Homo sapiens
ggcgcgccagtcctcaacgctggctttgtcttcccctatgtcatcctcaatctctatgaaagcaacaccgctaccatagaggtcccctacatctcccccacccccaatacctcgagtggactccacgccccgtggacgttctacctccaggtgctctcacccctcaatcctcccccttctctccccaccgactcggaccgatg

SEQ ID NO: 5776 - DNA, 203 bp, Homo sapiens
ggcgcgccagtcctttccttatcctgctctatctatgtcacccccgttgactcctctttccacggtctccgctacctcgccccacagcactggaagactcgcgccgtcccaggtgcgggcactttcggatctgccgtggctggccaggaactccctctctgtggagtccgtgcctactacccccccaacgactcggaccgatg

SEQ ID NO: 5777 - DNA, 203 bp, Homo sapiens
ggcgcgccagtccttgcctacatccctgcccaggtacgcgactggcttgagttcgcccaccggcctggtctcatggccacagtgccgtggaccatggcggacgagccggccgagcgcctcggtatcttccccgtctctcccagtgctatcgctgggactggcgcccccatctcctatgttatttctctcgactcggaccgatg

SEQ ID NO: 5778 - DNA, 203 bp, Homo sapiens
ggcgcgccagtcctcttctcccagtggcgcggtgaactcgccgcccacctcctcttcactggctccgctcagcactacggccgcctggtcgtgtgctacactcctgctgccccccaacccccctccaccatgcaggaagcgatgcgcggaacatacaccgtatgggacgtcaacgctgcctcaaccctcgactcggaccgatg

SEQ ID NO: 5779 - DNA, 203 bp, Homo sapiens
ggcgcgccagtcctatccttcaacgtacgactgatgcaaaaccccgccctcacttcccaaaccctcaccgaagacctcgatgcaccccaagacaccgggaacattgagaacggtgcggctgacaactccccgcagccccgcaccaccttcgactacaccggaaaccccctccctccagacaccaaactcgactcggaccgatg

SEQ ID NO: 5780 - DNA, 203 bp, Homo sapiens
ggcgcgccagtcctggacctgcgaatcacgctccgcttctccaacccaaatgacaaccctgccaccatgcttgttgccttcgctccccctggcgccaccatccccctcaaacccacgcgccaaatgctctccaacttctacatggcggaggtcccagtctccgctgccacctccaccatggtctctttcgactcggaccgatg

SEQ ID NO: 5781 - DNA, 203 bp, Homo sapiens
ggcgcgccagtcctctccatcccctacacctcccccctctctgccatccccacctcatacttcggatgggaggactggtcaggtaccaactttggccagctctcctccgggtcatggggaaacctcatgctcatcccctctctctctgtcgactctgctatccccttcgacttccagctctcttgctgcgactcggaccgatg

SEQ ID NO: 5782 - DNA, 203 bp, Homo sapiens
ggcgcgccagtcctccccacctacgtccactgggccatccgcaaggtggcccccgacggcagtgccaaacagatctcgctgtcccgcagcgggatccaggcactggtcgccctcgaaccccccgagggtgaaccttacctcgaaattctcccctcccattggacccttgctgaactccaacttggcaacgactcggaccgatg

SEQ ID NO: 5783 - DNA, 203 bp, Homo sapiens
ggcgcgccagtcctcaagtgggagtacagcgccaccaacaactgtacccacttcgtcagctccatcactggcgaatccctccccaacaccggcttctccctggccctcggaatcggtgccctcaccgccatcgcagcctcggctgctgttgccgtgaaagcgctcccaggcatcaggcgacagggtctcgactcggaccgatg

SEQ ID NO: 5784 - DNA, 203 bp, Homo sapiens
ggcgcgccagtcctcattgatcacatcactaaatccatctcccgctgccgtgaattggtctccatcgcccaggaggccaaatccggccctcactcttccttcctcaaccaagcagtcaaaaactacacccttgccatctcccaacaccgcaaatgccagacaggtcccaggcctgaacccgtggtggtcgactcggaccgatg

SEQ ID NO: 5785 - DNA, 203 bp, Homo sapiens
ggcgcgccagtcctctacctctacggaccccccggcactggcaaatccctccttgcttcactcctcgctcaaaccctttcccagcgtcttgctgggacccccgatgacgtctactccccctcctccgcctcctgtgagtacttcgatgggtacacgggtcaaaccgtgcactttatcgatgacatcggcgactcggaccgatg

SEQ ID NO: 5786 - DNA, 203 bp, Homo sapiens
ggcgcgccagtcctgcaggatccggaggggcgggactgggctaatttcccaaacctcgtctcctctgcccccttcattgtcccaatggcctccctcgaggagaagggcacccactacacctccaaggtcatcgtggttacctccaacttccacgagcctaacgagcgcgccgcgcgctcgatgggcgccgactcggaccgatg

SEQ ID NO: 5787 - DNA, 203 bp, Homo sapiens
ggcgcgccagtcctggcgcaccaccgccctgtaccatgctcccttggcctctcccaagccatcgcaaacaacacccccatccaacaaatctctgaaaccttctggaagtaccgcaaacccatcttcacttgcaccactttcctcgctgtcctcggtttcctctgctctgtcatccctcttgctcgctccgactcggaccgatg

SEQ ID NO: 5788 - DNA, 203 bp, Homo sapiens
ggcgcgccagtccttcccacctcccgccagtacaaggacatgcggcgcttcatcggcgcccatccccaccccactggactccttgtttcccaattcaaagctgcccccctctatgtccgcatctccgacaaccggatcctggaccttgacttccccggagtcgtcgtctgtaagcaggcgtacggatacgactcggaccgatg

SEQ ID NO: 5789 - DNA, 203 bp, Homo sapiens
ggcgcgccagtcctcattgttcccactgctgaagtccggcctggcgtcaacgtcaaccggatgtcccgcttgcacccctctcccgcctacggtgccttccctgtcaagaaacaacccgctcccctcaagcgcaacgacaagcgcctgcaggagggcgtcgatcttgacacccagctcttcctcaaacacgactcggaccgatg

SEQ ID NO: 5790 - DNA, 203 bp, Homo sapiens
ggcgcgccagtcctcgtcgaagctgctcccatccatgctatcgtcgctggccggatgctcctcggtggtctcatcgactacatgcaggggcgtcccggcgagcacggtagtgcggttggttgcaacccagacgttcactggacttccttcttttacgccttcagcgagttctctcaggtatacgatctcgactcggaccgatg

SEQ ID NO: 5791 - DNA, 203 bp, Homo sapiens
ggcgcgccagtcctggactacaagtgttttgatgctacccttccttctgctgtcttcacccttgttgctgaccatcttacccgcatcaccggagatccccgcgtcggtcgctacatccactccatccgccattcacaccacatttatggcaaccggatgtacgacatgatcggggggaatccctccggcgactcggaccgatg

SEQ ID NO: 5792 - DNA, 203 bp, Homo sapiens
ggcgcgccagtcctttgtgtggccacctccatcctcaacaccatcatcaacaacatctgtgtcctctctgccctcatccaacaccctgatttctctccctcccgcttccacatcctggcgtacggtgacgacgtcatctacgctacggaaccccccatccatccttccttccttcgggagttctaccacgactcggaccgatg

SEQ ID NO: 5793 - DNA, 203 bp, Homo sapiens
ggcgcgccagtcctgaaacacacccctctggtggtcacccccgcaaacaaaggccaggatttcccacccacgtctacgatctatgaagtcaccttcctcaaacgctggttcgttccggacgatgttagacccatctacattcaccctgtgatggaccccgacacgtacgagcaatcggtaatgtggttcgactcggaccgatg

SEQ ID NO: 5794 - DNA, 203 bp, Homo sapiens
ggcgcgccagtcctggctgcctgatagttagggaacacagtgcctcggcacgcttagttagttagaaccctttgcccactcctccatggtgatataaagaccacccacttccttcgggtgagcccctaagccatggttgtactgcactatcatcctaagacggtccttcttcggatcgcaatctcacccgactcggaccgatg

SEQ ID NO: 5795 - DNA, 203 bp, Homo sapiens
ggcgcgccagtcctggtgatataaagaccacccacttccttcgggtgagcccctaagccatggttgtactgcactatcatcctaagacggtccttcttcggatcgcaatctcaccctggtgccgcgcttccttcgggaactgcacccgcggaccagggccgtctttgaacttttctaactgttcttaccgactcggaccgatg

SEQ ID NO: 5796 - DNA, 203 bp, Homo sapiens
ggcgcgccagtccttctttgctgagacttgaccgccccgggtacccgtgtacgaataaacctcttgctgattgcatctgactcgtggtctcggtgttctgtgggcgcggggtctcatcgccgaggaagacctagttcaggggtctttcatttgggggctcgtccgggatcgagacccccgacccccggcgactcggaccgatg

SEQ ID NO: 5797 - DNA, 203 bp, Homo sapiens
ggcgcgccagtcctgaccaccgacccaccatcaggaggtaagctggccggcgaccatacctgttgtccttgtataagtgtctctgtcaattgatctgattttggcggtgggatcgaaggagctgacgagctcgtacttcgcccccgcaaccctggaagacgttccacgggtgtctgatgtctggagcccgactcggaccgatg

SEQ ID NO: 5798 - DNA, 203 bp, Homo sapiens
ggcgcgccagtcctggccaggaccccccccctgagcccaggataaccttaaaaataggggggcaaccggtgactttcctggtggacacgggagcccagcactcagtactaactcgaccagatggacctctcagtgaccgcacagccctggtgcaaggagccacgggaagcaaaaactaccggtggacccgactcggaccgatg

SEQ ID NO: 5799 - DNA, 203 bp, Homo sapiens
ggcgcgccagtcctccagaaataggactgtcagggcagctaacctggacacgccttcctcaagggttcaagaatagccccaccctatttgatgaggccctgcactcagacctggccgatttcagggtaaggtacccggctctagtcctcctacaatatgtagatgacctcttgctggctgcggcaacccgactcggaccgatg

SEQ ID NO: 5800 - DNA, 203 bp, Homo sapiens
ggcgcgccagtcctaggactgaatgcctggaagggactaaggcactccttgagactttgggcaataaggggtaccgagcctctgcaaagaaggcccaaatttgcctgcaagaagtcacatacctggggtactctttaaaagatggccaaaggtggcttaccaaagctcgcaaggaagccatcctatcccgactcggaccgatg

SEQ ID NO: 5801 - DNA, 203 bp, Homo sapiens
ggcgcgccagtcctcccccttgtttacgcatggttgcagccatcgccatcctagtcaaggatgcagggaagctaaccctaggacagccgctaactatcctgacctcccacccagttgaggcacttgtccgacagcctccaaataaatggctctctaatgctagaatgactcattaccaagctatgctccgactcggaccgatg

SEQ ID NO: 5802 - DNA, 203 bp, Homo sapiens
ggcgcgccagtcctctcgatgcagagcgagtccatttcgggccgacagtctcccttaaccctgctaccttgctccccctccccagcgggggaaaccaccacgactgtctccagattttagccgagacccatggcaccagacccgacttaactgaccagccgttgccggatgcagacctgacctggtaccgactcggaccgatg

SEQ ID NO: 5803 - DNA, 203 bp, Homo sapiens
ggcgcgccagtcctgaagctcattatgagccaaagagaggtacctgggagtaccgaggaaaaactatcatgcctgaaaaatacgcaaaagagttgattagccatctgcataagttaacacacctcagtgctaggaaaatgaaaactttactagaaagagaagaaactgggttttacctccctaacagacgactcggaccgatg

SEQ ID NO: 5804 - DNA, 203 bp, Homo sapiens
ggcgcgccagtcctgacttacacctccggcaagtaacagagagctgccgggcatgtgctcaaatcaacgccggaaagataaagtttggacctgatgtaagggcccgaggccgccggcccggaacacattgggaagtagacttcactgaaatcaagccaggaatgtatggatataaatacctcttggtgcgactcggaccgatg

SEQ ID NO: 5805 - DNA, 203 bp, Homo sapiens
ggcgcgccagtcctccaatgtaaaacacggggcacgttactcctcctcaaagtatggatgtaaaactacagatagaaaaaaacagcaacaaacataccccttttacgtctgccccggacatgccccctcgctggggccaaagggaacacattgtggaggggcacaagatgggttttgtgccgcatgggcgactcggaccgatg

SEQ ID NO: 5806 - DNA, 203 bp, Homo sapiens
ggcgcgccagtcctctgaaagcgccccaaggtctgttgcccccaccaccgtgggtcccaaacggattgggaccggagataggttaataaatttagtacaagggacatacctagccttaaatgccaccgaccccaacaaaactaaagactgttggctctgcctggtttctcgaccaccctattacgaagcgactcggaccgatg

SEQ ID NO: 5807 - DNA, 203 bp, Homo sapiens
ggcgcgccagtcctggattgcaatcttaggtaactacagcaaccaaacaaacccccccccatcctgcctatctactccgcaacacaaactgaccatatctgaagtatcagggcaaggactgtgcatagggactgttcctaagacccaccaggctttgtgcaatgagacacaacagggacatacaggggcgactcggaccgatg

SEQ ID NO: 5808 - DNA, 203 bp, Homo sapiens
ggcgcgccagtcctcgcactatctagccgcccccaatggcgcctattgggcctgtaacactggactcaccccatgcatttccatggcggtgctcaattggacctctgatttttgtgtcttaatcgaattatggcccagagtgacttaccatcaacccgaatatgtgtacacacattttgccaaagctgcgactcggaccgatg

SEQ ID NO: 5809 - DNA, 203 bp, Homo sapiens
ggcgcgccagtcctttagtgccttagaaaagtccctgacctccctttctgaagtagtcttacaaaacagacggggcctagatattctattcttacaagagggagggctctgtgccgcattaaaagaagaatgttgcttctatgcggatcacaccggactcgtccgagacaatatggctaaattgagagcgactcggaccgatg

SEQ ID NO: 5810 - DNA, 203 bp, Homo sapiens
ggcgcgccagtcctaaagactaaaacagcggcaacaactgtttgactcccaacagggatggtttgaaggatggttcaacaagtccccctggttcacaaccttaatttcctccattatgggccccttactaatcctactcctaattctcctcttcggcccatgcatccttaacagattagtacaattcgcgactcggaccgatg

SEQ ID NO: 5811 - DNA, 203 bp, Homo sapiens
ggcgcgccagtcctgtggtgccatttcacaaggcatggaaaattactcaagtatgttcccatgagatacaaggaagttagaggctaaaacaggatatctgtggttaagcacctgggccccggcttgaggccaagaacagttaaaccccggatatagctgaaacagcagaagtttcaaggccgctaccacgactcggaccgatg

SEQ ID NO: 5812 - DNA, 203 bp, Homo sapiens
ggcgcgccagtcctgctataaaacgagccatcagcccccaacgggcgcgcaagtctttgctgagacttgaccgccccgggtacccgtgtacgaataaacctcttgctgattgcatctgactcgtggtctcggtgttctgtgggcgcggggtctcatcgccgaggaagacctagttcaggggtctttcacgactcggaccgatg

SEQ ID NO: 5813 - DNA, 203 bp, Homo sapiens
ggcgcgccagtccttgatgaacacgctgagtggtttgatgccggtggcttaggtccaagtacactacccactagtcatgaacggtacacacatgagaatgatgaaggccaccaggtaaagtggtcggctagggaaggtgtagaccttggcatatccgggctcacgacggtgtctgggcctgagtggaacgactcggaccgatg

SEQ ID NO: 5814 - DNA, 203 bp, Homo sapiens
ggcgcgccagtcctgcaaaggaagctcatctcctctggccggttttaccacccgacccaagattggtcccgagacactccagaattccaacaagacagcaagttagagatggttagggatgcagtgctagccgctataaatgggttggtgtcgcggccatttaaagatcttctgggtaagctcaaacccgactcggaccgatg

SEQ ID NO: 5815 - DNA, 203 bp, Homo sapiens
ggcgcgccagtcctcgtagtatcctctaccaatgctctcatatcccggatctcaatggctagggctgcattggccaaggctcaagctgaaatgaccagcaggatgcgtcctgtggtcattatgatgtgtgggccccctggtataggtaaaaccaaggcagcagaacatctggctaaacgcctagccaacgactcggaccgatg

SEQ ID NO: 5816 - DNA, 203 bp, Homo sapiens
ggcgcgccagtccttgagatacggcctggtggtaaggttgggctggtcccacgggaggcagtggatcattgggatggatatcacggagaggaagtgatgctgtgggacgactatggaatgacaaagatacaggaagactgtaataaactgcaagccatagccgactcagcccccctaacactcaattgcgactcggaccgatg

SEQ ID NO: 5817 - DNA, 203 bp, Homo sapiens
ggcgcgccagtccttgaccgaatagaaaacaagggaatgcaatttgtgtctgatgctatagtcatcaccaccaatgctcctggcccagccccagtggactttgtcaacctcgggcctgtttgccgaagggtggacttccttgtgtattgcacggcacctgaagttgaacacacgaggaaagtcagtcccgactcggaccgatg

SEQ ID NO: 5818 - DNA, 203 bp, Homo sapiens
ggcgcgccagtccttggggacacaactgcactgaaagactgcttcaagcccgatttctcacatctaaaaatggagttggctccccaagggggctttgataaccaagggaataccccgtttggtaagggtgtgatgaagcccaccaccataaacaggctgttaatccaggctgtagccttgacgatggacgactcggaccgatg

SEQ ID NO: 5819 - DNA, 203 bp, Homo sapiens
ggcgcgccagtcctcgcttcatgtttccagtccgccataactaccatactacaaatggcgggatctgcgctcgttattaatcgagcggtcaagcgtatgtttggtacccgtacagcagccatggcattagaaggacctgggaaagaacataattgcagggtccataaggctaaggaagctggaaagggcgactcggaccgatg

SEQ ID NO: 5820 - DNA, 203 bp, Homo sapiens
ggcgcgccagtcctggtcttctataaatccaagagtaagaaacaccaacaagagcaacggcgacaacttggtctagtgactggatcagacatcagaaaacgtaagcccattgactggaccccgccaaagaatgaatgggcagatgatgacagagaggtggattataatgaaaagatcaattttgaagccgactcggaccgatg

SEQ ID NO: 5821 - DNA, 203 bp, Homo sapiens
ggcgcgccagtccttcccccgacactatggagccgagtcacaaagtttggatcaggatggggcttttgggtcagcccgacagtgttcatcacaaccacacatgtagtgccaactggtgtgaaagaattctttggtgagcccctatctagtatagcaatccaccaagcaggtgagttcacacaattcagcgactcggaccgatg

SEQ ID NO: 5822 - DNA, 203 bp, Homo sapiens
ggcgcgccagtcctgttctcaaagaaaatgcgccctgacttgacaggtatggtccttgaagaaggttgccctgaagggacagtctgctcagtcctaattaaacgggattcgggtgaactacttccgctagccgtccgtatgggggctattgcctccatgaggatacagggtcggcttgtccatggccacgactcggaccgatg

SEQ ID NO: 5823 - DNA, 203 bp, Homo sapiens
ggcgcgccagtcctgggcgaaaccgcactagaaggtggagacaaggggcattatgccggccacgagattgtgaggtatggaagtggcccagcactgtcaactaaaacaaaattctggaggtcctccccagaaccactgccccccggagtatatgagccagcatacctggggggcaaggacccccgtgtcgactcggaccgatg

SEQ ID NO: 5824 - DNA, 203 bp, Homo sapiens
ggcgcgccagtcctatctcttgacaaaactactagttcggggtaccctcaccataaaaggaagaatgatgattggaatggcaccaccttcgttggagagctcggtgagcaagctgcacacgccaacaatatgtatgagaatgctaaacatatgaaacccatttacactgcagccttaaaagatgaactcgactcggaccgatg

SEQ ID NO: 5825 - DNA, 203 bp, Homo sapiens
ggcgcgccagtcctagtcaagccagaaaagatttatcaaaaagtcaagaagcgtctactatggggcgccgatctcggaacagtggtcagggccgcccgggcttttggcccattttgtgacgctataaaatcacatgtcatcaaattgccaataaaagttggcatgaacacaatagaagatggccccctcgactcggaccgatg

SEQ ID NO: 5826 - DNA, 203 bp, Homo sapiens
ggcgcgccagtcctcatctatgctgagcatgctaaatataagaatcattttgatgcagattatacagcatgggactcaacacaaaatagacaaattatgacagaatccttctccattatgtcgcgccttacggcctcaccagaattggccgaggttgtggcccaagatttgctagcaccatctgagatcgactcggaccgatg

SEQ ID NO: 5827 - DNA, 203 bp, Homo sapiens
ggcgcgccagtcctggatgtaggtgattatgtcatcagggtcaaagaggggctgccatctggattcccatgtacttcccaggtgaacagcataaatcactggataattactctctgtgcactgtctgaggccactggtttatcacctgatgtggtgcaatccatgtcatatttctcattttatggtgacgactcggaccgatg

SEQ ID NO: 5828 - DNA, 203 bp, Homo sapiens
ggcgcgccagtcctgttccaaggcaggttagatagggcttcgattgaacgccaaatcttctggacccgcgggcccaatcattcagatccatcagagactctagtgccacacactcaaagaaaaatacagttgatttcacttctaggggaagcttcactccatggtgagaaattttacagaaagatttccgactcggaccgatg

SEQ ID NO: 5829 - DNA, 203 bp, Homo sapiens
ggcgcgccagtcctgtgcccctctcccaatcagtagtatgggcatttccccagacaatgtccagagtgtgcagttccaaaatggtcggtgtactctggatggccgcctggttggcaccaccccagtttcattgtcacatgttgccaagataagagggacctccaatggcactgtaatcaaccttactgcgactcggaccgatg

SEQ ID NO: 5830 - DNA, 203 bp, Homo sapiens
ggcgcgccagtcctaattggatggcacaccctttcacccttttgagggccctgcccccattgggtttccagacctcggtggttgtgattggcatatcaatatgacacagtttggccattctagccagacccagtatgatgtagacaccacccctgacacttttgtcccccatcttggttcaattcaggcgactcggaccgatg

SEQ ID NO: 5831 - DNA, 203 bp, Homo sapiens
ggcgcgccagtcctcaaatggcattggcagtggtaattatgttggtgttcttagctggatttcccccccatcacacccgtctggctcccaagttgacctttggaagatccccaattatgggtcaagtattacggaggcaacacatctagccccttctgtatacccccctggtttcggagaggtattggcgactcggaccgatg

SEQ ID NO: 5832 - DNA, 203 bp, Homo sapiens
ggcgcgccagtcctcataattggtgcaattgctgcttccacagcaggtagtgctctgggagcgggcatacaggttggtggcgaagcggccctccaaagccaaaggtatcaacaaaatttgcaactgcaagaaaattcttttaaacatgacagggaaatgattgggtatcaggttgaagcttcaaatcacgactcggaccgatg

SEQ ID NO: 5833 - DNA, 203 bp, Homo sapiens
ggcgcgccagtcctattattggctaaaaatttggcaactagatattcactcctccgtgctgggggtttgaccagtgctgatgcagcaagatctgtggcaggagctccagtcacccgcattgtagattggaatggcgtgagagtgtctgctcccgagtcctctgctaccacattgagatccggtggcttcgactcggaccgatg

SEQ ID NO: 5834 - DNA, 203 bp, Homo sapiens
ggcgcgccagtcctgacaacaaccaacccactaatcagacatgagaacagaatggttttagccagcactacagctaaggctatggagcaaatggctggatcgagtgagcaagcagcagaggccatggaggttgctagtcaggctaggcaaatggtgcaagcgatgagaaccattgggactcatcctagcgactcggaccgatg

SEQ ID NO: 5835 - DNA, 203 bp, Homo sapiens
ggcgcgccagtcctctccagtgctggtctgaaaaatgatcttcttgaaaatttgcaggcctatcagaaacgaatgggggtgcagatgcaacggttcaagtgatcctctcgctattgccgcaaatatcattgggatcttgcacttgatattgtggattcttgatcgtctttttttcaaatgcatttacccgactcggaccgatg

SEQ ID NO: 5836 - DNA, 203 bp, Homo sapiens
ggcgcgccagtccttatgttatccaggagatttcatcgactatgaggagctgagggagcaattgagctcagtgtcatcattcgaaagattcgaaatatttcccaaagaaagctcatggcccaaccacaacacaaccaaaggagtaacggcagcatgctcccatgcggggaaaagcagtttttacagaacgactcggaccgatg

SEQ ID NO: 5837 - DNA, 203 bp, Homo sapiens
ggcgcgccagtcctattataacaggagatttaccccggaaatagcagaaagacccaaagtaagagatcaagctgggaggatgaactattactggaccttgctaaaacccggagacacaataatatttgaggcaaatggaaatctaatagcaccaaggtatgctttcgcactgagtagaggctttgggtcgactcggaccgatg

SEQ ID NO: 5838 - DNA, 203 bp, Homo sapiens
ggcgcgccagtcctatggggatctatcagattctggcgatctactcaactgtcgccagttcactggtgcttttggtctccctgggggcaatcagtttctggatgtgttctaatggatctttgcagtgcagaatatgcatctgagattagaatttcagaaatatgaggaaaaacacccttgtttctactcgactcggaccgatg

SEQ ID NO: 5839 - DNA, 203 bp, Homo sapiens
ggcgcgccagtcctctcacttggaatgcaggaccttttttctgacccaaggtgccttactgaatgacaggcattcaaatgggactgttaaggacagaagcccttatagggccttaatgagctgccctgtcggtgaagctccgtccccgtacaattcaagatttgaatcggttgcttggtcagcaagtgcgactcggaccgatg

SEQ ID NO: 5840 - DNA, 203 bp, Homo sapiens
ggcgcgccagtcctcatgtcatgatggcatgggctggctaacaatcggaatttcaggtccagataatggagcagtggctgtattaaaatacaacggcataataactgaaaccataaaaagttggaggaagaaaatattgaggacacaagagtctgaatgtgcctgtgtaaatggttcatgttttactacgactcggaccgatg

SEQ ID NO: 5841 - DNA, 203 bp, Homo sapiens
ggcgcgccagtccttagactgtataaggccgtgcttctgggttgaattaatcaggggacgacctaaagaaaaaacaatctggactagtgcgagcagcatttctttttgtggcgtgaatagtgatactgtagattggtcttggccagacggtgctgagttgccattcaccattgacaagtagtctgttccgactcggaccgatg

SEQ ID NO: 5842 - DNA, 203 bp, Homo sapiens
ggcgcgccagtcctgatcccaggatgtgctctctgatgcaaggttcaactctccctaggaggtctggagccgcaggtgctgcagtcaaaggagttggaacaatggtgatggaattggtcaggatgatcaaacgtgggatcaatgatcggaacttctggaggggtgagaatggacgaaaaacaagaattcgactcggaccgatg

SEQ ID NO: 5843 - DNA, 203 bp, Homo sapiens
ggcgcgccagtcctcattctgccgcatttgaagatctaagagtattgagcttcatcaaagggacgaaggtggtcccaagagggaagctttccactagaggagttcaaattgcttccaatgaaaatatggagactatggaatcaagtacacttgaactgagaagcaggtactgggccataaggaccagacgactcggaccgatg

SEQ ID NO: 5844 - DNA, 203 bp, Homo sapiens
ggcgcgccagtcctgcaaatgttgtaaggaagatgatgaccaattctcaggacaccgaactttctttgaccatcactggagataacaccaaatggaacgaaaatcagaatcctcggatgtttttggccatgatcacatatatgaccagaaatcagcccgaatggttcagaaatgttctaagtattgctcgactcggaccgatg

SEQ ID NO: 5845 - DNA, 203 bp, Homo sapiens
ggcgcgccagtccttcatttgaaataaagaaactgtgggagcaaacccgttccaaagctggactgctggtctccgacggaggcccaaatttatacaacattagaaatctccacattcctgaagtctgcctaaaatgggaattgatggatgaggattaccaggggcgtttatgcaacccactgaacccacgactcggaccgatg

SEQ ID NO: 5846 - DNA, 203 bp, Homo sapiens
ggcgcgccagtcctctgctgatggatgccttaaaattaagcattgaggacccaagtcatgaaggagagggaataccgctatatgatgcaatcaaatgcatgagaacattctttggatggaaggaacccaatgttgttaaaccacacgaaaagggaataaatccaaattatcttctgtcatggaagcaacgactcggaccgatg

SEQ ID NO: 5847 - DNA, 203 bp, Homo sapiens
ggcgcgccagtcctattaaaatgaaatggggaatggagatgaggcgttgtctcctccagtcacttcaacaaattgagagtatgattgaagctgagtcctctgtcaaagagaaagacatgaccaaagagttctttgagaacaaatcagaaacatggcccattggagagtctcccaaaggagtggaggaacgactcggaccgatg

SEQ ID NO: 5848 - DNA, 203 bp, Homo sapiens
ggcgcgccagtcctagttccattgggaaggtctgcaggactttattagcaaagtcggtatttaacagcttgtatgcatctccacaactagaaggattttcagctgaatcaagaaaactgcttcttatcgttcaggctcttagggacaatctggaacctgggacctttgatcttggggggctatatgaacgactcggaccgatg

SEQ ID NO: 5849 - DNA, 203 bp, Homo sapiens
ggcgcgccagtcctacaagcagtgtgtacattgaagtgttgcatttgactcaaggaacatgctgggaacagatgtatactccaggaggggaagtgaagaatgatgatgttgatcaaagcttgattattgctgctaggaacatagtgagaagagctgcagtatcagcagacccactagcatctttattgcgactcggaccgatg

SEQ ID NO: 5850 - DNA, 203 bp, Homo sapiens
ggcgcgccagtcctgagatgtgccacagcacacagattggtggaattaggatggtagacatccttaagcagaacccaacagaagagcaagccgtgggtatatgcaaggctgcaatgggactgagaattagctcatccttcagttttggtggattcacatttaagagaacaagcggatcatcagtcaagcgactcggaccgatg

SEQ ID NO: 5851 - DNA, 203 bp, Homo sapiens
ggcgcgccagtcctagagaggaagaggtgcttacgggcaatcttcaaacattgaagataagagtgcatgagggatatgaagagttcacaatggttgggagaagagcaacagccatactcagaaaagcaaccaggagattgattcagctgatagtgagtgggagagacgaacagtcgattgccgaagcacgactcggaccgatg

SEQ ID NO: 5852 - DNA, 203 bp, Homo sapiens
ggcgcgccagtccttctcccgaggaggtcagtgaaacacagggaacagagaaactgacaataacttactcatcgtcaatgatgtgggagattaatggtcctgaatcagtgttggtcaatacctatcaatggatcatcagaaactgggaaactgttaaaattcagtggtcccagaaccctacaatgctacgactcggaccgatg

SEQ ID NO: 5853 - DNA, 203 bp, Homo sapiens
ggcgcgccagtccttccgctgttctgaggggattcctcattctgggcaaagaagacaggagatatgggccagcattaagcatcaatgaactgagcaaccttgcgaaaggagagaaggctaatgtgctaattgggcaaggagacgtggtgttggtaatgaaacgaaaacgggactctagcatacttactcgactcggaccgatg

SEQ ID NO: 5854 - DNA, 203 bp, Homo sapiens
ggcgcgccagtcctcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtcgactcggaccgatg

SEQ ID NO: 5855 - DNA, 203 bp, Homo sapiens
ggcgcgccagtcctttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccgactcggaccgatg

SEQ ID NO: 5856 - DNA, 203 bp, Homo sapiens
ggcgcgccagtcctcctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctcgactcggaccgatg

SEQ ID NO: 5857 - DNA, 203 bp, Homo sapiens
ggcgcgccagtcctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagcgactcggaccgatg

SEQ ID NO: 5858 - DNA, 203 bp, Homo sapiens
ggcgcgccagtcctccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggcgactcggaccgatg

SEQ ID NO: 5859 - DNA, 203 bp, Homo sapiens
ggcgcgccagtccttctaggagttggggcggatcaaggatgcgccatcaactttggcaagagagagctcaagtgcggagatggtatcttcatatttagagactctgatgactggctgaacaagtactcatactatccagaagatcctgtgaagcttgcatcaatagtgaaagcctcttttgaagaaggcgactcggaccgatg

SEQ ID NO: 5860 - DNA, 203 bp, Homo sapiens
ggcgcgccagtcctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatcgactcggaccgatg

SEQ ID NO: 5861 - DNA, 203 bp, Homo sapiens
ggcgcgccagtcctgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagcgactcggaccgatg

SEQ ID NO: 5862 - DNA, 203 bp, Homo sapiens
ggcgcgccagtccttgatttgctgaaactcacagtggctgtgggattgcatttccatgagatgaacaatggaggagacgccatgtatatggcgttgattgctgccttttcaatcagaccagggctgctcatcggctttgggctcaggaccctatggagccctcgggaacgccttgtgctgaccctaggcgactcggaccgatg

SEQ ID NO: 5863 - DNA, 203 bp, Homo sapiens
ggcgcgccagtcctggaaccaactagggttgttaactgggaagtgatcattatggatgaagcccattttttggatccagctagcatagccgctagaggttgggcagcgcacagagctagggcaaatgaaagtgcaacaatcttgatgacagccacaccgcctgggactagtgatgaatttccacattccgactcggaccgatg

SEQ ID NO: 5864 - DNA, 203 bp, Homo sapiens
ggcgcgccagtcctgccacttcgtatctccgcatcctctgctgctcaaaggagggggcgcattgggagaaatcccaacagagatggagactcatactactattctgagcctacaagtgaaaataatgcccaccacgtctgctggttggaggcctcaatgctcttggacaacatggaggtgaggggtggcgactcggaccgatg

SEQ ID NO: 5865 - DNA, 203 bp, Homo sapiens
ggcgcgccagtcctaatggtcgccccactctatggcgttgaaggaactaaaacaccagtttcccctggtgaaatgagactgagggatgaccagaggaaagtcttcagagaactagtgaggaattgtgacctgcccgtttggctttcgtggcaagtggccaaggctggtttgaagacgaatgatcgtaacgactcggaccgatg

SEQ ID NO: 5866 - DNA, 203 bp, Homo sapiens
ggcgcgccagtcctgtggtgttttgaaggccctgaggaacatgagatcttgaatgacagcggtgaaacagtgaagtgcagggctcctggaggagcaaagaagcctctgcgcccaaggtggtgtgatgaaagggtgtcatctgaccagagtgcgctgtctgaatttattaagtttgctgaaggtaggagcgactcggaccgatg

SEQ ID NO: 5867 - DNA, 203 bp, Homo sapiens
ggcgcgccagtcctgggagctgctgaagtgctagttgtgctgagtgaactccctgatttcctggctaaaaaaggtggagaggcaatggataccatcagtgtgttcctccactctgaggaaggctctagggcttaccgcaatgcactatcaatgatgcctgaggcaatgacaatagtcatgctgtttatcgactcggaccgatg

SEQ ID NO: 5868 - DNA, 203 bp, Homo sapiens
ggcgcgccagtcctggttgtgatccccgagccagggcaacaaaggtccatccaagacaaccaagtggcatacctcattattggcatcctgacgctggtttcagcggtggcagccaacgagctaggcatgctggagaaaaccaaagaggacctctttgggaagaagaacttaattccatctagtgcttccgactcggaccgatg

SEQ ID NO: 5869 - DNA, 203 bp, Homo sapiens
ggcgcgccagtcctaccctggagttggccggatcttgacctgaagccaggagctgcctggacagtgtacgttggcattgttacaatgctctctccaatgttgcaccactggatcaaagtcgaatatggcaacctgtctctgtctggaatagcccagtcagcctcagtcctttctttcatggacaagggcgactcggaccgatg

SEQ ID NO: 5870 - DNA, 203 bp, Homo sapiens
ggcgcgccagtcctgataccattcatgaagatgaatatctcggtcataatgctgctggtcagtggctggaattcaataacagtgatgcctctgctctgtggcatagggtgcgccatgctccactggtctctcattttacctggaatcaaagcgcagcagtcaaagcttgcacagagaagggtgttccacgactcggaccgatg

SEQ ID NO: 5871 - DNA, 203 bp, Homo sapiens
ggcgcgccagtccttggcgttgccgagaaccctgtggttgatgggaatccaacagttgacattgaggaagctcctgaaatgcctgccctttatgagaagaaactggctctatatctccttcttgctctcagcctagcttctgttgccatgtgcagaacgcccttttcattggctgaaggcattgtcctcgactcggaccgatg

SEQ ID NO: 5872 - DNA, 203 bp, Homo sapiens
ggcgcgccagtccttttgggtgaagtctggaagagggaactgaatctgttggacaagcgacagtttgagttgtataaaaggaccgacattgtggaggtggatcgtgatacggcacgcaggcatttggccgaagggaaggtggacaccggggtggcggtctccagggggaccgcaaagttaaggtggttcgactcggaccgatg

SEQ ID NO: 5873 - DNA, 203 bp, Homo sapiens
ggcgcgccagtcctcatcaccttcaaggacaaaactgatatccaccgcctagaaccagtgaaatgtgacacccttttgtgtgacattggagagtcatcatcgtcatcggtcacagagggggaaaggaccgtgagagttcttgatactgtagaaaaatggctggcttgtggggttgacaacttctgtgtcgactcggaccgatg

SEQ ID NO: 5874 - DNA, 203 bp, Homo sapiens
ggcgcgccagtcctaagccgtgccatatggtatatgtggctgggagcgcggtatcttgagtttgaggccctgggattcctgaatgaggaccattgggcttccagggaaaactcaggaggaggagtggaaggcattggcttacaatacctaggatatgtgatcagagacctggctgcaatggatggtggcgactcggaccgatg

SEQ ID NO: 5875 - DNA, 203 bp, Homo sapiens
ggcgcgccagtccttggattctacgcggatgacaccgctggatgggacacgcgcatcacagaggcagaccttgatgatgaacaggagatcttgaactacatgagcccacatcacaaaaaactggcacaagcagtgatggaaatgacatacaagaacaaagtggtgaaagtgttgagaccagccccaggcgactcggaccgatg

SEQ ID NO: 5876 - DNA, 203 bp, Homo sapiens
ggcgcgccagtcctcaggctggaggcatggctcactgagcacggatgtgacagactgaagaggatggcggtgagtggagacgactgtgtggtccggcccatcgatgacaggttcggcctggccctgtcccatctcaacgccatgtccaaggttagaaaggacatatctgaatggcagccatcaaaaggcgactcggaccgatg

SEQ ID NO: 5877 - DNA, 203 bp, Homo sapiens
ggcgcgccagtcctgtggaatgattgggagaatgtgcccttctgttcccaccacttccatgaactacagctgaaggatggcaggaggattgtggtgccttgccgagaacaggacgagctcattgggagaggaagggtgtctccaggaaacggctggatgatcaaggaaacagcttgcctcagcaaagccgactcggaccgatg

SEQ ID NO: 5878 - DNA, 203 bp, Homo sapiens
ggcgcgccagtcctagtatggataaccaacaacccacacatgcaggacaagacaatggtgaaaaaatggagagatgtcccttatctaaccaagagacaagacaagctgtgcggatcactgattggaatgaccaatagggccacctgggcctcccacatccatttagtcatccatcgtatccgaacgctcgactcggaccgatg

SEQ ID NO: 5879 - DNA, 203 bp, Homo sapiens
ggcgcgccagtcctgattggacaggagaaatacactgactacctaacagtcatggacaggtattctgtggatgctgacctgcaactgggtgagcttatctgaaacaccatctaacaggaataaccgggatacaaaccacgggtggagaaccggactccccacaacctgaaaccgggatataaaccacgcgactcggaccgatg

SEQ ID NO: 5880 - DNA, 203 bp, Homo sapiens
ggcgcgccagtcctgctggagaaccgggctccgcacttaaaatgaaacagaaaccgggataaaaactacggatggagaaccggactccacacattgagacagaagaagttgtcagcccagaaccccacacgagttttgccactgctaagctgtgaggcagtgcaggctgggacagccgacctccaggtcgactcggaccgatg

SEQ ID NO: 5881 - DNA, 203 bp, Homo sapiens
ggcgcgccagtcctatggcacatggagttgttttcaaatgaacttttatacaaaacatataaacaaaaaccagcaggcgtcgtggaacctgtttacgacgtcaacgggcgtccactgtttggagagagcagtgacttgcacccgcagtccacactaaaactaccacaccaacgaggcagcgccaacatcgactcggaccgatg

SEQ ID NO: 5882 - DNA, 203 bp, Homo sapiens
ggcgcgccagtcctcctgaccaatgctaggtccctaccgcggaaaggtgactgccggagaggtaatgtgaatggagcggtgagtggcatctatatcaaaccaggaccgatctactaccaggactatgtggggcccgtctatcatagagccccactggaactatgtagggaggcaagtatgtgtgaaaccgactcggaccgatg

SEQ ID NO: 5883 - DNA, 203 bp, Homo sapiens
ggcgcgccagtcctgaacaaacatggttggtgtaactggtttcatatagaaccgtggatatggctgatgaacaaaacccaaaacaacctgacagaagggcagccgcttagggagtgtgctgtgacttgtaggtatgacaaggaagcagaattgaacattgtgacacaggctagggacaggcctacaaccgactcggaccgatg

SEQ ID NO: 5884 - DNA, 203 bp, Homo sapiens
ggcgcgccagtccttctgacaggctgcaacaaaggcaagaatttctccttcgcaggtgttgtactggacaggccctgtaactttaaagtatcggttgaagatgtgctgttcaaggagcacgattgcggcaacatgctgcaagagaccgcgatacagatactcgatggggcaaccaacaccattgagggcgactcggaccgatg

SEQ ID NO: 5885 - DNA, 203 bp, Homo sapiens
ggcgcgccagtcctagcaagggtagggacggccaagttgacaacctggttagggaagcaattagggatccttggtaagaagttggagaataaaagcaaagcatggtttggtgcacatgcagcaagtccatactgcggagtggagaagaagatcggttacgtctggtatacaaaaaactgcactccagccgactcggaccgatg

SEQ ID NO: 5886 - DNA, 203 bp, Homo sapiens
ggcgcgccagtcctgaagaggtacctagtggctgtgcacgagagagccctatcaaccagtgctgagtttatgcagatcagtgatgggacaatagccccagatgtgatagatatgactgatgactttgagtttggactctgcccttgtgactcaaaaccagtgataaagggcaaatttaatgccagcttcgactcggaccgatg

SEQ ID NO: 5887 - DNA, 203 bp, Homo sapiens
ggcgcgccagtcctagtttatgacatctgtgacaatgaagaagcagtgtacctgtttccatcaaggcataagagtggaagcagaccggatttcatattaccttttttgaaagccgtgttaataagctgcatcagtagccaatggcaattggtttacattacttacctaatactggaaattacatactacgactcggaccgatg

SEQ ID NO: 5888 - DNA, 203 bp, Homo sapiens
ggcgcgccagtccttgtaaaaaaattgactagtatgaacagaggagagttcaaacagataacattggccactggggcaggaaaaactacggaactgccaagatccgtcatagaggagatagggaggcacaaaagggtcttagtcctgataccattgagagctgcagcagagtcagtgtatcagtatatcgactcggaccgatg

SEQ ID NO: 5889 - DNA, 203 bp, Homo sapiens
ggcgcgccagtcctgagagtgaagtacccaagtatatctttcaatttgagaataggagatatgaaggaaggtgacatggctactggtatcacttactcctcatatcggtactttttccagcttccccagcccaaactgaaaactgccatggtagagtattcatatatattcttagatgagtaccactgcgactcggaccgatg

SEQ ID NO: 5890 - DNA, 203 bp, Homo sapiens
ggcgcgccagtccttgctacacccgagcaattagcaataattggaaagatacacaggtttgctgaaaatcttagagtggtagcaatgacagcaaccccagctggaacggtcacaacgactggtcagaaacaccctatagaggagttcatagccccagaggtgatgaagggtgaagatctaggtagtgacgactcggaccgatg

SEQ ID NO: 5891 - DNA, 203 bp, Homo sapiens
ggcgcgccagtcctctcgcaatccccgtatgtggtagtaagcaccaatgccatagagtcaggtgtgacattgccagacttagacacagttgtagacactggactaaggtgtgaaaagagggtgaggatatcttcaaaaatgcccttcattgtaacaggacttaagagaatggcagtcacaataggagacgactcggaccgatg

SEQ ID NO: 5892 - DNA, 203 bp, Homo sapiens
ggcgcgccagtcctgagcctttatgaagaggacagcctgatgataactcaactcgaggtcctcaacaacctccttatatcagaagacctgcctgccgcagtgaagaacatcatggccgggaccgatcacccagaacccatacaactggcctataacagttatgaaaaccaaattccagtgctgttccccgactcggaccgatg

SEQ ID NO: 5893 - DNA, 203 bp, Homo sapiens
ggcgcgccagtcctaaagatcaaaaatggtgaggtgacagacagttacgagaattacacatacctcaatgcaagaaaactaggagaggacgtgccggcatatgtgtacgccacagaggatgaggatctagcagtggatcttctgggtatggattggccggacccaggcagccaacaggtggtggagaccgactcggaccgatg

SEQ ID NO: 5894 - DNA, 203 bp, Homo sapiens
ggcgcgccagtcctcccaaacgccataaggactgacggcaaggacacagagttgaaggaattagctgtgggagaccttgataaatatgtggatgcactggtagactactccaaacaagggatgaaatttatcaaagtccaagctgaaaaggtcaaagactcccagtctacaaaggaaggcttgcaaaccgactcggaccgatg

SEQ ID NO: 5895 - DNA, 203 bp, Homo sapiens
ggcgcgccagtccttctgcaacgcgtcgtcgaacctgccttagcatacctcccatatgctacaagttccttgaagtcgttcgcacccacaagattagagagtgtggtcatactcagttctacaatttacaagacatacctatccataaggaagggtaagagtgacggcttgctaggtacaggcataagcgactcggaccgatg

SEQ ID NO: 5896 - DNA, 203 bp, Homo sapiens
ggcgcgccagtcctgataggttttaaaggtgcatatttgggtgaccgaccagactatcaagatcttgtcgatagagattgtgcaactataacgaagaactcagtacagttcctaaaaatgaagaagggttgcgctttcacatatgacctaacaatctctaaccttgtcaggcttattgaactagtccacgactcggaccgatg

SEQ ID NO: 5897 - DNA, 203 bp, Homo sapiens
ggcgcgccagtcctagatgagaaagtagacaggccttttgttctaattattggaaacaaaggttctacctcaaatagagcaagaacggccaagaatatacggctttataaaggaaataacccaagagagatcagggatctgatgagccaaggaagaatattgacggttgctctaaaagagttggaccccgactcggaccgatg

SEQ ID NO: 5898 - DNA, 203 bp, Homo sapiens
ggcgcgccagtcctacagatgagtctagcccccctctttgaagagctgttattaaagtgccctccatgtagtaaaatttcaaagggacatatggtgtcagactaccaactggctcaaggaaactgggaacccttcgggtgtggggtctatatgggaaccataccagctaggcgtctcaagatccaccccgactcggaccgatg

SEQ ID NO: 5899 - DNA, 203 bp, Homo sapiens
ggcgcgccagtcctcagagatggacacaaaagaaacatatataataagatcataggctcaacaatggcctctgctggtattaggctggagaaactgccagtagtccgagcccaaaccgacacaaccagtttccaccaggctataagagaaaaaattgataaaccagaaaacaagcagacccctggattcgactcggaccgatg

SEQ ID NO: 5900 - DNA, 203 bp, Homo sapiens
ggcgcgccagtcctagtgatgtacaagtgggtaaagcaaaaaccagtggtgatacccggctatgaaggtaaaacaccgcattttgacatattcaacaaagtgaagaaggaatgggattcattccaggaccccgtggcagtgagctttgacaccaaagcatgggatacacaagtcaccagtagagacctcgactcggaccgatg

SEQ ID NO: 5901 - DNA, 203 bp, Homo sapiens
ggcgcgccagtcctgaagccccagaaaataactgaaggggacaaaatgaaagtggcatatagatttgaggacatcgagttttgttcccatactcccgtgccagtaagatgggcagataacaccagtagttacatggcagggaggagcacagccactatactagctaagatggcaaccaggttggattccgactcggaccgatg

SEQ ID NO: 5902 - DNA, 203 bp, Homo sapiens
ggcgcgccagtcctttccccggtgatgtcgtatagactgcttgcgtggttgaaagcgacggatccgttatccgcttatgtacttcgagaagcccagtaccacctcggaatcttcgatgcgttgcgctcagcactcaaccccagagtgtagcttaggctgatgagtctggacatccctcaccggtgacgcgactcggaccgatg

SEQ ID NO: 5903 - DNA, 203 bp, Homo sapiens
ggcgcgccagtcctgtggtccaggctgcgttggcggcctacctatggctaacgccatgggacgctagttgtgaacaaggtgtgaagagcctattgagctacataagaatcctccggcccctgaatgcggctaatcccaacctcggagcaggtggtcacaaaccagtgattggcctgtcgtaacgcgcacgactcggaccgatg

SEQ ID NO: 5904 - DNA, 203 bp, Homo sapiens
ggcgcgccagtcctactctttgggcaaaatatgtactaccactacctaggtaggtccgggtacaccgtgcatgtacagtgtaacgcctccaaattccaccagggggcactaggggtattcgccgtaccagagatgtgtctggccggggatagcaacaccactaccatgcacaccagctatcaaaatgccgactcggaccgatg

SEQ ID NO: 5905 - DNA, 203 bp, Homo sapiens
ggcgcgccagtcctggtagtgccatggattagcaacaccacgtatcggcaaaccatagatgatagtttcaccgaaggcggatacatcagcgtcttctaccaaactagaatagtcgtccctctttcgacacccagagagatggacatccttggttttgtgtcagcgtgtaatgacttcagcgtgcgcttcgactcggaccgatg

SEQ ID NO: 5906 - DNA, 203 bp, Homo sapiens
ggcgcgccagtcctgttgcgagataccacacatatagagcaaaaagcgctagcacaggggttaggtcagatgcttgaaagcatgattgacaacacagtccgtgaaacggtgggggcggcaacatctagagacgctctcccaaacactgaagccagtggaccaacacactccaaggaaattccggcactcgactcggaccgatg

SEQ ID NO: 5907 - DNA, 203 bp, Homo sapiens
ggcgcgccagtcctcaccgcagtggaaactggggccacaaatccactagtcccttctgatacagtgcaaaccagacatgttgtacaacataggtcaaggtcagagtctagcatagagtctttcttcgcgcggggtgcatgcgtgaccattatgaccgtggataacccagcttccaccacgaataaggacgactcggaccgatg

SEQ ID NO: 5908 - DNA, 203 bp, Homo sapiens
ggcgcgccagtccttaagctatttgcagtgtggaagatcacttataaagatactgtccagttacggaggaaattggagttcttcacctattctagatttgatatggaacttacctttgtggttactgcaaatttcactgagactaacaatgggcatgccttaaatcaagtgtaccaaattatgtacgtcgactcggaccgatg

SEQ ID NO: 5909 - DNA, 203 bp, Homo sapiens
ggcgcgccagtcctggaccagtcggcagcactaggtgactccctttatggtgcagcatctctaaatgacttcggtattttggctgttagagtagtcaatgatcacaacccgaccaaggtcacctccaaaatcagagtgtatctaaaacccaaacacatcagagtctggtgcccgcgtccaccgagggccgactcggaccgatg

SEQ ID NO: 5910 - DNA, 203 bp, Homo sapiens
ggcgcgccagtcctagtggcgtactacggccctggagtggattacaaggatggtacgcttacacccctctccaccaaggatctgaccacatatggattcggacaccaaaacaaagcggtgtacactgcaggttacaaaatttgcaactaccacttggccactcaggatgatttgcaaaacgcagtgaacgactcggaccgatg

SEQ ID NO: 5911 - DNA, 203 bp, Homo sapiens
ggcgcgccagtcctcgtcatgtggagtagagacctcttagtcacagaatcaagagcccagggcaccgattcaatcgcaaggtgcaattgcaacgcaggggtgtactactgcgagtctagaaggaaatactacccagtatccttcgttggcccaacgttccagtacatggaggctaataactattaccccgactcggaccgatg

SEQ ID NO: 5912 - DNA, 203 bp, Homo sapiens
ggcgcgccagtcctctatgaagacaccacaacagtgctcgctaccctggcccttcttgggtgtgatgcttcaccatggcagtggcttagaaagaaagcatgcgatgttctggagataccttatgtcatcaagcaaggtgacagttggttgaagaagtttactgaagcatgcaacgcagctaagggactcgactcggaccgatg

SEQ ID NO: 5913 - DNA, 203 bp, Homo sapiens
ggcgcgccagtcctgatggtatcaacagtggagtttataccacccatggcatccctggaggagaaaggaatcctgtttacttcaaattacgttctagcatccacaaactcaagcagaatttccccccccactgtggcacacagtgatgcattagccaggcgctttgcgttcgacatggacattcaggtcgactcggaccgatg

SEQ ID NO: 5914 - DNA, 203 bp, Homo sapiens
ggcgcgccagtcctcaaaaaacccaacgtgcccaccattcggacagcaaaggtacaaggaccagggttcgattacgcagtggctatggctaaaagaaacattgttacagcaactactagcaagggagagttcactatgttaggagtccacgacaacgtggctattttaccaacccacgcttcacctggcgactcggaccgatg

SEQ ID NO: 5915 - DNA, 203 bp, Homo sapiens
ggcgcgccagtcctcctcccactggtgacttatgtaaaggatgaacttagatccaaaacaaaggttgagcaggggaaatccagattaattgaagcttctagtttgaatgactcagtggcaatgagaatggcttttgggaacctatatgctgcttttcacaaaaacccaggagtgataacaggttcagccgactcggaccgatg

SEQ ID NO: 5916 - DNA, 203 bp, Homo sapiens
ggcgcgccagtcctcagggtaggtgcattgataacattattctctcttccctcagcaggcatgcaaaatcatattagattggcagatagatcacctgaagctcagatagaacgctgtgagattgacggttttgagccaggcacatataggctaattccgaatgcacgcgccaatcttactgccaatgacgactcggaccgatg

SEQ ID NO: 5917 - DNA, 203 bp, Homo sapiens
ggcgcgccagtcctaattgctgcctatgctttgcttgcagatgacctccctccaaccataaataatggaactccctatgtacatgcagatgttgaaggacagccatgtgatgagattgagcaattcctagatcgatgctacagtgtactaatccaggcttgggtgatggtctgtaaatgtatgacagccgactcggaccgatg

SEQ ID NO: 5918 - DNA, 203 bp, Homo sapiens
ggcgcgccagtccttggttattatttccagattggggttgagactgcacgacggcaacaaggcactgttgacaacagagtagcagatgatctaggcctgactcctgagcaaaggactgaggttactcagcttattgacaggcttgcaaggggcagaggtgcggggataccaggtgggcccgtgaatcccgactcggaccgatg

SEQ ID NO: 5919 - DNA, 203 bp, Homo sapiens
ggcgcgccagtcctcccgtcctgcaaagcagccaaaaccccaaccagtaaaggatttagcaggacggaaagtgatgataactaaaatgatcactgactgtgtggccaatcctcaaatgaagcaggtgtttgagcaacgattggcaaaggccagcaccgaggatgctctgaatgatatcaagcgagacacgactcggaccgatg

SEQ ID NO: 5920 - DNA, 203 bp, Homo sapiens
ggcgcgccagtccttcatctctgaatcatcacaacagaaggtgactcctgtagtgacggcgtgcatgctgtccttcggtgctggaccagtcctagaagacccacaacatatgctgaaagctcttgatcagacagacatcagggttcggaagacagcgagtgataaagagcagatcttattcgagatcacgactcggaccgatg

SEQ ID NO: 5921 - DNA, 203 bp, Homo sapiens
ggcgcgccagtcctaagcttttaccgaatatccaacccactgataacagctgtgaatttaagagtgtaactcaatacaataagaccttgagtaatttgcttcttccaattgcagaaaacataaacaatattgcatcgccctcatctgggtcaagacggcataaaaggtttgctggcattgctattggccgactcggaccgatg

SEQ ID NO: 5922 - DNA, 203 bp, Homo sapiens
ggcgcgccagtcctattgctgcgctcggtgttgcgaccgcagcacaagtaactgccgctgtctcattagttcaagcacagacgaatgcacgtgcaatagcggcgatgaaaaattcaatacaagcaactaatcgagcagtcttcgaagtgaaggaaggcactcaacggttagctatagcggtacaagcacgactcggaccgatg

SEQ ID NO: 5923 - DNA, 203 bp, Homo sapiens
ggcgcgccagtcctcatgcagtcacgaccattgatctaaccgcatgtcaaacattgtccctagacggattggatttcagcattgtctctctaagcaacatcacttatgctgagaaccttaccatttcattgtctcagacaatcaatactcaacccattgacatatcaactgaactgagtaaggttaatcgactcggaccgatg

SEQ ID NO: 5924 - DNA, 203 bp, Homo sapiens
ggcgcgccagtcctgatggagccctccaaactcttcacaatgtcagacaatgccacctttgcacctgggcctgttatcaatgcggctgacaagaagacattccgaacctgcttccgaatattggtactgtctgtacaagctgttacccttatattagttattgtcactttaggtgagcttgtgaggatcgactcggaccgatg

SEQ ID NO: 5925 - DNA, 203 bp, Homo sapiens
ggcgcgccagtcctgatcaatgatcaaggcttgagcaatcagttgtcttcaattgcagacaagataagagagtcagctactatgattgcatctgctgtgggagtaatgaatcaagttattcacggagtaacggtatccttacccctacaaattgagggaaaccaaaatcaattgttatccacgcttgccgactcggaccgatg

SEQ ID NO: 5926 - DNA, 203 bp, Homo sapiens
ggcgcgccagtcctagtaaccattgtggatactaggtccactctatgcattattgccccagaattagttgctttatactccaatgagcacaaagcattaacgtacctcacctttgaaatggtattaatggtcactgatatgttagagggacgactcaatgtttcttctttgtgcacagctagtcattacgactcggaccgatg

SEQ ID NO: 5927 - DNA, 203 bp, Homo sapiens
ggcgcgccagtccttctgtcccctctaaagaagagaatcgaaattctcctaacattagttgatgaccttgctctacttatgggggacaaagtatacggtgttgtctcttcacttgagagttttgtttacgcccaattacagtatggtgatcctgttgtagacattaagggtacattctatggatttatcgactcggaccgatg

SEQ ID NO: 5928 - DNA, 203 bp, Homo sapiens
ggcgcgccagtcctagcatccaaggtccgagagtccatgtgtgctcctaaggtgttagatttccaaacaataatgaagaccctggctttctttcatgcaatcctgattaacggttataggaggagccataatggaatctggcctcctactactcttcatggcaatgcccccaaaagcctcattgagatcgactcggaccgatg

SEQ ID NO: 5929 - DNA, 203 bp, Homo sapiens
ggcgcgccagtcctgagcctgataaaacagcgatatcgtgatgcgaatcggcctctaccacaaccattcaaccgacggctactgttgaattttctagaggatgacagattcgatcccattaaggagcttgagtatgtcaccagtggagaatatcttagggaccctgaattttgtgcatcttactctctcgactcggaccgatg

SEQ ID NO: 5930 - DNA, 203 bp, Homo sapiens
ggcgcgccagtccttgacctcacaaaatactgcttaaattggaggtaccaagtcatcatcccctttgcgcgtacattgaattcaatgtatggtataccccacctgttcgaatggatacatttaaggctaatgcgaagcactctctatgttggtgatcccttcaatcctccatcagatcctacccaactcgactcggaccgatg

SEQ ID NO: 5931 - DNA, 203 bp, Homo sapiens
ggcgcgccagtccttgaccttgatacagctctcaatgatgatatatttatagtttctcctcgtggaggaatcgagggtttatgtcaaaaattatggactatgatttccatctcaacaatcatattatccgcgactgaggcaaacactagagttatgagtatggttcagggtgacaaccaagcaattgccgactcggaccgatg

SEQ ID NO: 5932 - DNA, 203 bp, Homo sapiens
ggcgcgccagtcctgttttacaaaggtcgaattttgactcaagcgttaaagaacgtgagcaagatgtgcttaacagctgacatactaggggactgttcacaagcatcatgctccaatttagctactactgtaatgcgcctgactgagaatggggtcgagaaagatttgtgttattttctaaatgcattcgactcggaccgatg

SEQ ID NO: 5933 - DNA, 203 bp, Homo sapiens
ggcgcgccagtcctattaaaatttacccctgcaagctcctatgcattctctagctttgttcatatatctaatgactgtcaagttcttgagatcgatgatcaggtaacagattctaacctgatttaccagcaagttatgattactggccttgctttaattgagacatggaacaatcctccaatcaacttcgactcggaccgatg

SEQ ID NO: 5934 - DNA, 203 bp, Homo sapiens
ggcgcgccagtcctcatctcatccacaattagtcaccctcgtatactcagaagatgcatcaatctggatgtcatagcccctatcaattctccacacatagcttcactggattacacaaaattgagcatagatgcagtaatgtggggaactaagcaggttttgaccaacatttcgcaaggtatcgattacgactcggaccgatg

SEQ ID NO: 5935 - DNA, 203 bp, Homo sapiens
ggcgcgccagtccttgagatagttgttccttctgaaagccaactcacactcagtgatagagttctaaatctagttgcacgaaaactatcactactggcaatcatctgggccaattataactaccctccaaaggttaaaggtatgtcacctgaggacaaatgtcaggctttaactacccatctactccacgactcggaccgatg

SEQ ID NO: 5936 - DNA, 203 bp, Homo sapiens
ggcgcgccagtcctctttggatatctggaaccaatactaatggaatctaaaatattcaatctaagttcatccgaatcagcatcccttacagaatttgatttcatcctcaacttggaattgtctgaagccagccttgagaaatactctctcccaagtttgcttatgacggctgagaatatggataaccccgactcggaccgatg

SEQ ID NO: 5937 - DNA, 203 bp, Homo sapiens
ggcgcgccagtccttaacagcgatatcactgacttaagcacgaaaactagtgtcgagtacattattcacaaggtaggggctgatacatgtgcgttggttcatgtggatctggagggtgtacccggctcaatgaacagtatgttggagagagcccaagttcatgcgctactgatcacggtaactgtactcgactcggaccgatg

SEQ ID NO: 5938 - DNA, 203 bp, Homo sapiens
ggcgcgccagtcctgcttacccctgatgttgaagattctgagcgcattgatattgacaatgatatacctgattatgatatccacggggacataatttaaatcgactaaagactcctctggcatgataagtcaccaaaaggttccacaccagcatccaaattcttctagaccgtacacgacctcgaatacgactcggaccgatg

SEQ ID NO: 5939 - DNA, 203 bp, Homo sapiens
ggcgcgccagtcctggacataatttaaatcgactaaagactcctctggcatgataagtcaccaaaaggttccacaccagcatccaaattcttctagaccgtacacgacctcgaataatcataaccacatcagtattaaatccataatatcattttaagaaaaaattgattttactttctccccttggtcgactcggaccgatg

SEQ ID NO: 5940 - DNA, 203 bp, Homo sapiens
ggcgcgccagtccttcaactgacagcaaccccatagtctggtgctcatgacagtgtgagagttcaatactcacctctccactgtcgtgaggacccttatgttaaccacaaaccttatatttttaggagccgggaggatagctcaacctgttaagaactcagaaggttatgtatattcttccttgctcccgactcggaccgatg

SEQ ID NO: 5941 - DNA, 203 bp, Homo sapiens
ggcgcgccagtcctggattatacaagctggttttataatccgagaagtctatgaagtactggggcttgatcctcttggtcgacccctgaacttcccagggggtttaacacaaagagacaccgctgttcctgttacaagaggaagaggacgaggacgaacaggcccccgacgaggaccagttctgcccgcgactcggaccgatg

SEQ ID NO: 5942 - DNA, 203 bp, Homo sapiens
ggcgcgccagtcctatgggccaacctatatgggtatattctcccatacactctatgaccagaatacagaaaacacccttaacagaaaggaaggcattatcaattcggtggttaaaatggcaaacttattttgaagatcctagattaatatttcattatgatgatacattaccagatttacaaaatcttcgactcggaccgatg

SEQ ID NO: 5943 - DNA, 203 bp, Homo sapiens
ggcgcgccagtcctaataagaaaaagccactgaaacatgtgagtaaatggaaatcaatagctgactgtaaaaaacataaggccgatatccacgtgatacatgagccaggccatcaaaatgatttgcaatcaccttatgccatgggcaacaatgctgctgataaattggcagtcaaggccagttacactcgactcggaccgatg

SEQ ID NO: 5944 - DNA, 203 bp, Homo sapiens
ggcgcgccagtcctaaggctctcaatcatctcactggtactgctattcctaaggtgctgcattctgatcaaggatcagcattcacctctgcaactttggtcgcctgggccaaagacaagggtatacaaatggaatacagttctccttatcatccccaaagtagtggtaaagttgaaaggaaaaacagtcgactcggaccgatg

SEQ ID NO: 5945 - DNA, 203 bp, Homo sapiens
ggcgcgccagtcctgagataaaacgactcttgacaaaactattggttggacggcctacaaagtggtacccacttatacctactgttcaattggcattgaataatactccaaatgcaaaaataggcaaaacgccacatcaattgatgtatggagtggattgtaatcttcccttccaggatctaagtacacgactcggaccgatg

SEQ ID NO: 5946 - DNA, 203 bp, Homo sapiens
ggcgcgccagtcctacctgatgtgcagatagatttgcctgtttataatcctgacatgactaagccattgcctctttgtttgcggattaagtattggatgtatttgttatgtgctacctcaccgcgtgtaatggcttggttactgtttgtttgtgttttgatatctgttatgatcatagctgttatagtcgactcggaccgatg

SEQ ID NO: 5947 - DNA, 203 bp, Homo sapiens
ggcgcgccagtcctccaaggggtctttttggaaccctttcctaaacctattattgacaaggagagggttttgggtatttcacaaattgttatgattgattctggttcaatagcccaatctatgaatttggatttgtatatgaaacatttgttggtggatatgattaatgaagagatggttgcattaagcgactcggaccgatg

SEQ ID NO: 5948 - DNA, 203 bp, Homo sapiens
ggcgcgccagtccttaatgtggtgcttccttttgaattaccagtaggggatccctcaactcaagaccaatatatacataagagatgttatcagcagtttgcacactgctatatagtatggcaacctggtaggcgtgtctggcctacttcagagattatacaagaccaatgtccattaccagatcatcccgactcggaccgatg

SEQ ID NO: 5949 - DNA, 203 bp, Homo sapiens
ggcgcgccagtcctatatggaaactggtggtatcttaatagaacctctgaacaaaaggaagaaacatataggaagaagatgctaaatttgacagaaaataactcttccattctaaaagatagagctttgccaccaacatggacccctaaaggacaagccaggctgtttagagaattaaacccattagacgactcggaccgatg

SEQ ID NO: 5950 - DNA, 203 bp, Homo sapiens
ggcgcgccagtcctatataaggtacaatctttatatcaagaatgtattcaaaaggggacctcatatgatttggaagatgtaattaatcaactcttaagggtcttacagaacaatggaatagatttgggtaaagtaccagcctcacgagcatttactcctttctataaccaaatgcctgtctcttataacgactcggaccgatg

SEQ ID NO: 5951 - DNA, 203 bp, Homo sapiens
ggcgcgccagtccttgctggtcatcttgctagggtagaattacaacatccttatgaaatagttaaccaagactgtgagcaactgacttatctagaactcaagggatgtcaagaattggattatctggtatgcgaagaaatccttcaacatgaaccatgtggaaatcagacaggatctgactgtccagtcgactcggaccgatg

SEQ ID NO: 5952 - DNA, 203 bp, Homo sapiens
ggcgcgccagtcctgggttgcctaacatggactggacagttgaatgggatggggagatttcagattcagctcttcaggaatttgactttgatctcagtctgtttgggcagtgatcaccacaaaggtattacagattattgttgtggacctgcttcatgctatactattgtgtgggaaattagtgcagacgactcggaccgatg

SEQ ID NO: 5953 - DNA, 203 bp, Homo sapiens
ggcgcgccagtcctagtattggcaacaggaactccttatcttttcagagctcagcctcatcataggccactacaaacccctgctccttggtccaaaaggcttattaggaccagatatatcagaaattctgtagaagatcaatttgtacattttgccactgaagcaaattacactcccctttcagcccacgactcggaccgatg

SEQ ID NO: 5954 - DNA, 203 bp, Homo sapiens
ggcgcgccagtcctctcatgacagtgtgagagttcaatactcacctctccactgtcgtgaggacccttatgttaaccacaaaccttatatttttaggagccgggaggatagctcaacctgttaagaactcagaaggttatgtatattcttccttgctcccggtggttcgatccctgtttagcctgatacgactcggaccgatg

SEQ ID NO: 5955 - DNA, 203 bp, Homo sapiens
ggcgcgccagtcctcgatagccgctaacctgggacgaactccccttttagtttcggttttaagatgcttccgcatacgcatatagatagaagtaggaagtagttaatcccagtctgagggatggctcgtccaacaaaccacacatcgaggaatgtaatacctgtcctctctcagatcagtggagggaccgactcggaccgatg

SEQ ID NO: 5956 - DNA, 203 bp, Homo sapiens
ggcgcgccagtcctccatggaggcactaatggtcacaacagtggacaaattgactcaggggagacagacctttgattggacggtgtgtagaaaccaacctgctgcaacggcactgaacacaacaataacctcttttaggttgaatgatttaaatggagccgacaagggtggattagtgcccttttgcccgactcggaccgatg

SEQ ID NO: 5957 - DNA, 203 bp, Homo sapiens
ggcgcgccagtcctgaacggcatctctttcgccaggaatgatgatgggaatgtttaatatgctatctacagtattaggagtagccgcactagggataaaaaacattggaaacaaagaatacttatgggatggactgcagtcttcggatgattttgctctgtttgttaatgcaaaagatgaagagacatcgactcggaccgatg

SEQ ID NO: 5958 - DNA, 203 bp, Homo sapiens
ggcgcgccagtccttacgaaagcttttttctcagaaagatgagacttgacaatgccacttggggccgaataacctttggccctgttgagagagtaagaaaaagagtactactaaacccgctcaccaaggaaatgcccccagatgaagcgagcaatgtaataatggaaatattattccctaaagaagcacgactcggaccgatg

SEQ ID NO: 5959 - DNA, 203 bp, Homo sapiens
ggcgcgccagtccttttgaaagcataatccctcagaagatggctggtcagtacagtggatttgcaagagcagtgctcaaacaaatgagagaccaagaggttatgaaaactgaccaattcataaaattgttgcctttctgtttttcgccaccaaaattaaggagcaatggagagccttatcaatttttgcgactcggaccgatg

SEQ ID NO: 5960 - DNA, 203 bp, Homo sapiens
ggcgcgccagtcctggctttcttgttagtggcaaatatgaccctgatcttggagatttcaaaaccattgaggaacttgaaagactaaaaccgggagaaaaagccaacatcttactttaccaaggaaagcccgttaaagtagttaaaaggaaaagatatagtgctttatccaatgatatttcacaagggcgactcggaccgatg

SEQ ID NO: 5961 - DNA, 203 bp, Homo sapiens
ggcgcgccagtcctctggccaatatgactgaaggaaagtccaagaaaccgaagaccttagctaaggaatgtctagaaaggtattcaacactacgtgatcaaactgacccaatattgataatgaaaagcgaaaaagctaacgaaaacttcttatggaggttatggagggactgtgtaaatacaataagccgactcggaccgatg

SEQ ID NO: 5962 - DNA, 203 bp, Homo sapiens
ggcgcgccagtcctttattaaatgaaagcaatgctagtatgggaaaatataaagtaataccaatcaccaacagagtggtaaatgaaaaaggggaaagctttgacatgctttatggtctggcggttaaggggcaatctcatttgcggggggacacggatgttgtaacagttgtgactttcgagtttagtcgactcggaccgatg

SEQ ID NO: 5963 - DNA, 203 bp, Homo sapiens
ggcgcgccagtccttcaaatcctcaaaagttcacctcatctgccaatggagtaaccacacattatgtttctcagattggtggcttcccaaatcaaacagaagacgaagggctaaaacaaagcggcagaattgttgttgattacatggtacaaaaacctggaaaaacaggaacaattgtttatcaaagacgactcggaccgatg

SEQ ID NO: 5964 - DNA, 203 bp, Homo sapiens
ggcgcgccagtcctggactgaaaagggttggacttgacccttcattaatcagtacttttgccggaagcacactacccagaagatcaggtacaactggtgttgcaatcaaaggaggtggaactttagtggatgaagccatccgatttataggaagagcaatggcagacagagggctactgagagacatccgactcggaccgatg

SEQ ID NO: 5965 - DNA, 203 bp, Homo sapiens
ggcgcgccagtcctcatcaacaaaaacaactgcaccaacaatgtcattagagtgcacaaacgcatcaaatgcccagactgtgaaccattctgcaacaaaagagatgacatttccacccccagagccggagtggacataccctcgtttatcttgccagggctcaacctttcagaaggcactcctaattacgactcggaccgatg

SEQ ID NO: 5966 - DNA, 203 bp, Homo sapiens
ggcgcgccagtcctgccctcataggttcggagagatcaaaggaaactcagctcccttgataataagagaaccttttgttgcttgtggaccaaaagaatgcagacactttgctctgacccattatgcagctcagccggggggatactacaatggaacaagaaaggacagaaacaagctgaggcatctagcgactcggaccgatg

SEQ ID NO: 5967 - DNA, 203 bp, Homo sapiens
ggcgcgccagtcctacactgaagagtgcacatgcgggttcgccagcaataaaaccatagaatgtgcctgtagagacaacagttacacagcaaaaagaccctttgtcaaattaaatgtggaaactgatacagctgaaataagattgatgtgcacaaagacttatctagacactcccagaccggatgatgcgactcggaccgatg

SEQ ID NO: 5968 - DNA, 203 bp, Homo sapiens
ggcgcgccagtcctgaagcatagcagggccttgcgaatctaatggagacaagtggcttggaggcatcaaaggaggattcgtccatcaaagaatggcatctaagattggaagatggtactcccgaacgatgtctaaaactaacagaatggggatggaactgtatgtaaagtatgatggtgacccatggacgactcggaccgatg

SEQ ID NO: 5969 - DNA, 203 bp, Homo sapiens
ggcgcgccagtccttgcctaactgatatacaaaaagcactaattggtgcctctatatgctttttaaaacccaaagaccaagaaagaaaaaggagattcatcacagagcccctgtcaggaatgggaacaacagcaacaaagaagaaaggcctaattctagctgagagaaaaatgagaagatgtgtaagccgactcggaccgatg

SEQ ID NO: 5970 - DNA, 203 bp, Homo sapiens
ggcgcgccagtcctgggtaaacttgaaaatacaaataaggaatccaaataaggaggcaataaacagagaggtgtcaattctgagacacaattaccaaaaggaaatccaagccaaagaaacaatgaagaaaatactctctgacaacatggaagtattgggtgaccacatagtagttgaagggctttcaacgactcggaccgatg

SEQ ID NO: 5971 - DNA, 203 bp, Homo sapiens
ggcgcgccagtcctcaagaccgcctacacagactaaaacgaaaattagaatcaagaataaagactcacaacaagagtgagcctgagaataaaaggatgtctcttgaagagagaaaagcaattggggtaaaaatgatgaaagtgcttctgtttatggatccctctgctggaattgaagggtttgagccacgactcggaccgatg

SEQ ID NO: 5972 - DNA, 203 bp, Homo sapiens
ggcgcgccagtcctcccgtcaaaataacaacttataacacgatgttacccgaagaaaccattttagtgtaacatttaagattagaagtagttcatctaatagagataggcactattagaaggaggccttttctaaaggagccgttagtcagcccagacaagcgcagtactttagaagagagaagttcccgactcggaccgatg

SEQ ID NO: 5973 - DNA, 203 bp, Homo sapiens
ggcgcgccagtccttacctacaaaaaactgggaattgaagcaatgattaaaagacttggagatttgggaagagcagccaaaggctgttcagatttgaatgtggtgctcaaccaggctataaccaaccacatgttagaacattttgggaagaatgttcttggtttaaaacaagaagatgaactcaaagtcgactcggaccgatg

SEQ ID NO: 5974 - DNA, 203 bp, Homo sapiens
ggcgcgccagtccttaaccctaaccctgaatttatggagttaatacgtacagctaacatagctccataccccttacacatggctcacctcgaagataaaaggaaaacaaaattcacatcaaaagtaatcattatgacatctaatgtttttgaacaggatgttaattcactaacatttccagatgcattcgactcggaccgatg

SEQ ID NO: 5975 - DNA, 203 bp, Homo sapiens
ggcgcgccagtcctgatgaccgttagtttaatactgggcactctcattggaatacttactgttgtagggttttggaaatggttatgtagtggcgataaaaagaagaatccgataaaaagacattttattaatacaggcaatgttctaatcttacccgatagagaattaaacaccttttggaaaaatcacgactcggaccgatg

SEQ ID NO: 5976 - DNA, 203 bp, Homo sapiens
ggcgcgccagtcctaattaagacaaaacccgccatcctaagaaatgtgatagtggatggaaaaattgttaatataaaacataaaaacttgaagaaatgcgccatggacacaccctatgtgtcaaaagaaatgactgaagaagcttttcagttagttaaatcagtctggttaaagggaatgcgtaatgacgactcggaccgatg

SEQ ID NO: 5977 - DNA, 203 bp, Homo sapiens
ggcgcgccagtcctgtactatttgggcttcatagcacaccttatggaaaatcgaataaccaatgaagtatccataggaactaatgtttattcccaagattggaataagacagttagaaaacttaaaactatgggacccaaggttattgcaggagatttctcaacctttgatggatctttgaatgtttgcgactcggaccgatg

SEQ ID NO: 5978 - DNA, 203 bp, Homo sapiens
ggcgcgccagtccttttggatatcagtacatataatggttatgctcaggagagattcctaaattactacttgtaatttgggaatcgcaacacaacatggttacccatagattgaggaaatttccaataaactcagtattaaggcttgttgtgttggacaaggtgccctatttagggtgaggagccttacgactcggaccgatg

SEQ ID NO: 5979 - DNA, 203 bp, Homo sapiens
ggcgcgccagtcctctggcagccccagtgaatcctccattggataggaacagctatattgggtagttgtagcagttgtattcaaatgaatgcagcgttccgaaatatcatacctgccgatcaagaaacaaatacttccaacgtacataatacgcaactcgcgtcgacctctgaagaaaactcagttgacgactcggaccgatg

SEQ ID NO: 5980 - DNA, 203 bp, Homo sapiens
ggcgcgccagtccttgataacaaacccctcaatagatatgtgttaaatcgacagaatccacaaccatttgttaaatcttggacattgccttcagtagttttaagtgctggaggtaagggacaaaaattagctaattttaaatatttacgatgtgatgttaaagtcaaaattgttctaaacgcaaatcccgactcggaccgatg

SEQ ID NO: 5981 - DNA, 203 bp, Homo sapiens
ggcgcgccagtcctagcatatgatttagtcacaggtactgaagattttgtcaagctatatctatttacaataacgcccatattatccccgactagcacatctgctagttcaaaggtggacctttcagtttatatgtggttggataatatttccttagtcatacccacgtatcgcgttaacacgagcatcgactcggaccgatg

SEQ ID NO: 5982 - DNA, 203 bp, Homo sapiens
ggcgcgccagtcctcgtaccaaatgtggggactgttgttcagacagtacaaaatatgactacacgagacagtgaaacaattaggaaagcaatggttgcattaaggaaaaataataaatcaacttacgactatatagtgcaagctttatcttctgcagttccagaagttaagaatgtaactatgcagatcgactcggaccgatg

SEQ ID NO: 5983 - DNA, 203 bp, Homo sapiens
ggcgcgccagtccttgctgccatgccggaagaggagacaactgaagctaatgccggtcagtttctctcctttgcaagtctattccttccgaaattggtagtaggagaaaaggcttgccttgagaaggttcaaaggcaaattcaagtacatgcagagcaaggactgatacaatatccaacagcttggcacgactcggaccgatg

SEQ ID NO: 5984 - DNA, 203 bp, Homo sapiens
ggcgcgccagtcctacttgatcatatcctacaaaagacagaacgaggagttcgtctccatcctcttgcaaggaccgccaaggtaaaaaatgaggtgaactcctttaaggctgcactcagctccctggccaagcatggagagtatgctcctttcgcccgacttttgaacctttctggagtaaataatctcgactcggaccgatg

SEQ ID NO: 5985 - DNA, 203 bp, Homo sapiens
ggcgcgccagtccttggacttgatgatcaggaaaagaaaattcttatgaacttccatcagaaaaagaacgaaatcagcttccagcaaacaaacgctatggtaactctaagaaaagagcgcctggccaagctgacagaagctatcactgctgcgtcactgcccaaaacaagtggacattacgatgatgacgactcggaccgatg

SEQ ID NO: 5986 - DNA, 203 bp, Homo sapiens
ggcgcgccagtccttgacgacattccctttccaggacccatcaatgatgacgacaatcctggccatcaagatgatgatccgactgactcacaggatacgaccattcccgatgtggtggttgatcccgatgatggaagctacggcgaataccagagttactcggaaaacggcatgaatgcaccagatgacgactcggaccgatg

SEQ ID NO: 5987 - DNA, 203 bp, Homo sapiens
ggcgcgccagtcctcaaccgcacacccactgtcgccccaccggctcccgtatacagagatcactctgaaaagaaagaactcccgcaagacgagcaacaagatcaggaccacactcaagaggccaggaaccaggacagtgacaacacccagtcagaacactcttttgaggagatgtatcgccacattctcgactcggaccgatg

SEQ ID NO: 5988 - DNA, 203 bp, Homo sapiens
ggcgcgccagtcctcaactagaacaaagggcaggggccatactgcggccacgactcaaaacgacagaatgccaggccctgagctttcgggctggatctctgagcagctaatgaccggaagaattcctgtaagcgacatcttctgtgatattgagaacaatccaggattatgctacgcatcccaaatgccgactcggaccgatg

SEQ ID NO: 5989 - DNA, 203 bp, Homo sapiens
ggcgcgccagtcctcacctgtcatccacatccgctctcgaggtgacattccccgagcttgccagaaaagcttgcgtccagtcccaccatcgcccaagattgatcgaggttgggtatgtgtttttcagcttcaagatggtaaaacacttggactcaaaatttgagccaatctcccttccctccgaaagacgactcggaccgatg

SEQ ID NO: 5990 - DNA, 203 bp, Homo sapiens
ggcgcgccagtcctggcgaataatagcagaggcttcaactgctgaactatagggtacgttacattaatgatacacttgtgagtatcagccctggataatataagtcaattaaacgaccaagataaaattgttcatatctcgctagcagcttaaaatataaatgtaataggagctatatctctgacagtcgactcggaccgatg

SEQ ID NO: 5991 - DNA, 203 bp, Homo sapiens
ggcgcgccagtccttccttgaagctatggtgaatgtcatatcgggccccaaagtgctaatgaagcaaattccaatttggcttcctctaggtgtcgctgatcaaaagacctacagctttgactcaactacggccgccatcatgcttgcttcatacactatcacccatttcggcaaggcaaccaatccaccgactcggaccgatg

SEQ ID NO: 5992 - DNA, 203 bp, Homo sapiens
ggcgcgccagtcctttgtcagagtcaatcggctgggtcctggaatcccggatcatcccctcaggctcctgcgaattggaaaccaggctttcctccaggagttcgttcttccgccagtccaactaccccagtatttcacctttgatttgacagcactcaaactgatcacccaaccactgcctgctgcaacgactcggaccgatg

SEQ ID NO: 5993 - DNA, 203 bp, Homo sapiens
ggcgcgccagtcctagatcgttccaattgatccaaccaaaaatatcatgggaatcgaagtgccagaaactctggtccacaagctgaccggtaagaaggtgacttctaaaaatggacaaccaatcatccctgttcttttgccaaagtacattgggttggacccggtggctccaggagacctcaccatggcgactcggaccgatg

SEQ ID NO: 5994 - DNA, 203 bp, Homo sapiens
ggcgcgccagtcctaacccttgccacaatctccacgagtccccaatccctcacaaccaaaccaggtccggacaacagcacccataatacacccgtgtataaacttgacatctctgaggcaactcaagttgaacaacatcaccgcagaacagacaacgacagcacagcctccgacactccctctgccaccgactcggaccgatg

SEQ ID NO: 5995 - DNA, 203 bp, Homo sapiens
ggcgcgccagtcctgggaatttacatagaggggctaatgcacaatcaagatggtttaatctgtgggttgagacagctggccaacgagacgactcaagctcttcaactgttcctgagagccacaactgagctacgcaccttttcaatcctcaaccgtaaggcaattgatttcttgctgcagcgatggggcgactcggaccgatg

SEQ ID NO: 5996 - DNA, 203 bp, Homo sapiens
ggcgcgccagtcctatcactgcattcttgaatattgctctccagttaccgtgtgaaagttctgctgtcgttgtttcagggttaagaacattggttcctcaatcagataatgaggaagcttcaaccaacccggggacatgctcatggtctgatgagggtaccccttaataaggctgactaaaacactatcgactcggaccgatg

SEQ ID NO: 5997 - DNA, 203 bp, Homo sapiens
ggcgcgccagtcctaccttattattcagattaggccccaagaggcattcttcatctccttttagcaaagtactatttcagggtagtccaattagtggcacgtcttttagctgtatatcagtcgcccctgagatacgccacaaaagtgtctctaagctaaattggtctgtacacatcccatacattgtacgactcggaccgatg

SEQ ID NO: 5998 - DNA, 203 bp, Homo sapiens
ggcgcgccagtcctagagcttgcgggttatattcatcatactcccttaatccgcaactacgcaactgtaaactcccgaaacatatctaccgtttgaaatacgatgtaactgttaccaagttcttgagtgatgtaccagtggcgacattgcccatagatttcatagtcccagttcttctcaaggcactgcgactcggaccgatg

SEQ ID NO: 5999 - DNA, 203 bp, Homo sapiens
ggcgcgccagtcctcatcaagcatcatggcaccacacaagtgatgattttggtgaacatgccacagttagagggagtagctttgtaactgatttagagaaatacaatcttgcatttagatatgagtttacagcaccttttatagaatattgcaaccgttgctatggtgttaagaatgtttttaattggcgactcggaccgatg

SEQ ID NO: 6000 - DNA, 203 bp, Homo sapiens
ggcgcgccagtcctcaaatttctttagttgaaattaagactggttttaagttacgctcagctgtgatgggtgacaatcagtgcattactgttttatcagtcttccccttagagactgacgcagacgagcaggaacagagcgccgaagacaatgcagcgagggtggccgccagcctagcaaaagttacacgactcggaccgatg

SEQ ID NO: 6001 - DNA, 203 bp, Homo sapiens
ggcgcgccagtcctagtataggcactgcttttgagcgatccatctctgagacacgacatatctttccttgcaggataaccgcagctttccatacgtttttttcggtgagaatcttgcaatatcatcatctcgggttcaataaaggttttgaccttggacagttaacactcggcaaacctctggatttccgactcggaccgatg

SEQ ID NO: 6002 - DNA, 203 bp, Homo sapiens
ggcgcgccagtcctggagccacactcccatgtatgattgagcaattcaaagtgttttggctgaaaccctacgaacaatgtccgcagtgttcaaatgcaaagcaaccaggtgggaaaccattcgtgtcagtggcagtcaagaaacatattgttagtgcatggccgaacgcatcccgaataagctggactcgactcggaccgatg

SEQ ID NO: 6003 - DNA, 203 bp, Homo sapiens
ggcgcgccagtcctgaagcacgagtaaatttaagtgttcaagaaatacttcaaatgaccccttcacattactcaggaaatattgttcacaggtacaacgatcaatacagtcctcattctttcatggccaatcgtatgagtaattcagcaacgcgattgattgtttctacaaacactttaggtgagtttcgactcggaccgatg

SEQ ID NO: 6004 - DNA, 203 bp, Homo sapiens
ggcgcgccagtcctttatctggatgggagctagccaagaccatcatgcaatcaattatttcagatagcaacaattcatctacagacccaattagcagtggagaaacaagatcattcactacccatttcttaacttatcccaagataggacttctgtacagttttggggcctttgtaagttattatcttcgactcggaccgatg

SEQ ID NO: 6005 - DNA, 203 bp, Homo sapiens
ggcgcgccagtcctaaccgaaaatacttggcaagagactcttcaactggatcaagcacaaacaacagtgatggtcatattgagagaagtcaagaacaaaccaccagagatccacatgatggcactgaacggaatctagtcctacaaatgagccatgaaataaaaagaacgacaattccacaagaaaaccgactcggaccgatg

SEQ ID NO: 6006 - DNA, 203 bp, Homo sapiens
ggcgcgccagtcctgagagtttcaagtcggctgtgacgctagcagagggagaaggtgctggtgccttactattgattcagaaataccaagttaagaccttatttttcaacacgctagctactgagtccagtatagagtcagaaatagtatcaggaatgactactcctaggatgcttctacctgttatgcgactcggaccgatg

SEQ ID NO: 6007 - DNA, 203 bp, Homo sapiens
ggcgcgccagtccttcaaaattccataatgaccaaattgagattattcttaacaactcagcaagccaaataacagacataacaaatcctacttggtttaaagaccaaagagcaaggctacctaagcaagtcgaggttataaccatggatgcagagacaacagagaatataaacagatcgaaattgtaccgactcggaccgatg

SEQ ID NO: 6008 - DNA, 203 bp, Homo sapiens
ggcgcgccagtccttcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacgactcggaccgatg

SEQ ID NO: 6009 - DNA, 203 bp, Homo sapiens
ggcgcgccagtcctagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggacgactcggaccgatg

SEQ ID NO: 6010 - DNA, 203 bp, Homo sapiens
ggcgcgccagtcctgagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtagcgactcggaccgatg

SEQ ID NO: 6011 - DNA, 203 bp, Homo sapiens
ggcgcgccagtcctcagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtcgactcggaccgatg

SEQ ID NO: 6012 - DNA, 203 bp, Homo sapiens
ggcgcgccagtcctatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaacgactcggaccgatg

SEQ ID NO: 6013 - DNA, 203 bp, Homo sapiens
ggcgcgccagtcctacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaacgactcggaccgatg

SEQ ID NO: 6014 - DNA, 203 bp, Homo sapiens
ggcgcgccagtcctgtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgcgactcggaccgatg

SEQ ID NO: 6015 - DNA, 203 bp, Homo sapiens
ggcgcgccagtcctcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtcgactcggaccgatg

SEQ ID NO: 6016 - DNA, 203 bp, Homo sapiens
ggcgcgccagtcctgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgccgactcggaccgatg

SEQ ID NO: 6017 - DNA, 203 bp, Homo sapiens
ggcgcgccagtcctgacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcacgactcggaccgatg

SEQ ID NO: 6018 - DNA, 203 bp, Homo sapiens
ggcgcgccagtccttgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccaccgactcggaccgatg

SEQ ID NO: 6019 - DNA, 203 bp, Homo sapiens
ggcgcgccagtcctcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctcgactcggaccgatg

SEQ ID NO: 6020 - DNA, 203 bp, Homo sapiens
ggcgcgccagtcctaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccgactcggaccgatg

SEQ ID NO: 6021 - DNA, 203 bp, Homo sapiens
ggcgcgccagtcctcttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgcgactcggaccgatg

SEQ ID NO: 6022 - DNA, 203 bp, Homo sapiens
ggcgcgccagtccttgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaacgactcggaccgatg

SEQ ID NO: 6023 - DNA, 203 bp, Homo sapiens
ggcgcgccagtcctccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatcgactcggaccgatg

SEQ ID NO: 6024 - DNA, 203 bp, Homo sapiens
ggcgcgccagtcctacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattcgactcggaccgatg

SEQ ID NO: 6025 - DNA, 203 bp, Homo sapiens
ggcgcgccagtcctggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagcgactcggaccgatg

SEQ ID NO: 6026 - DNA, 203 bp, Homo sapiens
ggcgcgccagtcctcggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagcgactcggaccgatg

SEQ ID NO: 6027 - DNA, 203 bp, Homo sapiens
ggcgcgccagtccttaccaacaacaaacaccaaaggctattgaagtcaggccacttgtgccacggtttgagcaaaccgtgctgcctgtagctccgccaataatgggaggcgtaataatccccagggaggccatgcgccacggaagctgtacgcgtggcatattggactagcggttagaggagacccctcgactcggaccgatg

SEQ ID NO: 6028 - DNA, 203 bp, Homo sapiens
ggcgcgccagtcctattttctgaccgtccttttatgcttcatgggtggttggttttttccaattcaaattaccttttggaggaatttgatgttgtcttcggtaagagaggtggtggtaatgtgacatacactgaccagtatctctgtggcgccgatggcaaacctgttatgagtgaagatttatggcacgactcggaccgatg

SEQ ID NO: 6029 - DNA, 203 bp, Homo sapiens
ggcgcgccagtcctgtttgttgaccatttcggtgagaacgaagaaattatcatcaatggtcatacttacgtttgtgcttggcttactaagcgtaagcccttagattacaaacgtcagaacaaccttgccattgaagagattgaatatgtgcatggtgatgctttgcatacactacgcaatggttctgtcgactcggaccgatg

SEQ ID NO: 6030 - DNA, 203 bp, Homo sapiens
ggcgcgccagtccttattgaaggtgtctctgtttggagagtgattgctcttcagagtgtggattgctttgttgcttcttccacttttgtagaagaggaacatgttaatagaatggatacattctgcttcaatgtacgcaatagtgttactgatgagtgtcgtctggccatgttgggtgctgaaatgaccgactcggaccgatg

SEQ ID NO: 6031 - DNA, 203 bp, Homo sapiens
ggcgcgccagtccttagtaatgtcagaagacaagttgcttcaggtgtcatagacattagtaccggttggtttgatgtttatgatgacatctttgctgaaagcaaaccatggtttgttcgcaaggctgaagacatttttggcccttgttggtccgctcttgcttctgcacttaaacaacttaaagtcaccgactcggaccgatg

SEQ ID NO: 6032 - DNA, 203 bp, Homo sapiens
ggcgcgccagtccttacaggtgaacttgtgagatttgttaagtctatttgcaattcagctgttgctgtcgtgggtggtactatacaaattctcgctagtgtgcctgagaagtttttgaatgcgtttgacgtgtttgtcacagctattcaaactgtctttgactgtgctgttgaaacttgtactattgccgactcggaccgatg

SEQ ID NO: 6033 - DNA, 203 bp, Homo sapiens
ggcgcgccagtcctgagagactatgttgacaaatgggatgatttttgcagacaatatagtaacgagtcttggtttgaggatgattacagggcttttatcagtgttttggacatcactgatgctgctgtgaaagctgcagagtctaaagctttcgttgatactattgttccaccttgcccatctattttcgactcggaccgatg

SEQ ID NO: 6034 - DNA, 203 bp, Homo sapiens
ggcgcgccagtcctagacactgtggtttctactgttaaaattggtggcttgacctttaaaacatatgcttttgataaaccttacattgtgatacgtgatatcgtgtgtaaggttgaaaataaaacagaagcagaatggattgagctttttccacataatgacaggattaagtcttttagtactttcgacgactcggaccgatg

SEQ ID NO: 6035 - DNA, 203 bp, Homo sapiens
ggcgcgccagtcctgagtgcttacatgccaattgcagaccctacacattttgacattgaagaagttgaacttttagatgcagagtttgtagaaccaggctgtggtggtattttggcagtaatagatgagcacgtcttttataagaaggatggtgtttattatccatcaaatggtactaacattctacccgactcggaccgatg

SEQ ID NO: 6036 - DNA, 203 bp, Homo sapiens
ggcgcgccagtccttgctgaggatgttgttgaccaagttgaagaagtcaatagcatttttgacattgagacagtggatgttaaacatgatgtgagtccttttgaaatgccatttgaagagttaaatggtttaaagatactcaaacaattggataacaactgctgggttaactcagttatgttacaaatcgactcggaccgatg

SEQ ID NO: 6037 - DNA, 203 bp, Homo sapiens
ggcgcgccagtcctctttacagaagacttgttgtgtgtcgctgatgacaaacccattgttttgtttactgactctatgcttactttggatgaccgtggtttagctctagacaatgcacttagtggtgtgcttagtgctgctattaaggattgtgttgacataaataaagctataccttctggtaatctcgactcggaccgatg

SEQ ID NO: 6038 - DNA, 203 bp, Homo sapiens
ggcgcgccagtccttattaagtttgatataggttctgttgttgtctacatgtgtgttgtgccatccgaaaaggacaaacatttagataataatgttcaacgatgcacacgtaagttgaatagacttatgtgtgatatagtttgtactataccagctgactacatcttgccattggtgttgtctagtttcgactcggaccgatg

SEQ ID NO: 6039 - DNA, 203 bp, Homo sapiens
ggcgcgccagtcctttgggtgaatgctgtttgtattgcactacagtattcgaaaccccattttatttcacaaggtcttgatgctgcgtggaataaatttgttttaggcgatgttgaaatttttgttgcatttgtttactatgttgcaagactaatgaaaggtgacaagggtgatgctgaagacactttcgactcggaccgatg

SEQ ID NO: 6040 - DNA, 203 bp, Homo sapiens
ggcgcgccagtccttaagtactattcacgtgttagaagtgttagaggtagagctattatagtcagtgtcgaacagcttgaaccgtgtgctcagtctagacttttgagtggtgttgcttatactgctttttctggacctgttgacaaaggtcattatactgtttatgatactgcaaagaaatcaatgtacgactcggaccgatg

SEQ ID NO: 6041 - DNA, 203 bp, Homo sapiens
ggcgcgccagtcctgcttgctaagtttacgaaactactgttactcatatatacattgtactcagtagttttgctttgtgtacgttttggaccgtttaatttttgtagtgagactgttaatggttatgctaagtcaaactttgtcaaggatgattactgtgatggttcattgggctgcaagatgtgtctcgactcggaccgatg

SEQ ID NO: 6042 - DNA, 203 bp, Homo sapiens
ggcgcgccagtcctttttggttaccaagagttaagtcaatttagccatttggatgttgtgtggaagcatataacagaccctttgtttagtaatatgcaacctttcattgtcatggttttgctgcttatatttggtgacaattatttgagatgcttcttgctgtattttgttgctcagatgataagcaccgactcggaccgatg

SEQ ID NO: 6043 - DNA, 203 bp, Homo sapiens
ggcgcgccagtccttagacttaagagattccctgttaacacaattgtcaatggtgtgcaacgttcattttatgttaatgcaaatggtggtagtaagttttgtaagaaacatagatttttctgtgttgattgtgactcttatggttatggcagcacgtttataacacccgaagtttctagagaacttggcgactcggaccgatg

SEQ ID NO: 6044 - DNA, 203 bp, Homo sapiens
ggcgcgccagtcctttgtactagattagaaggtttgggtggtaacaatgtttattgttataacacagcgcttatggaaggttctttgccttacagttcaatacaagctaatgcatattataaatatgacaatggcaattttattaagttgccagaagttattgcacaaggctttggttttagaacagtcgactcggaccgatg

SEQ ID NO: 6045 - DNA, 203 bp, Homo sapiens
ggcgcgccagtcctctatagtggtaatgcaaatgaagctgattaccgttgcgcttgttatgcctatttagcaaaagcaatgttggacttttcgcgtgatcataatgacatcttgtacacacctccgactgtcagttatggttctacattacaggctggtttgcgcaaaatggcacaaccatctggcttcgactcggaccgatg

SEQ ID NO: 6046 - DNA, 203 bp, Homo sapiens
ggcgcgccagtcctcatgagaactaattggactatccgtggttcatttattaatggtgcgtgtggttcccctggctacaatcttaaaaatggcgaggtggaatttgtttatatgcatcaaattgaactcggaagtggtagccatgtaggttctagctttgatggtgttatgtatggtggttttgaagacgactcggaccgatg

SEQ ID NO: 6047 - DNA, 203 bp, Homo sapiens
ggcgcgccagtcctacataaggttttgtttttgcaagtgtttttgttgccttcaattattgtggctgctattcaaaactgtgcttgggactaccatgttacaaaggtgttggcagagaagtttgattataatgtttctgttatgcaaatggacatccagggttttgttaacatttttatttgtcttttcgactcggaccgatg

SEQ ID NO: 6048 - DNA, 203 bp, Homo sapiens
ggcgcgccagtccttgttgcactgttgcatacttggcgctttgctaaagagcgttgtacacattggtgcacttatttgttctcactcattgctgttttatacactgcattgtatagttatgactacgttagtttgctggttatgctactttgtgcaatttctaatgaatggtatattggtgctattatcgactcggaccgatg

SEQ ID NO: 6049 - DNA, 203 bp, Homo sapiens
ggcgcgccagtcctcgttctaatgggcattttgtctaacatgaacatagcttctaattcaaaggagtgggcatattgtgttgaaatgcacaataaaataaacttgtgtgacgaccctgaaactgctcaagagttattgctggcgttgttggcctttttcttgtctaagcatagtgattttggtcttggcgactcggaccgatg

SEQ ID NO: 6050 - DNA, 203 bp, Homo sapiens
ggcgcgccagtccttagtgaaggtaatgctctatacaacaatgaaggtggacgtgcattcatgtatgcatatgtgactacgaagcctggcatgaagtatgttaaatgggaacatgactctggtgtggttacagttgaattggaaccaccttgcagatttgttatagacacacctactggaccccaaatcgactcggaccgatg

SEQ ID NO: 6051 - DNA, 203 bp, Homo sapiens
ggcgcgccagtccttaagtatctttattttgttaagaatcttaacaatttaaggagaggtgctgttttgggttacattggtgccactgtgagattgcaagctggcaaacagactgagtttgtttcaaactcccatttattaacacattgttcttttgctgttgacccagctgcagcctatcttgatgccgactcggaccgatg

SEQ ID NO: 6052 - DNA, 203 bp, Homo sapiens
ggcgcgccagtccttgttaaacaaggcgcaaaacctgttggcaattgtgtaaagatgttgactaatggttctggtagcggtcaggctattacttgtaccattgattccaacactacgcaggacacatatggtggcgcgtctgtttgtatttattgcagagcacatgttgcacatccaaccatggacggcgactcggaccgatg

SEQ ID NO: 6053 - DNA, 203 bp, Homo sapiens
ggcgcgccagtccttgtttagctagtgagtgctttatgaaaagtgacatctttggtcaagacttcaaaacttttgatttgttgaaatatgatttcacagaacataaggaggttttgtttaacaagtactttaagtattggggacaggattatcatcctgattgtgttgattgccatgacgagatgtgtcgactcggaccgatg

SEQ ID NO: 6054 - DNA, 203 bp, Homo sapiens
ggcgcgccagtcctgggtgggataatatgttaaagaacctgatggccgatgttgatgatcctaaattgatgggatgggactatcctaagtgtgatagagctatgccctcaatgattcgtatgttgtcggctatgatcttaggttctaagcatgtcacatgttgtacggctagtgataaattttatagacgactcggaccgatg

SEQ ID NO: 6055 - DNA, 203 bp, Homo sapiens
ggcgcgccagtcctctaccatatccagatcctagccgtattatttctgctggtgtttttgtggatgacatcactaagactgatgctgtcattcttttggaacgctatgtttctctggctatagatgcctacccattgtctaagcatcctaaacctgagtacaggaaggtgttttacgcattgttagaccgactcggaccgatg

SEQ ID NO: 6056 - DNA, 203 bp, Homo sapiens
ggcgcgccagtccttgggtcaaacatctcaacaagactcttaacgaaggtgttttggagtctttttctgttacacttttagatgaacatgagtctaagttttgggatgaaagcttttatgctagtatgtatgagaagtctacagtattacaagctgctggtctttgtgtagtatgtggttctcaaacacgactcggaccgatg

SEQ ID NO: 6057 - DNA, 203 bp, Homo sapiens
ggcgcgccagtcctgttctaagatgcggtgattgtttacgcagaccgatgttgtgcactaagtgcgcctatgatcatgtgtttggcactgatcataagttcattttagctattacaccatatgtgtgtaacacatctggctgcaatgtaaatgacgttacaaaactgtatcttggaggtttgaattatcgactcggaccgatg

SEQ ID NO: 6058 - DNA, 203 bp, Homo sapiens
ggcgcgccagtcctgagaaatattctaccatttacaagttgcacccatcatttaatgttagtgatgcttatgcaaatcttgtaccttattaccaacttattggcaaacagcgtataaccacaatacagggtcctcctggtagtggaaaatcgcattgttctattggtattggtgtgtattaccctggacgactcggaccgatg

SEQ ID NO: 6059 - DNA, 203 bp, Homo sapiens
ggcgcgccagtcctgaaccaattgactataatgttgtgacacaacgtatgtgtgctataggacccgatgtctttttacacaagtgttacagatgtcctgctgaaatagttaacactgtttcagagcttgtttatgaaaacaagtttgtacctgtcaaagaagctagtaagcagtgcttcaaaatctttcgactcggaccgatg

SEQ ID NO: 6060 - DNA, 203 bp, Homo sapiens
ggcgcgccagtcctgaacgcggtagtgttcaggtagacaatggctccagtataaataggcgtcaacttgatgttgttaagcgatttatacataaaaactccacatggagcaaggctgtgtttatctcaccttacaatagtcaaaattatgtagctgccaggcttttaggcttacaaactcagacagtgcgactcggaccgatg

SEQ ID NO: 6061 - DNA, 203 bp, Homo sapiens
ggcgcgccagtcctgtgatttcatatatgggtttcaggtttgatgttagcatgcctggtagtcatagtttgttctgtactagagactttgccatgcgtcatgtcagaggttggttaggaatggatgtggaaggtgcacatgtcacaggtgacaatgttggcactaatgtacctctacaagttggttttcgactcggaccgatg

SEQ ID NO: 6062 - DNA, 203 bp, Homo sapiens
ggcgcgccagtcctgttaagaatgtggattggtcaattacctaccctatgatagctaatgaaaatgccataaacaagggcggtcgcactgtgcagagtcatattatgcgtgctgctattaaattgtacaaccctaaagcaatccatgacattggtaatcctaagggtattcgttgtgctgtaactgatcgactcggaccgatg

SEQ ID NO: 6063 - DNA, 203 bp, Homo sapiens
ggcgcgccagtcctcaaggtttagagaacattgcttttaacgttgttaataaaggttcatttgttggtgctgatggtgaattaccagtagccattagtggtgataaagtgttcgtacgtgatggtaacactgataatttagtctttgttaacaaaacatcactgcctacaaacatagcatttgaacttcgactcggaccgatg

SEQ ID NO: 6064 - DNA, 203 bp, Homo sapiens
ggcgcgccagtccttctaagactgtttgtacttacatggatttgttgttggatgattttgtttctgtattgaagtctttggatttgactgttgtatccaaggttcatgaggtcataattgacaacaaaccatggagatggatgctatggtgtaaagataatgccgttgctacattctatcctcagttgcgactcggaccgatg

SEQ ID NO: 6065 - DNA, 203 bp, Homo sapiens
ggcgcgccagtcctagctggaataagaaattgtatgaacttgtacaaagattttctttttggactatgttttgcacttctgttaatacgtcatcatcagaagcctttgttgtcggaattaactatcttggtgatttcgcacaaggaccttttatagatggtaacataatacacgcaaattatgtatttcgactcggaccgatg

SEQ ID NO: 6066 - DNA, 203 bp, Homo sapiens
ggcgcgccagtcctttgagttttagtaatcatttagtctcaactaaataaaatgtttgttttgcttgttgcatatgccttgttgcatattgctggttgtcaaactacaaatgggctgaacactagttactctgtttgcaacggctgtgttggttattcagaaaatgtatttgctgttgagagtggtggcgactcggaccgatg

SEQ ID NO: 6067 - DNA, 203 bp, Homo sapiens
ggcgcgccagtcctaagccctattcaatccgttgagctacctgtgtctattgtgtcgctacctgtttatcataaacatacgtttattgtgttgtacgttgacttcaaacctcagagtggcggtggcaagtgctttaactgttatcctgctggtgttaatattacactggccaattttaatgaaactaacgactcggaccgatg

SEQ ID NO: 6068 - DNA, 203 bp, Homo sapiens
ggcgcgccagtcctagggcctttgtgtgttgacacatcacacttcactaccaaatacgttgctgtttatgccaatgttggtaggtggagtgctagtattaacacgggaaattgccctttttcttttggcaaagttaataactttgttaaatttggcagtgtatgtttttcgctaaaggatatacccggcgactcggaccgatg

SEQ ID NO: 6069 - DNA, 203 bp, Homo sapiens
ggcgcgccagtccttacttctgcttgtaaaactattgaagacgccttaagaaatagcgccaggctggagtctgcagatgttagtgagatgctcacttttgacaagaaagcgtttacacttgctaatgttagtagttttggtgactacaaccttagcagcgtcatacctagcttgcccacaagtggtagcgactcggaccgatg

SEQ ID NO: 6070 - DNA, 203 bp, Homo sapiens
ggcgcgccagtccttagagtggctggtcgcagtgccatagaagacatactttttagcaaacttgttacttctggacttggcactgtggacgcagactacaaaaagtgcactaagggtctttccattgctgacttggcttgtgctcaatattataatggcattatggttttgcctggcgtcgctgatgccgactcggaccgatg

SEQ ID NO: 6071 - DNA, 203 bp, Homo sapiens
ggcgcgccagtcctagcaatgaccaacatagtagatgcctttactggtgttaatgatgctattacacaaacttcacaagccctacaaacagttgctactgcacttaacaagatccaggatgttgttaatcaacaaggcaactcattgaaccatttaacttctcagttgaggcagaattttcaagctatcgactcggaccgatg

SEQ ID NO: 6072 - DNA, 203 bp, Homo sapiens
ggcgcgccagtccttgtgttgcgacaacctaatcttgctctttacaaagaaggcaattattatagaatcacatctcgcataatgtttgaaccacgtattcctaccatggcagattttgttcaaattgaaaattgcaatgtcacatttgttaacatttctcgctctgagttgcaaaccattgtgccagacgactcggaccgatg

SEQ ID NO: 6073 - DNA, 203 bp, Homo sapiens
ggcgcgccagtccttttgtaatagaacagtttatggccccattaaaaatgtgtaccacatttaccaatcatatatgcacatagaccctttccctaaacgagttattgatttctaaactaaacgacaatgtcaaatgacaattgtacgggtgacattgtcacccatttgaagaattggaattttggttgcgactcggaccgatg

SEQ ID NO: 6074 - DNA, 203 bp, Homo sapiens
ggcgcgccagtcctgaatgttattctaaccatattcattgttattcttcagtttggacactataaatactccagattgttttatggtttgaagatgcttgtactgtggcttctttggccactcgtacttgctttgtcaatctttgacacctgggctaattgggattctaattgggcctttgttgcattcgactcggaccgatg

SEQ ID NO: 6075 - DNA, 203 bp, Homo sapiens
ggcgcgccagtccttagcttttttatggccgtatcaacactcgttatgtgggtgatgtacttcgcaaacagtttcagacttttccgacgtgctcgaactttttgggcatggaatcctgaggttaatgcaatcactgtcacaaccgtgttgggacagacatactatcaacccattcaacaagctccaaccgactcggaccgatg

SEQ ID NO: 6076 - DNA, 203 bp, Homo sapiens
ggcgcgccagtcctcaggcaacactgtggtcttgactttcactactagagtgactgtgcccaaagaccatccacacttgggtaagtttcttgaggagttaaatgcattcactagagaaatgcaacaacatcctcttcttaaccctagtgcactagaattcaacccatctcaaacttcacctgcaactgcgactcggaccgatg

SEQ ID NO: 6077 - DNA, 203 bp, Homo sapiens
ggcgcgccagtcctagcgcagttttgcgaggtgaccaaaaggataggtagggtgacaggtagtgacggaaagctttaccatatatatgtgtgcatcgatggttgcatactgctgaagctagccaagagggacgagccaagaaccctgaagtggattagaaatttcaccgactgtccattgtgggttaccgactcggaccgatg

SEQ ID NO: 6078 - DNA, 203 bp, Homo sapiens
ggcgcgccagtcctcagttgctctgatgatggcgcaagtggaagtaaagagaagaagccagataggatcaacaaaggcaaattaaaaatagccccaaaagagcatgagaaggacagcagaactaagccacctgacgctacgattgtagtggaaggagtaaaataccaggttaaaaagaagggtaaagtcgactcggaccgatg

SEQ ID NO: 6079 - DNA, 203 bp, Homo sapiens
ggcgcgccagtccttaaaggaaagagtacccaagacggcctgtaccacaacaagaataaaccaccagaatctaggaagaaattagaaaaagccctattggcatgggcggtaatagcaattatgttgtaccaaccagttgaagccgaaaatataactcaatggaacctgagtgacaacggcactaatggcgactcggaccgatg

SEQ ID NO: 6080 - DNA, 203 bp, Homo sapiens
ggcgcgccagtccttatccagcatgctatgtaccttagaggggttagcaggagcttgcatgggatctggccggaaaaaatatgcaaaggagtccccacctacctggccacagacacggaactgaaagaaatacagggaatgatggatgccagcgaggggacaaactatacgtgctgtaagttacagagcgactcggaccgatg

SEQ ID NO: 6081 - DNA, 203 bp, Homo sapiens
ggcgcgccagtccttttgttatttgaagaggcaggacaggtcgtaaaattagccttacgagcgctgagggatttaaccagggtctggaatagcgcatcaaccacggcattcctcatctgcttgataaaagtattaagaggacagatcgtgcaaggtgtgatatggctgctactagtaactggggcacacgactcggaccgatg

SEQ ID NO: 6082 - DNA, 203 bp, Homo sapiens
ggcgcgccagtcctaaatggagatttattctactgtaagttggggggcaactggacatgtgtgaaaggtgaaccagtggtctacacgggggggctagtaaaacaatgcagatggtgtggcttcgacttcaatgagcccgacggactcccgcactaccccataggtaagtgcatcttggtaaatgagaccgactcggaccgatg

SEQ ID NO: 6083 - DNA, 203 bp, Homo sapiens
ggcgcgccagtcctaggttacagaatagtagattcaacggactgtaacagagatggcgttgtaatcagcacagatgggagtcatgagtgcttgatcggtaacacaactgtcaaggtgcatgcatcagatgaaagactgggccctatgccatgcagacccaaagagattgtctctagtgcaggacctgtcgactcggaccgatg

SEQ ID NO: 6084 - DNA, 203 bp, Homo sapiens
ggcgcgccagtcctggtagcactgttaggaggaagatatgtcctgtggctaatagtgacctacatagttctaacagaacaactcgccgctggtttaccattgggccagggtgaggtagtgttgatagggaacttaattacccacacagacattgaggtcgtagtatatttcttactactctatttggtcgactcggaccgatg

SEQ ID NO: 6085 - DNA, 203 bp, Homo sapiens
ggcgcgccagtcctgaccaacttcaagagggtaaacgacatatacgaagttgaccaatctggtgaaggggtttaccttttcccgtcaaaacaaaagacaagttcaataacaggtaccatgttgccattgatcaaagccatactcatcagctgcatcagtaataagtggcagttcatatatctattgtacgactcggaccgatg

SEQ ID NO: 6086 - DNA, 203 bp, Homo sapiens
ggcgcgccagtcctaagggtcgtttgccaatcaaataataagatgacagatgagtctgagtatggagttaaaactgactccggatgcccggaaggagctaggtgttatgtgttcaacccagaggcagttaacatatcagggactaaaggagccatggtccacttacaaaaaactggaggagaattcaccgactcggaccgatg

SEQ ID NO: 6087 - DNA, 203 bp, Homo sapiens
ggcgcgccagtcctctttagagagatgaactatgattggagcctttatgaggaggacagtctgatgattacacaattggaaatcctcaataatttgttgatatcagaagaactaccgatggcagtaaaaaatataatggccaggactgaccacccagaaccaattcagctggcgtacaacagctacgacgactcggaccgatg

SEQ ID NO: 6088 - DNA, 203 bp, Homo sapiens
ggcgcgccagtcctaacacaagtgccagtgctattcccaaaaataaagaatggagaggtgactgatagttacgataactataccttcctcaacgcaagaaaattgggggatgatgtacccccttacgtgtatgccacagaggatgaggacttagcggtagagctactgggcttagactggccagaccccgactcggaccgatg

SEQ ID NO: 6089 - DNA, 203 bp, Homo sapiens
ggcgcgccagtcctagacaccacacacctacagtacgccccaaatgctatcaagacggaggggaaggagacagaattgaaggagctagcccagggggatgtgcagagatgtgtggaagctatgaccaattatgcaagagagggtatccaattcatgaagtctcaggcactgaaggtgaaagaaacccccgactcggaccgatg

SEQ ID NO: 6090 - DNA, 203 bp, Homo sapiens
ggcgcgccagtcctatacaaaagctggaattacaataatctgtccaagatagttgaaccggctttggccactctgccctatgccgccacagctctcaaactattcgcccccactcgattggagagcgttgtcatattgagtaccgcaatctacaagacctacctatcaatcaggcgcggaaaaagcgacgactcggaccgatg

SEQ ID NO: 6091 - DNA, 203 bp, Homo sapiens
ggcgcgccagtcctgaactacagggtgacaaaatactatgatgacaatctatcagaaataaagccagtgataagaatggaagggcatgtggaactctactacaagggagccaccatcaaactggacttcaacaacagtaaaacaatactggcaaccgataaatgggagattgatcactccactctggtcgactcggaccgatg

SEQ ID NO: 6092 - DNA, 203 bp, Homo sapiens
ggcgcgccagtcctttgggtgatgcaagaagaaaataaacagggcaacctgacccccttgtttgaagagctcctgcaacagtgtccacccggaggccagaacaaaactgcacatatggtctctgcttaccaactagctcaagggaactggatgccaaccagctgccatgtttttatggggaccatatccgactcggaccgatg

SEQ ID NO: 6093 - DNA, 203 bp, Homo sapiens
ggcgcgccagtcctggattcagagaaaaacaaagtcgaagagattattgacaatctgaaaaaaggcagaaacatcaaatactatgaaaccgcgatcccaaagaatgagaagagggacgtcaatgatgactggactgctggtgacttcgtggaagagaagaaacccagagtcatacaataccctgaagccgactcggaccgatg

SEQ ID NO: 6094 - DNA, 203 bp, Homo sapiens
ggcgcgccagtcctcacccaggtaaccacaaaagatttggagttgataaaggacatacaaaagtactatttcaagaagaaatggcataaatttattgacaccctgaccatgcacatgtcagaagtacccgtaatcagtgctgatggggaagtatacataaggaaagggcaaagaggcagtggacaacccgactcggaccgatg

SEQ ID NO: 6095 - DNA, 203 bp, Homo sapiens
ggcgcgccagtccttaaaatggccacaaggttagattccagtggtgagaggggtaccatagcatatgagaaagcagtagcattcagcttcctgctgatgtactcctggaacccactaatcagaaggatctgcttactggtgctatcaactgaactgcaagtgaaaccagggaagtcaaccacttactacgactcggaccgatg

SEQ ID NO: 6096 - DNA, 203 bp, Homo sapiens
ggcgcgccagtccttaaatacgtccaacaaaagagagtcaatccgttctttgctctaactcagcaatggctaacagaaatgaggaatctgctctcccagagtctatcagtaaggaagttcatggttgagatcctcatagaagtcaagaaaggaggatctgctaaaggcagagcagtagaaataatctccgactcggaccgatg

SEQ ID NO: 6097 - DNA, 203 bp, Homo sapiens
ggcgcgccagtcctccatgctggaggaattgatcagaacatggcaaatagactgggactaagttcagatcaagttgcagaactcgctgctgcagttcaggaaacatcagcaggaaggcaagagagtaatgttcaggctagagaggcaaaatttgctgcaggaggtgtgctcattggaggcagtgatcacgactcggaccgatg

SEQ ID NO: 6098 - DNA, 203 bp, Homo sapiens
ggcgcgccagtcctagatatcgatgaaggggaagaacctatagaacagagtggcagacagtcagttaccttcaaaagggagatgagtatttcatcccttgctaacagtgtgccgagcagttctgtgagcacatccggtgggaccagattgactaattcattactaaacctcagatcaagactggctgccgactcggaccgatg

SEQ ID NO: 6099 - DNA, 203 bp, Homo sapiens
ggcgcgccagtcctaaaagcagcaaaagaagccgcctcatccaatgcaacagatgatccagcaatcagcaacagaactcaaggggaatcagagaagaagaataatcaagacctcaaacctgctcaaaatgaccttgatttcgtcagagctgatgtgtgacgtctatttccaatattctacagtatccacgactcggaccgatg

SEQ ID NO: 6100 - DNA, 203 bp, Homo sapiens
ggcgcgccagtccttaatttaactaagctactgtctttgcactggaatatacaatacctcttacctcatttcttactttaatatcatgttatttttttgataagtcacttaacttgaccaaggtctaccaggtaatgctcgcacaagtgaactgcaatctcaacttagattaaacataatcatgcaaacgactcggaccgatg

SEQ ID NO: 6101 - DNA, 203 bp, Homo sapiens
ggcgcgccagtcctgactgaatcccacagcagtaccgttcactctgagaaacctgtctgatcctgcaaaagactctcctgtgattgctgaacactactacggactaggagttaaagagcaaaacgttggccctcagactagcagaaatgtcaatttggacagcatcaaattgtacacatcagatgacgcgactcggaccgatg

SEQ ID NO: 6102 - DNA, 203 bp, Homo sapiens
ggcgcgccagtcctacaaatcaacagatgtaccaggagcaggaccgaaagattcagcagtgaaggaagaaccaccccagaagaggctacctatgttagctgaagaatttgagtgctctggatcggaagacccaatcattcgggagctgctgaaggagaactcactcataaattgtcagcaagggaaagcgactcggaccgatg

SEQ ID NO: 6103 - DNA, 203 bp, Homo sapiens
ggcgcgccagtcctatgctcagcctccatatcattggagcatcgagaggtcaataagcccggataaaactgagatcgtcaacggtgctgtgcaaactgctgacaggcaaagaccaggaactccgatgccaaagtcccgaggtattcccattaaaaagggcacagacgcgaaatatccatctgctgggacgactcggaccgatg

SEQ ID NO: 6104 - DNA, 203 bp, Homo sapiens
ggcgcgccagtcctcggaaaacgtgcctgggtcgaagagtggtgcaacccggcatgttcgaggatcacccccctaccaagaaggcaagagtgtcaatgcggagaatgtccaactgaatgcttccactgcggttaaggaaactgataagtcagaagtaaaccccgtagacgacaacgactcacttgatgcgactcggaccgatg

SEQ ID NO: 6105 - DNA, 203 bp, Homo sapiens
ggcgcgccagtcctataaatacatcatgccttcagatgatttctcaaacactttcttcccgcacgacactgatcgcttgaattatcacgcagatcatttaggtgattatgaccttgaaaccctgtgtgaagagtcggttctaatgggagtgatcaactctataaaattaattaatctggatatgcgctcgactcggaccgatg

SEQ ID NO: 6106 - DNA, 203 bp, Homo sapiens
ggcgcgccagtcctgtaatatttgatcactgaattgtcagcagaaatacaatgatctaacaacaatctcccacaagtagacaatggtttcaggtcaataataacaacctcaatactaatctttcacataagcattactcattccagccctcagacgataacacaatacttgatacatgtttattgaagcgactcggaccgatg

SEQ ID NO: 6107 - DNA, 203 bp, Homo sapiens
ggcgcgccagtccttggtaagagtgcctctcatccccaagatcttctggaggaactctgttccctcaaagttactgtgagaagaacagctggatcaactgagaaaattgtgtttggatcatctggccctctaaatcacctcgttccgtggaagaaagtactgactagtggttcaatttttaatgcagtcgactcggaccgatg

SEQ ID NO: 6108 - DNA, 203 bp, Homo sapiens
ggcgcgccagtcctcataggcggactaagtctccacattaagatcaatggtgtaatcagcaaacggctgtttgctcaaatgggattccaaaaaaacctttgtttctctttgatggacatcaatccttggctcaacagattgacctggaacaacagttgtgagatcagccgagtagcagctgtgttgcacgactcggaccgatg

SEQ ID NO: 6109 - DNA, 203 bp, Homo sapiens
ggcgcgccagtcctaagacccagtttctaattcaatgactatacaggctatatctcaggcattcggtggaaattatgaaacactgctaagaacattgggttacgctacagaagactttgatgatcttctagaaagtgacagcataacaggtcaaatcatctatgttgatctaagtagctactatataacgactcggaccgatg

SEQ ID NO: 6110 - DNA, 203 bp, Homo sapiens
ggcgcgccagtcctcacaaaaaacaataactaattgttttctcttgaagaataagatttggtgcatatcattggttgagatatatgacacaggagacaatgtcataagacccaaactattcgcggttaagataccagagcaatgtacataaaaatcaacctcataatttaatggattgatctaatatacgactcggaccgatg

SEQ ID NO: 6111 - DNA, 203 bp, Homo sapiens
ggcgcgccagtccttacacatgcgagacaaaagtactgaaataatcctaaatccgaatcttatctgcattttcaaatcagacaaaactggaaagaagtgttattatcttacacccgaaatggttctaatgtattgtgatgtcctagagggaaggatgatgatggagacaacagtcaaatcggatatcacgactcggaccgatg

SEQ ID NO: 6112 - DNA, 203 bp, Homo sapiens
ggcgcgccagtcctgcataaaggaaatgcatcaagaattgagtgagtgtggttttacagatcagaagattcggtctatgtttattgatgatcttttatccattctaaatatcgataatatacatctgttggcagagttcttttctttctttcgtacgtttggccatcctattcttgaggctaaagttgcgactcggaccgatg

SEQ ID NO: 6113 - DNA, 203 bp, Homo sapiens
ggcgcgccagtcctctgcagaaaaagtgagagaacatatgttggcagataaagttcttgaatatgcccctataatgaaagcacatgctatattctgcgggactataataaatgggtatagggatagacacggaggagcctggcctcctctttacctccccgcacatgcatctaaacatataatccgttcgactcggaccgatg

SEQ ID NO: 6114 - DNA, 203 bp, Homo sapiens
ggcgcgccagtcctgtgaagtgttgagctataccccaccgaagtcaaccgagccaagaagattggttgacgtttttgtaaatgatgaaaactttgatccatacaacatgctggaatatgtcttatccggtgcttatctcgaggatgaacaattcaatgtttcttatagcttgaaggagaaagagacgacgactcggaccgatg

SEQ ID NO: 6115 - DNA, 203 bp, Homo sapiens
ggcgcgccagtcctagcaagctggacgattgttcgcaaagatgacctacaaaatgcgtgcatgtcaagtcatagcagaggccctgatagcctcaggtgtcggtaaatattttaaggagaacgggatggttaaggatgagcacgaacttttgaagacactcttccaattgtctatttcctcagttcctccgactcggaccgatg

SEQ ID NO: 6116 - DNA, 203 bp, Homo sapiens
ggcgcgccagtcctctgatcttaagaaattctgtctcaattggagatacgaatcaatggctatatttgctgaacgtctggatgagatatacggtttacctggattttttaattggatgcacaaacgactagaaagatctgttatctatgttgcagaccctaattgcccccctaatattgacaaacatacgactcggaccgatg

SEQ ID NO: 6117 - DNA, 203 bp, Homo sapiens
ggcgcgccagtcctctatcactcaaaaagttcatcctaatcttccctacaaggtaaagaaagagatctgtgcaaagcaagctcagctttattttgaaaggttaaggatgaacttaagagccctcggccacaatcttaaagctacagaaactatcatcagtacacatctttttatttattcgaagaaaacgactcggaccgatg

SEQ ID NO: 6118 - DNA, 203 bp, Homo sapiens
ggcgcgccagtcctttcattatgatggtgctgtgctgtctcaggcactcaaatcaatgtcaagatgttgcttttggtcagagactctggtggatgaaactagatcagcttgtagtaacatcagcactacaatagctaaagctatagaaaatgggttgtcaagaaatgtcggctattgcatcaatatttcgactcggaccgatg

SEQ ID NO: 6119 - DNA, 203 bp, Homo sapiens
ggcgcgccagtcctatataggtgatccggttacagcatctttggctgatcttaagagaatgattgatcacagtattatgactgaaagcgtattacaaaaagttatgaatcaagaacctggtgatgcgagtttcttggactgggccagtgatccatactcgggcaacttgcctgactcacaaagcatcacgactcggaccgatg

SEQ ID NO: 6120 - DNA, 203 bp, Homo sapiens
ggcgcgccagtccttgatatcatcaaatacttgctcagttgacttggcacgagcattgagatctcacatgtggagggaattagcgttaggtagagtaatatacggtcttgaggtaccagatgcacttgaggctatggtgggaaggtatataacagggagcttagagtgccaaatttgtgagcagggaacgactcggaccgatg

SEQ ID NO: 6121 - DNA, 203 bp, Homo sapiens
ggcgcgccagtcctacacgatgtatgggtggttctttgtacctagggattcccaattggatcaggtagatagagagcactcatcaataagagtaccttatgtaggatcaagtacggatgaaagatcggatatcaaactagggaatgtcaaaagaccaactaaggccttgcgttctgctatcagaattgcgactcggaccgatg

SEQ ID NO: 6122 - DNA, 203 bp, Homo sapiens
ggcgcgccagtcctagtccaaatcaagagaattagactttcctttatggtcaactgaggaacttcatgatgtcctagctaagactgttgctcagaccgttcttgagattataacaaaggctgacaaggatgttttaaagcaacaccttgcaatagactctgacgataacatcaacagcttaatcacagcgactcggaccgatg

SEQ ID NO: 6123 - DNA, 203 bp, Homo sapiens
ggcgcgccagtcctaggtgaataggaaagttgaatacccatatcacactataggagtttcaggaaatgttgttactaatacagatattgtttatacaggatatgcagacgtcttcaagtgtgaacagtgtgatttgctgatgggtgcttgggcaccaaacgacattccagcactgacgcacaatattccgactcggaccgatg

SEQ ID NO: 6124 - DNA, 203 bp, Homo sapiens
ggcgcgccagtcctgagcatcacagtgtgtccagtttaagctccccacagaaaatttagtggcacgtaattatgtgttgttgtgtgaggaaattgagcgagaaaatattcctgtaattttccaggattatagtgaagggaatgtctttacgtgtcggattgttagtggagatctaactgctgttggtacgactcggaccgatg

SEQ ID NO: 6125 - DNA, 203 bp, Homo sapiens
ggcgcgccagtcctcagcatccaatatgtatacagctcgagatgtagcgtctaaaaatttgttagatcagctacataacacccccaatgtgcacatgcactctctgcattccctcccgtatgagaatttcccttgtgaagctctggaatttgcagttgagcaaggtattatcccccctgtgacctttgcgactcggaccgatg

SEQ ID NO: 6126 - DNA, 203 bp, Homo sapiens
ggcgcgccagtccttcccccggagatcaggtgaaacgctagagttggctaatgccacattgaaccatgtgaataatgtgattgaccgacacgatgaagcaataagtaatgtcaggcaaaatgttgaagtgaagttgacgggtgtgtcccgacaagttggtgctatgttgccgaaagtagaaactgctacgactcggaccgatg

SEQ ID NO: 6127 - DNA, 203 bp, Homo sapiens
ggcgcgccagtccttatatgagtctataggaacaggcttatgcgtagcgttgtctggtatattgtcatttatagcagtcatgtgtcttggaatcactgatttatctgctgttacattcaataagctgctcacgcagtcttcattggttggacgagctttagtcggtgtgcgtagcttcaaagatgtttcgactcggaccgatg

SEQ ID NO: 6128 - DNA, 203 bp, Homo sapiens
ggcgcgccagtccttttttggcatctgggattatgtagacaatcaagtgtgtgaaattctttacgggaagagtcgcaagaacttggatttgttgaaagaatatccgagtttggactcgttgttgtccatcttcaactactttcacgacacggtagatgctaatgtgctcattagttgtaaccgtgcagcgactcggaccgatg

SEQ ID NO: 6129 - DNA, 203 bp, Homo sapiens
ggcgcgccagtccttagcttatgatgatgtattgcagatagtggattcggcccaaaagccaaatcctgagttattcgaatttattaggttgaacaacagtgatccatatcaagtacatatgtccagtgtcagggataaggcaaatacattcatagcaccatcttttgtttttgcaacctcaaacgtaacgactcggaccgatg

SEQ ID NO: 6130 - DNA, 203 bp, Homo sapiens
ggcgcgccagtcctatccaggcgcgtatgtccccaagtctattcatagtgcagatgcattcagacggcgtttagatctatgcgtttatgtagatgttaaagatgagtttgcacgcatcgtagctggatctaagggtcatcgtaaggtcccttgtgaacagaagatatggctccatcagaatccaggaacgactcggaccgatg

SEQ ID NO: 6131 - DNA, 203 bp, Homo sapiens
ggcgcgccagtcctagacgcagcaagacatgaagcaggaaattattgcaggaacatacaagatcactccggagacagctgtgtatgagttgcatgttgacactacgttagcaggcaatgctcagtctaaagtctgtgcttatgatggtttggtgtcactaattgaacaggtgaggaaattgcgtgttgcgactcggaccgatg

SEQ ID NO: 6132 - DNA, 203 bp, Homo sapiens
ggcgcgccagtccttggaagctcattttgtctcgcggagtgcgaacgatggaagcatgttcatcccagccagtgaggttgctgatttgttgtgtcagagacataacaatacgaatttgaatgaggaactggtgtatttgacgtggatgacgcagatcacagataaggagttagcctcgagtttagtatcgactcggaccgatg

SEQ ID NO: 6133 - DNA, 203 bp, Homo sapiens
ggcgcgccagtcctatttcacaaataacggaatggataagtcaatttggaaacagagcgccgagcgttcagcacaggccattagtcagtgtaagaatgcttggacgcgcataaacgatttcttgaagaatcattggatttccatatctgccgttataggatcagctctcctaatagggggagtgtcgacgactcggaccgatg

SEQ ID NO: 6134 - DNA, 203 bp, Homo sapiens
ggcgcgccagtcctcacccaatccaacaaaatctgaaattactcggagtcctatccatggatgtttccccgttcttacagcccccgctaccttgtatagcccaacagagaacttattaatcaagaacgcaatgaaagtaacaaagaatgtggagttgctggaagaagacctaattgatgcctgtgttccgactcggaccgatg

SEQ ID NO: 6135 - DNA, 203 bp, Homo sapiens
ggcgcgccagtcctaggtgattgctggtgatttctcgaattttgatggttcattgaattctcagattttatcacgagtatctgaaattgtcactgattggtatggagatgatgcagaaaatggtctgatcagacatacactacttgagtacttgtttaatgccacctggcttatgaatggtaaggtttcgactcggaccgatg

SEQ ID NO: 6136 - DNA, 203 bp, Homo sapiens
ggcgcgccagtccttccaactcaaccattctcagccttccggcaatccattaactactctcatcaactgtgtatataacatgatcatttttagatatgtctaccttctagctcagcgagaaaacgggtttcccatgacgctctctggatttactacaaacgtagcttgcattttctatggtgacgattcgactcggaccgatg

SEQ ID NO: 6137 - DNA, 203 bp, Homo sapiens
ggcgcgccagtccttcgaaaactctccgaacactaggtgcagtaaggctttcatggagtggtttgctatttagcgtacgtgtaccataggcagccccaaaaacacgtgtgaggagaaagtcccagtcactttgggcaaagtagacagccgcgcttgcgtggtgggacttaattaatgcctgctaaccccgactcggaccgatg

SEQ ID NO: 6138 - DNA, 203 bp, Homo sapiens
ggcgcgccagtcctagttgaaattgataattttgatacaacaaccagtggaggactaattccaggaggtagtgttacaaacagtgaaggttctacaatcttgatgaatgatatcccaatcactaatcagaatgtagtgctgtctaagaatgtaacagataacctgtttgaagtccaggaccaagctctcgactcggaccgatg

SEQ ID NO: 6139 - DNA, 203 bp, Homo sapiens
ggcgcgccagtccttggcaggttgaaaaacatcaagctatatgggcatgcgccatctgtgacatcttcagtatatccgtctactcagtccggatatgatgatgattgtcccattgtgcatgcgggaactgatgaggattcttctaaacaggggattgtctcaagggttgcagacaccgttggtgcggtcgactcggaccgatg

SEQ ID NO: 6140 - DNA, 203 bp, Homo sapiens
ggcgcgccagtccttgttggcttcgattatggcgtacccctgtctcttttccctaacaatgccattgatcccacaattgcagtgcctgaaggattggatgagatgtctattgaatacttagcacagcgaccatatatgctcaacagatacactatcagaggtggtgacactcctgatgcgcatggaaccgactcggaccgatg

SEQ ID NO: 6141 - DNA, 203 bp, Homo sapiens
ggcgcgccagtcctcagattgctggtgcaatatctcccctatggtagtggtgttcaaccaatagaaagtatcctttcacagatcatcgacatctcacaagtcgatgataagggtattgacattgcttttccttccgtctatcccaataagtggatgcgagtgtacgatccagcgaaagttgggtacaccgactcggaccgatg

SEQ ID NO: 6142 - DNA, 203 bp, Homo sapiens
ggcgcgccagtcctgttagtaacatgtggtagtatggcagcgattggtgaagctacggtcgcattgcaattcgtggacgagacaattgaaattctgagattagagtcagattttgagtccaaagctccagtgaaatttactccaggtaactataccgtggtcactgaagctagtgatgttgaattggtcgactcggaccgatg

SEQ ID NO: 6143 - DNA, 203 bp, Homo sapiens
ggcgcgccagtcctatatccatccacacatgctggtctggactactccagctcagacacatctacaatgttgactacaatgggtgaacagtttgtctctctcagaatgttaactagacgttccagtcccgttgacattcttagaggcgatttggttactttgcccggaatttcctttggcacagataacgactcggaccgatg

SEQ ID NO: 6144 - DNA, 203 bp, Homo sapiens
ggcgcgccagtcctgcattatattaacacatccctgaaccctatggctcaaattagcttgccttattatagtccagcagaaaatttagttattgattccaagtctttccctcaattaagtgatttatcaattagtaatttggaaaggacggaaaatgagtactttgtgcttgcaagtgctggtgatgacgactcggaccgatg

SEQ ID NO: 6145 - DNA, 203 bp, Homo sapiens
ggcgcgccagtcctccacactttctctcaattggcaggatgtccagctttcacttttggacctgccgaattggcttaatttaacacccttcaggtgtagacccgtcattgtgacgcgtgggttgaggtgccatgaatttgtcattcatggtgcatttatctcaacagttttccctaaccgcgcgttgccgactcggaccgatg

SEQ ID NO: 6146 - DNA, 203 bp, Homo sapiens
ggcgcgccagtccttatccccttgatgcaactgaggttttaacatctcattgtttttgagccccaacgccttggtggatgctcaaagaagattactcttgatgcttggctctcagaaagaatggcacctcaaagttttgagacccgattcttttgagtcgagaaccttacccccaacccttgagattgcgactcggaccgatg

SEQ ID NO: 6147 - DNA, 203 bp, Homo sapiens
ggcgcgccagtcctcttttcttccaactaaacccctattgatgtgttggtcgtttgccaatcggagggcgacaggcgcaggtcgccccaacagctagtattgtgggaacttgccactgctgatgaaacgaggtagtggcatttagtacctgagaacgctggaggagcatctccccctcttccttcattcgactcggaccgatg

SEQ ID NO: 6148 - DNA, 203 bp, Homo sapiens
ggcgcgccagtcctgccgagctcttcctcggtcttgttctgaatgcacacatgtctaggggctaaggatgtcctacaggtacccgcacgtaaccttcagagagtgtggatctgagtaggagactgtggtgcgctgctttacagacgtagcccagtttaaaaaacgtctatgcccctacagggtcgcggcgactcggaccgatg

SEQ ID NO: 6149 - DNA, 203 bp, Homo sapiens
ggcgcgccagtccttgggccgcaccctttccttttacaaacttggttttatggtgacaatggcaggcaacatggtcaacaacttgttcgctctcgctactgaagtgtgttctccaaaacagggtcctctcctcgacacagagatgcccttgcctcttgaattggctgaatttcccaatcagtctgacacgactcggaccgatg

SEQ ID NO: 6150 - DNA, 203 bp, Homo sapiens
ggcgcgccagtcctttgatgatgataggatgtacttgtcagggcctcctacccgagtcaaaatggcttcttcataccacatgcctcaatgggttgagtcttttgctcgtttttgcttggaactccaccccgtccaacacaggcgtaccttggcccagtcactccgtgactcacaatgtcgtggagctgcgactcggaccgatg

SEQ ID NO: 6151 - DNA, 203 bp, Homo sapiens
ggcgcgccagtcctgtcactcgcgcccggaggcaggtcacaacaatgaatcaggcaattctggtacaatcgtgaacaactattatatgcaacactaccaaaattccattgaccttgatggcatttcctctcaaaacattggcgaggctggagctggaaccaaccctttttcatccatactcgacgtgccgactcggaccgatg

SEQ ID NO: 6152 - DNA, 203 bp, Homo sapiens
ggcgcgccagtcctacgatgcactcccgcgccacctgccacctcagcagcttactctctacccacaccagtttctcaacttgcggactaacactactgttgacattgaggtcccctacatgaattttgtgcctgcttctgctccagtaatgcattgtccttggacccttttgatcatggtcatttcaccgactcggaccgatg

SEQ ID NO: 6153 - DNA, 203 bp, Homo sapiens
ggcgcgccagtcctcactccgctacggggctgggtcagcccctgatgtacagttaaccatgaccataacccccaccgattttgttgccaacggcctgagacagaccgtatctgagggtataccgggcacccagccctacgacaggcagttcctgtccacagagccctcagctccccctcccctctatacgactcggaccgatg

SEQ ID NO: 6154 - DNA, 203 bp, Homo sapiens
ggcgcgccagtcctcaccatcttggctgccagaccgaagcttcattcccggcaagtttactgactttttgcaggttgccgtcatcccaaccatggccgaggtttctgtgggcaccaaccacaaacccatccccagtttttctgttggcaatacattggaggaccggccgttgttgaacactgatttaacgactcggaccgatg

SEQ ID NO: 6155 - DNA, 203 bp, Homo sapiens
ggcgcgccagtcctctttcacctccatgacatttcggaacacttacctgtctgctttggctctcaattacacccagtacagaggtagtatttgtgtggactttttgtttacaggcactgccatggcccaagggaaatttgttgttgcttacacgcctcctgggcgtgaacccaaaacattggatgaagcgactcggaccgatg

SEQ ID NO: 6156 - DNA, 203 bp, Homo sapiens
ggcgcgccagtcctccatgcagggcacatatgccatatgggatcttggcttgaattctagctttaaatttgttataccttacatttcagcttcggcttaccgattcaccaacgaggacgaccgtccatctgtggtgaatgcagtcggttggttgcaagtttaccagctcactaccctgacgtaccctgcgactcggaccgatg

SEQ ID NO: 6157 - DNA, 203 bp, Homo sapiens
ggcgcgccagtccttggctcctgccgcgcattttggtactttgtcaattcgcgtgaacgcccgccccttgacgcaactcaaaggggcggacgacgaacctctccaagacctggcttttgccctcttcacccgccttcgtaatttgaaagcctatgcgccacgccatttccagcgtgtgcccaattcaccgactcggaccgatg

SEQ ID NO: 6158 - DNA, 203 bp, Homo sapiens
ggcgcgccagtcctgtgcaacaaactttgaccttctcaagttggctggagacgtcgaatccaacccagggcctaccatctggtccatgatgcctggtggcgagcttatagagtttgccacgaaagtgtcccaggtctacaaaactctgaaggaaaaatgcacagaccccactacgtggattaaggcagcgactcggaccgatg

SEQ ID NO: 6159 - DNA, 203 bp, Homo sapiens
ggcgcgccagtcctttcgccgcaccttcttcgatgactcgtcgtcggagtctgaggacggtgaaccagaagttccacagtttaggccacaggtttaccctagacctcgcagtgagcgagtggttagacaccccatgacagcccgtcgcgcgcagcgcgtcattgacatgggttactctgactacgagacgactcggaccgatg

SEQ ID NO: 6160 - DNA, 203 bp, Homo sapiens
ggcgcgccagtcctcggtgacgcgccgctactggaaggtgattgatgtcagcgcagacgaacagtataagacagtggacggcagattggactacgctaaggccacacaaccaacccagatcccccctgaattggctgtgttcaagacacacgtccctcttttgaagggcgctctacgcgactgccagccgactcggaccgatg

SEQ ID NO: 6161 - DNA, 203 bp, Homo sapiens
ggcgcgccagtcctatgcagcacttgctctttctcttttgacctctatactttctttttctcttgtgatttattcaggggtgaagacctatcaggagttttcccgcaagcacaagcatgtgcgccagccggtgtacaatgcctgggaggactttgatgaggactctatctttgaacagtcacgtgcttcgactcggaccgatg

SEQ ID NO: 6162 - DNA, 203 bp, Homo sapiens
ggcgcgccagtcctcagctggccgcaattcggcaacacgcgaccagcttgaggcagtggatgtgattgatcaatttgaaatgccgagtgatgctgtcgctattaagtttccagacaagcgcggctcctcttacaaaaatattcttcaccaccttgcctacaccctcccaacccgtggaaagccagtttcgactcggaccgatg

SEQ ID NO: 6163 - DNA, 203 bp, Homo sapiens
ggcgcgccagtccttcatccttgtcaacaacaacgtggcaggtagagccgttgttcacggtacttacattggatgcacccaaaagatcaccactttagacggattcacttttcccaacgtgagttcatacaaagccactacccatcttgggatgtgtcgcgcgccagtggttgccaacgaaaatggcacgactcggaccgatg

SEQ ID NO: 6164 - DNA, 203 bp, Homo sapiens
ggcgcgccagtcctaggcttatgcttcctcattgtttgcacagattggtactgacaatggacccatttcagagtatgaagctgttactggcattgagaatttggactcagtggagacgacaacgtcgcccggacttccctacacgacagcggggatcccgagagaggcgctgtttgacccagacaaaacgactcggaccgatg

SEQ ID NO: 6165 - DNA, 203 bp, Homo sapiens
ggcgcgccagtcctacaacattgtgctgcgtgccgcagcgtatgatgtcttcaccaactacgaggaaggtgacctcgccttcttgacgtacggtgatgacgtactactctgtgctaatcagccactgcctctggagcgctttcgcaagtcgcttgcaaagcttggatacaccattactccagctgacacgactcggaccgatg

SEQ ID NO: 6166 - DNA, 203 bp, Homo sapiens
ggcgcgccagtcctccacggacttggcggttcatcttggaccgctggagtacgcaaggctcttccgcccgtttgtggaagttgggtactgcgttcgccccttcggggatgcgcgcagggcctggctccgcaattttgacctgtgaggtgctccctaccagataccccagatttacccgttaccctaaacgactcggaccgatg

SEQ ID NO: 6167 - DNA, 203 bp, Homo sapiens
ggcgcgccagtccttgacctgtgaggtgctccctaccagataccccagatttacccgttaccctaaaattccctcccctttctcttcactcgccgaggccacgccgagtaggaccgagggtacagcgagtcttttagtttaaggtgttagatgtaaggtacgtgggctttcttttggtttacttcttccgactcggaccgatg

SEQ ID NO: 6168 - DNA, 203 bp, Homo sapiens
ggcgcgccagtccttccagaggagaggtgctggcttttgaagcattagctgaggacattcctgatacccttaatcaccaaactccatttgtaaataatgatgtagaagatgacatatttgatgaaacagagaaattcttagatgtttgctacagtgtgcttatgcaggcatggatagtaacatgcaagcgactcggaccgatg

SEQ ID NO: 6169 - DNA, 203 bp, Homo sapiens
ggcgcgccagtccttcacaatcaagatctttgctagcaaaccgctactatgctatggtgggagacattggcaagtacattgaacacagcggaatgggaggatttttcttaacacttaaatatggacttggaacaagatggcctacattggctcttgcagcattttctggggaactccagaaattaaaacgactcggaccgatg

SEQ ID NO: 6170 - DNA, 203 bp, Homo sapiens
ggcgcgccagtccttatttaaatcagcaatattttcagctaggagtagaaacagcaaggaaacagcagggagctgttgacaacaggacagcagaggacctcggcatgactgctgcagacaaagcagacctcactgcaaccatatcaaagctatccttgtcccaattacctaggggtagacaaccaatacgactcggaccgatg

SEQ ID NO: 6171 - DNA, 203 bp, Homo sapiens
ggcgcgccagtcctggacaaccaaacaaccagacaagtgacaaccagcagagattcaacccccccataccgcaaagaacatcaggtatgagcagtgaagagttccaacattcaatgaatcagtacatccgtgctatgcatgagcaatacagaggctcccaggatgatgatgccaatgatgccacagatcgactcggaccgatg

SEQ ID NO: 6172 - DNA, 203 bp, Homo sapiens
ggcgcgccagtcctctgattgagaacctgagtaaaatttccactgttacagataccaaaacccgccaaaaacgatttgcaggagtagttgttggacttgctgcattaggagtagccacagccgcacaaataactgcagctgtagcaatagtgaaagctaatgcaaatgctgctgcgataaacaatcttcgactcggaccgatg

SEQ ID NO: 6173 - DNA, 203 bp, Homo sapiens
ggcgcgccagtcctcatactgggagcatgtccaacaccaactgtacacccggaaatctgcttctgcatgatgcagcgtacatcaatggaataaacaaattccttgtacttaaatcatacaatgggacgcctaaatatggacctctcctaaatattcccagctttatcccctcagcaacatctcccaaccgactcggaccgatg

SEQ ID NO: 6174 - DNA, 203 bp, Homo sapiens
ggcgcgccagtcctgccggtaactccagcgaacaggctgcagcagcacggagttcctatgtaatccgttatcactcaaacaggttgattcagagtgctgttcttatttgcccattgtctgacatgcacacagcaaggtgtaatctagttatgtttaacaattctcaagtcatgatgggtgcagaaggtcgactcggaccgatg

SEQ ID NO: 6175 - DNA, 203 bp, Homo sapiens
ggcgcgccagtcctccttaatactattgaatgaagactccagattcaataataattgaaaggctctctatcttatgcaatagttatacgttttggctgtattagaatgttatagattctgctgtttttcccatatgaagcaatccttcaacaccgacttaggttcaattttctcatcatttactgttgcgactcggaccgatg

SEQ ID NO: 6176 - DNA, 203 bp, Homo sapiens
ggcgcgccagtccttactagggcacttcccgcatgatcttgacatttctgaaataagcccccttcacaataatgattgggatcaaattgccagagaagaatccaatcttgctgaacgacttggagtagctaaatctgaattaattaaacgtgtgcccgcatttagagcaactagatggcgtagtcatgcgactcggaccgatg

SEQ ID NO: 6177 - DNA, 203 bp, Homo sapiens
ggcgcgccagtcctctgatttagttcacattgttgacacacgatctggtctaatagttatcacccctgaacttgttatttgttttgatcggttaaatagtgttttaatgtattttacatttgagatgactttaatggtaagtgacatgtttgagggaaggatgaatgtcaccgctctctgcactattacgactcggaccgatg

SEQ ID NO: 6178 - DNA, 203 bp, Homo sapiens
ggcgcgccagtcctcctttattacacaagagattatagatatcctaattggttcaaaagcccttgataaggatgaatcaataactgttactacacaattgttagatatattttccaacctttctccagatttaattgctgagatgttgtgtctcatgagactttggggtcatcccactcttactgctgcgactcggaccgatg

SEQ ID NO: 6179 - DNA, 203 bp, Homo sapiens
ggcgcgccagtcctgtagaagtctaataaaacaacgacatcagagacatcatattcctatgcccaatccatttaatagacgtctattactcaatttcttagaagatgacagttttgatccagttgccgagcttcgatatgttaccggtggtgaatatctccaagatgacacattttgtgcatcttactcgactcggaccgatg

SEQ ID NO: 6180 - DNA, 203 bp, Homo sapiens
ggcgcgccagtcctatatcggagatcctcttggtacagctgtggcagatctcaagaggttaattaaatgtggtgctcttgaatcatggatactgtataatttactagcaagaaaaccagggaaaggttcatgggcaactttagcagccgatccatactcattgaatcaagaatatctttatcctcctacgactcggaccgatg

SEQ ID NO: 6181 - DNA, 203 bp, Homo sapiens
ggcgcgccagtcctcttctacacaagaaatcactctccatttgcacactagctcatcttgttgtgttagaagtgtagatggttgccttatatgtgagagcaatggagaggttcctcagatcactgttccctatactaatacatttgtatatgatcctgatccactagcagattatgagattgcacacccgactcggaccgatg

SEQ ID NO: 6182 - DNA, 203 bp, Homo sapiens
ggcgcgccagtcctcactaattccaggccctccttctcatcatgtattacgaccactaggagtgtcatccacagcttggtataaagggataagttattgtagatacctagaaacacaaaagatacagactggtgatcatctttatttagccgaaggaagcggtgcttcaatgtcacttctagaactctcgactcggaccgatg

SEQ ID NO: 6183 - DNA, 203 bp, Homo sapiens
ggcgcgccagtccttatttccaggagatactgtctattataatagtctttttagtagtggagagaatcctccacagagaaactatgcccctcttccaactcaatttgtacagagtgttccatataaattgtggcaagctgatcttgctgatgatagcaatttgataaaagattttgtcccattatggacgactcggaccgatg

SEQ ID NO: 6184 - DNA, 203 bp, Homo sapiens
ggcgcgccagtcctatggaaacggtgcagttacagacttatcaacaaaggatgcagttgcattcataatacataaagtaggagcagagaaagcatcccttgtccatatagatctcgaatcaactgctaatataaatcagcaaactctgtccagatcccagattcattcattaattatagcaactactgcgactcggaccgatg

SEQ ID NO: 6185 - DNA, 203 bp, Homo sapiens
ggcgcgccagtcctttagaactatcggtttcagtgcagctctagtaactgctactactcttcacaatgacggattcacaacaatacatcctgatgttgtttgtagttattggcaacaccatcttgaaaatgttgggagagtcggaaaagtaattgatgagatacttgatggtttagccaccaacttctcgactcggaccgatg

SEQ ID NO: 6186 - DNA, 203 bp, Homo sapiens
ggcgcgccagtcctctgtagctaaagatgctgattccaaaatcagcagtgctctggaggaagaactaggtgtgacagatacagcaaaagagagactaagacaccatctgacaaacctttcaggaggggatggtgcgtaccacaagcctacaggtggtggagctatagaagtggcaattgatcatacagcgactcggaccgatg

SEQ ID NO: 6187 - DNA, 203 bp, Homo sapiens
ggcgcgccagtcctacataacatttggagtcgaggacactgctgatcgggacaacaagaactggacaaatgacagcaatgaaagatggatgaatcactcgatcagcaaccacacaatcacgattcgtggtgcagaagaacttgaagaagagacaaatgatgaagacatcactgatatagaaaacaagacgactcggaccgatg

SEQ ID NO: 6188 - DNA, 203 bp, Homo sapiens
ggcgcgccagtcctttgcacgaaggctggccgacagaaaacagagactaagccaggcaaacaataaacgagacaccagcagtgatgctgactatgagaatgatgatgatgctacagcggctgcagggataggaggaatttaacaggatacttggacaatagaagccagatcaaaagtaagaaaaacttcgactcggaccgatg

SEQ ID NO: 6189 - DNA, 203 bp, Homo sapiens
ggcgcgccagtcctactctcagatgtcatcggactccttgacgtcgtcttatcctacaagcccacagaaattggagaagacagaagctggctccatggtatcatcgacaacccaaaagaaaacaagccatcatgcaaagccgacgataacaacaaagacagagcaatctcaacgtcgacccaagatcacgactcggaccgatg

SEQ ID NO: 6190 - DNA, 203 bp, Homo sapiens
ggcgcgccagtcctggaaactagcagcacacatagtacaagaataactgatgtcattaccaacccaagtccagagcttgaagatgccgttctacaaaggaacaaaagacggccgacgaccatcaagcgtaaccaaacaagatcagagagaacacagagttcagaactccacaaatcaacaagtgaaaacgactcggaccgatg

SEQ ID NO: 6191 - DNA, 203 bp, Homo sapiens
ggcgcgccagtcctctgtacgaagaacagttagatctggagaaatgatagtatacatggtagattcgatccatgctcctctactaccatggtccagccgactgagacaagggatgatatataatgccaataaagtagctctagcacctcaatgtctcccagtcgacaaagacatcagattcagggttgcgactcggaccgatg

SEQ ID NO: 6192 - DNA, 203 bp, Homo sapiens
ggcgcgccagtcctgccaacttgcatggaaaaaagcagtttgctatcctttaatggatgtaaatccacatatgaatctagtcatctgggcagcttcagtagaaatcacaagtgtcgatgctgtgttccaacctgcaattccgaaagaatttcgctattacccaaatgttgttgcaaaaagcatcgggacgactcggaccgatg

SEQ ID NO: 6193 - DNA, 203 bp, Homo sapiens
ggcgcgccagtcctaaatcaggaggatataagtctacactcctcaataatgacacccattagctctaaatcgtaccattaatcaaatacagatcaattcgatacaatcagttcaaataagaaaaacgtagggacaaagtcctctaccaacatcaaggaagacaagagtctcaaaaagctcagcctaagcgactcggaccgatg

SEQ ID NO: 6194 - DNA, 203 bp, Homo sapiens
ggcgcgccagtcctcagtctccattagacctgtagacatttctttaaatcttgcatctgccacaaatttcctagaggaatccaagacagagctcatgaaggcaagggcaatcatatcagcagttggaggatggcacaacacagagagtactcagataatcatgataataattgtgtgcatacttataacgactcggaccgatg

SEQ ID NO: 6195 - DNA, 203 bp, Homo sapiens
ggcgcgccagtcctaaagtgccaaaataatcaaagagacaatcacagaattaatcagacaagaagtaatatcaaggaccataaacatacaaagttcagtacaaagcgggatcccaatattgttaaacaagcaaagcagagatctcacacaattaatagagaagtcatgcaacagacaggaattggctccgactcggaccgatg

SEQ ID NO: 6196 - DNA, 203 bp, Homo sapiens
ggcgcgccagtcctgactaccttcattatcaattggtgatgcaatatatgcgtattcatcaaacttaatcactcaaggatgtgcagatatagggaagtcatatcaggttttacaattaggttacatatccttaaattcagatatgtatcctgatttaaacccggtaatttctcatacctatgacatcacgactcggaccgatg

SEQ ID NO: 6197 - DNA, 203 bp, Homo sapiens
ggcgcgccagtcctacgacaacaggaaatcatgttctgtaatagctgcaggaacaaggggttatcagttatgctccttgcccactgtgaatgagactacagactactcgagtgaaggtatagaagatttagtatttgacatattagatctcaagggaaagaccaaatctcatcgatacaaaaatgaagcgactcggaccgatg

SEQ ID NO: 6198 - DNA, 203 bp, Homo sapiens
ggcgcgccagtcctatataacttttgaccatcctttttctgcaatgtatccgagtgtaggaagtgggataaaaattgaaaatacactcattttcctagggtacggtggcttaacaactccgctccaaggcgacactaagtgtgtgataaacagatgtaccaatgttaatcagagtgtttgcaatgatgcgactcggaccgatg

SEQ ID NO: 6199 - DNA, 203 bp, Homo sapiens
ggcgcgccagtcctaagaattatgggagcttatcgactctttatttcccaatcttggtgaggatgtatataatattatatcactactagaacctttatcacttgctttaatacagttggatgaccctgtaactaatttaaaaggagctttcatgagacatgttttgactgagctacatacaattttaacgactcggaccgatg

SEQ ID NO: 6200 - DNA, 203 bp, Homo sapiens
ggcgcgccagtccttattacatgagaaattgatcaaaaatatgaataagtgcaattcaaatgggtattgggatgaaagaaagaaatctaaaaatgaattcaaagctgcagactcatcaaccgaggggtatgagactctgagctgttttttaaccaccgatttgaaaaaatactgtctcaactggagatcgactcggaccgatg

SEQ ID NO: 6201 - DNA, 203 bp, Homo sapiens
ggcgcgccagtcctctgacaacatcgacttagatacacttagcaatggaagtcctgccatacgtatcccttattttggttctgctactgatgaaagatcagaggctcaactaggttatgttaagaacttaagcaagccggcaaaagcagcaataagaatcgcaatggtttacacttgggcttatggaacgactcggaccgatg

SEQ ID NO: 6202 - DNA, 203 bp, Homo sapiens
ggcgcgccagtcctaaatgagaaaactttcatttttagctagacatctagcatacttgtgtagtttggcagagatagctaaagagggaccaaaattggaatctatgacatctctcgaacgactcgaatcattgaaagagtatctagaacttacttttttagacgatcctatattaagatatagtcaatcgactcggaccgatg

SEQ ID NO: 6203 - DNA, 203 bp, Homo sapiens
ggcgcgccagtcctatatagtagacacaaaaaattgtattatcacatttgatagagtattaagagatacaatctttgagtggactcggataaaagacgcagataagaagctaagacttacaggtaaatatgatctatatcctcttagagattcaggtaagttaaaagttatttctagaaggcttgtaacgactcggaccgatg

SEQ ID NO: 6204 - DNA, 203 bp, Homo sapiens
ggcgcgccagtcctgtccttcactttgaaaagaaagactaagcaaagatcagctggatggaccatgggtgtgattttcatatggatgatgggaaccatattgtcaattgaagttgttaaaaacaacgggggttggctcatgaaaccccgtcttcaagacactggatccacggtgcctgttggaaaaggcgactcggaccgatg

SEQ ID NO: 6205 - DNA, 203 bp, Homo sapiens
ggcgcgccagtcctttggaagaccgttgtggtgctttgtctggcagctttggcactaccatcatttgcaaccaattgtgtgaccatatcacagagagaaattcttaaaggagtggaaggagtcacatggttcgaggtgcttttggaaaagactagctgcattaccattgcagcacaaaacagaccatccgactcggaccgatg

SEQ ID NO: 6206 - DNA, 203 bp, Homo sapiens
ggcgcgccagtcctcattgacctctggctagacgatgtgaaacaaagctcggtgatggccagcaaagaattctgcatgaaggtcgaagtgtcagaaactcaaatagctgctaggtgccctactcaaggagatgcaactttgcctatggaagggaaggatgattatgtttgcaagaaaaccttcagtgacgactcggaccgatg

SEQ ID NO: 6207 - DNA, 203 bp, Homo sapiens
ggcgcgccagtcctcagaggatggggcaatggatgtgctctttttgggaaaggaagtattgtgggctgcgctaaagtagcctgcaatactgctaatgttatgaaaactcatatctatgagcaacaagctgtccagtatgtggttggcatagaggtacatagaggggaagtcatcaaagcaaatgtttccgactcggaccgatg

SEQ ID NO: 6208 - DNA, 203 bp, Homo sapiens
ggcgcgccagtcctccgtgtgacagttaaaaatgtgaaggaaaattcagatgatcaaggaactctgatcactacaaatccatttgttgaaagcaatggagccactatcttcctggaacttgaaccagtctatggattgtcaacaataaaagttggggacatcacataccaatggaatcagcaagggagcgactcggaccgatg

SEQ ID NO: 6209 - DNA, 203 bp, Homo sapiens
ggcgcgccagtccttgtcattgggaaggctgtgagaaaaatcaccaacgacatccataaaacaattgtcgttgggagtgctttttggaattcagatcaaagattctcagccattaatttgatggatctaattaggttgccctttgcttttttatttgggggacttggattcatgatgaagatgatcatcgactcggaccgatg

SEQ ID NO: 6210 - DNA, 203 bp, Homo sapiens
ggcgcgccagtcctgaatgaagttaatgactggtatggggggtacatgtactacccagatgatccagagacattcatcgccagcttggtcaatgataagaaagagcattgtggtacttatccagcaaacgccttggaactagcaatgtggcagaagcttgaatctcagatcaatttgttgttgaaagacgactcggaccgatg

SEQ ID NO: 6211 - DNA, 203 bp, Homo sapiens
ggcgcgccagtccttgtcattaaggaatggtgttgccgtcactgcaaactgcctccccttaaattcaccatggaggaagagtgctggtacgccatggaaatacgaccaacttccaaagttaatggtttggtgatggcatcagatggtgagaaaccactgtttgaatggtgttcatttgctctcctgaccgactcggaccgatg

SEQ ID NO: 6212 - DNA, 203 bp, Homo sapiens
ggcgcgccagtcctggcatatatgatggaagtggtgtttgacttgagaccaggcatgctgcttggccttatgttgaacaagacatggaagtttgaaagacttgttgccatgattggttgtctgtcattcttacaacaagccactattgaatggcggacagcctgggttctgctagattgcattgcagtcgactcggaccgatg

SEQ ID NO: 6213 - DNA, 203 bp, Homo sapiens
ggcgcgccagtccttgagaaagaagaaagtaggatggagactcttattcttggggtgggaatgatagcaacagaattccattgggtgggtttacccctgacagttcttgtccttggcttgaggagatggattgtgaatggaaaagaacaaaggagtctgatagtctatggtggaagatcagagagtgccgactcggaccgatg

SEQ ID NO: 6214 - DNA, 203 bp, Homo sapiens
ggcgcgccagtcctcaatgatgaaactgagggagaccttcttgagggagtttatagaattacagcagcctccatttttgggagaaagcaagttggaataggtgtcctcaaggaaggagtgttccataccatgtggcacgtcactagaggaagtgctctgcgagtgagagggagagtgctcgccccagacgactcggaccgatg

SEQ ID NO: 6215 - DNA, 203 bp, Homo sapiens
ggcgcgccagtcctaacagcctggtttgtgccttctttaaacacagccaactcaatggcaaaagtccttagaggtctaggaaagaaagttgtggtgcttacaagcaagaccttccatgataactatccgaagctcaatgatgagaagcctgattttattttgactactgatatctcagaaatgggtgccgactcggaccgatg

SEQ ID NO: 6216 - DNA, 203 bp, Homo sapiens
ggcgcgccagtccttaacttggatgtggaaagagtcattgaccctagaacaacattgaagcctgttgagaaaggaaatgcagttgaaatcagtggtgaaaggaagataactccagcctctgcagcgcaacgacgcggcagggtcggaaggactaaaggaaagaaggctgattacatttaccaaggtgacgactcggaccgatg

SEQ ID NO: 6217 - DNA, 203 bp, Homo sapiens
ggcgcgccagtcctcctgcttgctcaatgtgactttacaccatggttggcttggaaagtggcttcagatggcaagagcattgagaaccgagagtggctcaagagtgggccaaaggaacacttggtgacagatgaaaactgtgaagcggttacatacaagactcctggtggaaaggttgaaagactccacgactcggaccgatg

SEQ ID NO: 6218 - DNA, 203 bp, Homo sapiens
ggcgcgccagtcctcaagggattcaggatggcccaagaatcaatgccaacagcccttcttactgtgatgcaagctctaataataggcactggattgatcatgttcttggggtggatgtgttcgagtaggaaggtggacagaatgatgctgggcactctgttgatagtgggatgtagtgtcacagcatgcgactcggaccgatg

SEQ ID NO: 6219 - DNA, 203 bp, Homo sapiens
ggcgcgccagtcctaatgttcacccagagaattgttgctggtagtgtcagtggaaaactggacacattgaatggattgagaaatggatttgtgagcacctcgatgtcattgggtgacttgtcgcttttcatctcattctgcagaaacatgagtcctctaactactgtgacagggctggttctagccgccgactcggaccgatg

SEQ ID NO: 6220 - DNA, 203 bp, Homo sapiens
ggcgcgccagtcctggctatcctcctagctgtcatcaatgtggttgttgtccgtgaaccatgggcaatgcttgaagctggactagtgctcctcgctgcaattaagtttgcggctgatggggctaaagaaactttgataacgcttcctgtcctgagtgggattggtgctttgattagaggggattacttcgactcggaccgatg

SEQ ID NO: 6221 - DNA, 203 bp, Homo sapiens
ggcgcgccagtcctagctagggaagcactggctaagggaaaaaccaacaccggccatgcggtctccagaggaacagcaaaactagcctggattgatgagaggggtggagtggagttgaaaggaagtgtcgtggacctgggctgtggaagagggggctggagttactatgcggcttcgcaaccaaatgtcgactcggaccgatg

SEQ ID NO: 6222 - DNA, 203 bp, Homo sapiens
ggcgcgccagtccttgaggtgccagaagaagaagtccagatgagagtagacaaaatcaaggctgagaaatcaggcacctggtgttttgattctaatcacccttatcgcacgtggaactatcatggatcataccgtgtgagggatgtgggaacaagagcttcagcagtcaatcatgttgtgaagttactcgactcggaccgatg

SEQ ID NO: 6223 - DNA, 203 bp, Homo sapiens
ggcgcgccagtcctaaccaaaggtgggaaagtgagaacatgcacaaaagaagagttcatccaaaaagtaagatctcatgctgctatcggggcctggtcgtcagatatggaagggtggagctcagctgtggaggcagttgacgatcctaggttctggaacatggtgcagaaagaaagagatttacacctcgactcggaccgatg

SEQ ID NO: 6224 - DNA, 203 bp, Homo sapiens
ggcgcgccagtcctgcagcttatcagaatggcagaagccgaaggagttcttggagcaacttttgaggacttcgggattgacagatggttgcaggaacatggtgaagaccgagttgaaagaatgctggtcagtggtgatgactgtgtagtcaatgctatagatgaaaggtttgggtcaagtctgaattgcgactcggaccgatg

SEQ ID NO: 6225 - DNA, 203 bp, Homo sapiens
ggcgcgccagtcctgacagtcaaccaggggggatgtgttggagtggaatcaacaggctgtctagccaaggcgtatgcgcaaatgtggcttttgctttatttccacagaagagacctcagaacgctggctctagctgttatgtcagctgtgccaagcaattggattccaacaggacgcaccacttggtccgactcggaccgatg

SEQ ID NO: 6226 - DNA, 203 bp, Homo sapiens
ggcgcgccagtcctggcaaccagtgggctagccacatgggtatgacgcacccaccctctgcattcttgtaaatactttggccagtcattgtaaataggttagggagccgggcccaacccagctagggatagcctttctggggtaaggactagaggttagtggagacccccggcttttgaagttagggccgactcggaccgatg

SEQ ID NO: 6227 - DNA, 203 bp, Homo sapiens
ggcgcgccagtcctcctgggaaattagctaaggggataaccactctgatgaacatcctccggactctgctaaacggaatcttgggacgcaaaaaacaaaggagaggaggaactgaaagcctgttccccataatgtttctaactggattgatggctatgcaggtatcccaaaatggtgatggttggctgcgactcggaccgatg

SEQ ID NO: 6228 - DNA, 203 bp, Homo sapiens
ggcgcgccagtcctaatgtgtgggttaaatatccgctttgtaaacctggaggccacaggctaaaacgatcgctgtcaataactgaacatccatcgtctgtctcactagacaaaccaactttgtggcatcactggaacagtgtcaatgatcgaattggcaagagtgaagagtggatagttaccaatgctcgactcggaccgatg

SEQ ID NO: 6229 - DNA, 203 bp, Homo sapiens
ggcgcgccagtcctatgcgtgaggaacatctcgacggatatgtctgcaagagaagcttcagtgatagaggctggggaaatggttgtggtttgtttggaaaaggcagcatcgttggatgtgctaaggccacttgtggggcaaatgacatcatcaaaagctactcgtatgattcaccaaaagtcaaatatcgactcggaccgatg

SEQ ID NO: 6230 - DNA, 203 bp, Homo sapiens
ggcgcgccagtcctgtttttaaatcattggtcaaagctgaagaagtgaccaaaactagtaactcttaccatctcaccggaggacatgttgattgtagagtgagtactctcaatcttcgaatgaagggtttgacgtatcaaatgtgttcttctagctttgtgtggcacaaaagaccagtggccacgcaacgactcggaccgatg

SEQ ID NO: 6231 - DNA, 203 bp, Homo sapiens
ggcgcgccagtcctattgacttggccatgtggaaagcacttgaggaggagataaactggtttctggaagatcagtcagttgattggaggataatggttggaaatgaagaaaaggttttccacaaaacaaactcaagtggctgggaaagaagagctgggaggaattctctatcatggaagaactgggcgcgactcggaccgatg

SEQ ID NO: 6232 - DNA, 203 bp, Homo sapiens
ggcgcgccagtcctctagaggattgtgataaaagaggacattctgttagaagtaccacccaaggaggggtaacaatacctgactggtgttgtaaacactgtgttttgccacctttgaaattcaccaatgccgatggatgttggtatgccatggaaatcagaccactgaaaacgacacctggactagttcgactcggaccgatg

SEQ ID NO: 6233 - DNA, 203 bp, Homo sapiens
ggcgcgccagtccttatgcaggaagtatgacagctttggaagctcagtcatggggagttctctctgtgatgttgctgttttacatgggctttctaccgaagattgcaaaagaaagatggagtgtgccaactgccttcatgtttttcgtctttgccatcacagggttgattgattgcagggattttctccgactcggaccgatg

SEQ ID NO: 6234 - DNA, 203 bp, Homo sapiens
ggcgcgccagtccttttcaacatgtgactatggagtgggaatcagtttggaaagttttggattccttgggctttgttgtctatgggttcttactttctaagtctggaatgcaaagccacgtgttcatgctgtttgtagtgtcactgacttggatggatagcatagtaatgcaacatgctctagcacttcgactcggaccgatg

SEQ ID NO: 6235 - DNA, 203 bp, Homo sapiens
ggcgcgccagtcctactgattacacagccatactcggcattgttatggcaataggagcagccatttgcaaaaatggtctggaatcaagtggatggatgatcggaatcatgggaattttcctagtcttttttctcctccaattaagcaaaggagagatgacagctgaatgggctggatactgtgaatggcgactcggaccgatg

SEQ ID NO: 6236 - DNA, 203 bp, Homo sapiens
ggcgcgccagtcctttccataccatgtggcacgtcacacgtggtgctgtattgaacatctgtgggaggaaaatcgtaccagaatgggccagcatcacagaagatctaatatcatataatggtgggtggagattgttcactagatgggatggaacagaagttcaagttcacgcttacacccctgatggacgactcggaccgatg

SEQ ID NO: 6237 - DNA, 203 bp, Homo sapiens
ggcgcgccagtcctagttctatagctcaaactgagaagaaggaagaagatgttccacaaccaaagacacttgaaggagatggctggttgtcaaaagggaaaataaccgtaattgatgcccatcctggaagtggtaaaacacatagaatactaccaaatttagttaaaagggctgctgagagaaagatgcgactcggaccgatg

SEQ ID NO: 6238 - DNA, 203 bp, Homo sapiens
ggcgcgccagtcctaggacacttgttttagctccaacacgggttgtgataaaagagatggaaagtgctctcaaaggaatggatatcagttttcactcatcggccgtgtcaacgaagaccccaggatcacttgttgatgtcatgtgccatgctacttttgtaaataggaaattaattcatactccacagcgactcggaccgatg

SEQ ID NO: 6239 - DNA, 203 bp, Homo sapiens
ggcgcgccagtcctgatgttgaaaagatgattcctgatgagccatggaaacaaggttatgaatggataacagactttgaaggaagaacagcgtggtttgtgccatcatacaatgcagctcagggaatctcaaaagccttgagagagagaggaaagaaagtcctcattctgacaagcaagacctttcatcgactcggaccgatg

SEQ ID NO: 6240 - DNA, 203 bp, Homo sapiens
ggcgcgccagtcctgacaactatcctaagatacagtcagaaaaacctgatttcatactcaccactgacatttcggagatgggtgccaatttagatgttgatagggtaattgatccaaggacaactcttaaaccaatggaaaaaggcaatattgtggaggttagcggtgaaatatcaataacgcctgcccgactcggaccgatg

SEQ ID NO: 6241 - DNA, 203 bp, Homo sapiens
ggcgcgccagtccttatctgattgaaccaaagggaactacattttggacccttccagtggttagtggattaacatcactggtccgaggagatttctttggtttgattcccatttctttcagggtctggctatatgccagaagtgatagacgaggtatagtaaccagtcatcacacattgggtgaaaagcgactcggaccgatg

SEQ ID NO: 6242 - DNA, 203 bp, Homo sapiens
ggcgcgccagtccttttattcccttgtcaggtcatgtggttgacctgggctgcggccgcggcggctggagctactattgcgcagcacaaacaccagtaaggaaagtcaatgcttataccttaggtactggagctcatgagaaacctcgtctggtcgaaagcttaggttggaacctcatcacctttaagcgactcggaccgatg

SEQ ID NO: 6243 - DNA, 203 bp, Homo sapiens
ggcgcgccagtcctatgcagggatggagtgatgccaaggaagcagttcatgaccccaggttttggaatatggtggacaaagagaggaaactacacctggaaggaaaatgtgaaatgtgcatctataacatgatgggtaaaagagaaaagaaaccaggtgagtttggatgtgccaagggtagccggacccgactcggaccgatg

SEQ ID NO: 6244 - DNA, 203 bp, Homo sapiens
ggcgcgccagtcctgaaagattgtctcgtctcttgattagtggtgatgactgcgtggtaaacgcatgtgatgaaaggtttgggagaagcttgacatggttgaacaccatggagaaaatccgcaaggacattgacttgtgggctccatcaaatggatatgagaactttgaaaaagttgagttctgctcacgactcggaccgatg

SEQ ID NO: 6245 - DNA, 203 bp, Homo sapiens
ggcgcgccagtcctaaccactttcatgagctgatgttgaaagatggacgtcagctggtcgtcccctgcaggagtcaaaatgaattagttggtagagcttctgtaaatcagggtggaagtgcaaccgttgcagggactgcgtgtctagccaaagcctatgcccaaatgtggaatttgttgtattttcaccgactcggaccgatg

SEQ ID NO: 6246 - DNA, 203 bp, Homo sapiens
ggcgcgccagtcctaagacaaacatcacaacatggaagaatgtggcctacctgcccagaggacaagacatgtgttgtggcagtcttattggcagctcaaaaagagcaacttgggccaaactcattcctggagcagttgaaaaagtgagagggatgattgggaatgaaaattacgtcaactaccttggacgactcggaccgatg

SEQ ID NO: 6247 - DNA, 203 bp, Homo sapiens
ggcgcgccagtcctcaagacatgtgttgtggcagtcttattggcagctcaaaaagagcaacttgggccaaactcattcctggagcagttgaaaaagtgagagggatgattgggaatgaaaattacgtcaactaccttggagcaatgggacgctatgaatgtgatgatgtctcattccaactgtattaacgactcggaccgatg

SEQ ID NO: 6248 - DNA, 203 bp, Homo sapiens
ggcgcgccagtccttgcagagatgtcaaaaatgtgatggtgacttatcccacgtgtaagaggaacaccaggaccagacgggatgtcacaatccaagaccatccaccgtctgtcacactcaccaaaccatctcttctcaagcatgtgggaggggctgaggagcatcttcaaaaggttgaaaattggatccgactcggaccgatg

SEQ ID NO: 6249 - DNA, 203 bp, Homo sapiens
ggcgcgccagtcctttaatgaacagctggaaagttgtattggtgaccgtggccttgctctatggatttgggaacaagctacaaacgtggattctcataattgtgaccttgattgtggctccagcttatgctagcacctgtgttagtgtggccaaaagggatatgatccgtggtgacctcggaacaacccgactcggaccgatg

SEQ ID NO: 6250 - DNA, 203 bp, Homo sapiens
ggcgcgccagtcctggagaggcgcatctggcagaagaggcaaactctgactacgtgtgtaagcgaggtttcagtgacagaggttggggcaatggatgcggcttatttgggaaagggagcatagtggcatgcatcaagactacatgcaagaatgatgctaacatcataaagagctatgtctatgatgctcgactcggaccgatg

SEQ ID NO: 6251 - DNA, 203 bp, Homo sapiens
ggcgcgccagtcctaaccaaagaactgctatcttcaaagctttggtgaaagccaatgaaatctccaagtccaacaataagtacattctggatggaggacacttgagttgcaggatcggagtcaatggactgaagatggttggggctacctattctcaatgcacaaaacctttcgaatggatcaagaaacgactcggaccgatg

SEQ ID NO: 6252 - DNA, 203 bp, Homo sapiens
ggcgcgccagtcctccagtcctaactcaacatggcacagtggtcatggaagtgaagtacacaggtgaaggagccccatgccgtataccattcagagttgaacgagtggacaagcctatggaaaatgttggcaatctggtcacaggaaacccatatgcctcacaaaaggacgctgtggtgttccttgagcgactcggaccgatg

SEQ ID NO: 6253 - DNA, 203 bp, Homo sapiens
ggcgcgccagtcctgttggagagataggatgtatgattgatgtgggaaggagagagctgacttgtggggatggagttgtggtctggaaccaactggatgattggtgggaaaagtaccaatattatccagatgaacctgctgttttcttgggttccctcatggaagacaaagagaagcattgcggctaccgactcggaccgatg

SEQ ID NO: 6254 - DNA, 203 bp, Homo sapiens
ggcgcgccagtcctgtgggaggacttgtcatggcttttgatgaagaaccagtgtggaagccatggggtattatgggattgatagtcctgttgtacatgggcttctttccttctctgggcaatggaaaattttcaatgggttttggcatggctgtgttcctgttgtgcgtgactggaatgctctcattacgactcggaccgatg

SEQ ID NO: 6255 - DNA, 203 bp, Homo sapiens
ggcgcgccagtccttcggtagacccaatagccattgtcgtgacgttgatggctttgggggctgctgtggccaaggatggcactgccgttcagcctctaacactgggactcttttctgcagtcatcttgttcctattgcttcagctgacgggtgggcccctcatagctgaatgggcagggtacgcggatcgactcggaccgatg

SEQ ID NO: 6256 - DNA, 203 bp, Homo sapiens
ggcgcgccagtccttggaaatccaatgccttgcgctactctggtcatctggacttagaagtcaagaagttgagcgatgggagactggtcaacacagctaaggaaaataccaccaccactgatggactcatactaggggctggaatgctagcttctggctttagctgggtagctgtgcctgtgacttttcgactcggaccgatg

SEQ ID NO: 6257 - DNA, 203 bp, Homo sapiens
ggcgcgccagtcctacttactgtagctcaatagctcaggccaatgtgccagcagaaaccgaacctgaagtgctgaaaaccaactggacatcaaagggaaaactcaccgtcattgacgctcatccagggagtgggaaaacaaagaaaatattgccacgccttgttgatgaagctgttggaagaaagcttcgactcggaccgatg

SEQ ID NO: 6258 - DNA, 203 bp, Homo sapiens
ggcgcgccagtcctcgcacactagtccttgctccaacaagggttgttgtgaaggagatggagcaggcactcagaggcaagcctgttagttttcattcttcagcagcgagtaagaaggtgccaggagcactggtggatgttatgtgtcatgcaacttatgtccagcgacggatgatgcctattcctcagcgactcggaccgatg

SEQ ID NO: 6259 - DNA, 203 bp, Homo sapiens
ggcgcgccagtcctaagaactatgagcttgtcatcatggatgaagcacattggacagacccctctagcattgcggcccgaggattccttgattctcagcggaaggaaaatcacctttcactggtgctcatgactgccacaccacctggaactgatgatccctggcctcaaagcaacgctccaataaaccgactcggaccgatg

SEQ ID NO: 6260 - DNA, 203 bp, Homo sapiens
ggcgcgccagtccttcagctgctcaaaggagaggaagagtggggcgtgaggagggacgtcaagctgagtacgtctatcagggcgaagttgaccccgatgacggagacttggtgtgctggaaagaggcccagatactcctggataacatggaaggacgattcaaaacggccagtgtcttctatgagcctcgactcggaccgatg

SEQ ID NO: 6261 - DNA, 203 bp, Homo sapiens
ggcgcgccagtcctcagagcaaagttgacagggtcaccctgggggctctgttgctaactgctggctcagcggttctttggatgggtggagcagccccttgtgtcgtgggtgggagcctgatatgtgggtttgttttactagtagcattgtcaccagaggagggaatgcaacgcactcaagttgactcacgactcggaccgatg

SEQ ID NO: 6262 - DNA, 203 bp, Homo sapiens
ggcgcgccagtcctactctggctatgtttgtgttgacactctacaccttgatagccgctgttgtcgctaatgaaatggggttcttggaacgaacaaagaaggacttccgagagttttttaggaaagaagtgaacatggacggtgagccaacccagtggagaatttttgacctcgacatctgcccaatgcgactcggaccgatg

SEQ ID NO: 6263 - DNA, 203 bp, Homo sapiens
ggcgcgccagtcctaatgcccaggcattcttcctctacaagagtagactcgtccacgaaattgacagagccgaagcagtttctaacctcagtaaaggacggaccaacacaggacacgcagtgtcgagggggacaagcaagcttgcttggatgcatgagcgcggttacgttccactcaagggagttgtgcgactcggaccgatg

SEQ ID NO: 6264 - DNA, 203 bp, Homo sapiens
ggcgcgccagtccttacagcataagggatgttggcacctcagctagtgccccaaatcatgttgtcaagcttctggcatggccttggttgaaaatagagaaagtcgtgttaatggccatgacggatacaactgcctttggacagcagagagtgtttaaagagaaagttgacaccaaagcacccgaacctcgactcggaccgatg

SEQ ID NO: 6265 - DNA, 203 bp, Homo sapiens
ggcgcgccagtcctagtggagatgactgcgttgtcaacgctttggatgagaggtttggcaaagctctgacatggcttaacaccatggaaaaaacccgtaaagacatagaagcatggaaaccatcacgggcttatagaacctggcaggaagtcgagttttgctcacaccacttccatgagctttttctccgactcggaccgatg

SEQ ID NO: 6266 - DNA, 203 bp, Homo sapiens
ggcgcgccagtcctcgagacggaaggaagctgatcgtcccgtgccgggaccagcatgaattggttggacggtcaatggtctcgcagggtgggagctctggagtggcagggacagcttgtctggccaaagcatacgcccagatgtggctgatgagctatttccataggagagacctcagaactcttggacgactcggaccgatg

SEQ ID NO: 6267 - DNA, 203 bp, Homo sapiens
ggcgcgccagtcctcaggatttgtcatgctccagcctgatagacaacccaaccagagcgcagtgggcaaaactactcaaaggggctgtcatgaaagtgagagagatgataggccgagagcattactctgactacttgagcaatatgggtaggtaccaagaagggacggaagagttccacatgtggtaacgactcggaccgatg

SEQ ID NO: 6268 - DNA, 203 bp, Homo sapiens
ggcgcgccagtcctgtatacgagtttagctcaatcctcgtatacaatattgggcgtcaccaaatatagatttggcataggcaacaccccgatgcgaaggccgaaaagggctaaccatgcccttagtaggactagcaaaaaatcggggactagcccaggtggtgagcttcctggatgaccgaagccctgcgactcggaccgatg

SEQ ID NO: 6269 - DNA, 203 bp, Homo sapiens
ggcgcgccagtcctagtacagggcagtcgtcaacagttcaacacgcagaataggtttgcgtcttgatatgctgtgtggacgagggcatgcccacggtacatcttaacctatccgggggtcggataggcgaaagtccagtattggactgggagtacagcctgatagggtgttgcagagacccatctgatcgactcggaccgatg

SEQ ID NO: 6270 - DNA, 203 bp, Homo sapiens
ggcgcgccagtcctccctcaccagcgaggaactagagacatacccactaggcttaaggacttgcccagaaaaggggattgtaggagtggcaacaacaagggcccagtgagtggggtttacataaagccagggccagtttactaccaagattactcaggccccgtctaccatagggccccattggaactcgactcggaccgatg

SEQ ID NO: 6271 - DNA, 203 bp, Homo sapiens
ggcgcgccagtcctcttcgaggaatccaccatgtgtgaggtgacacgaaggctgggtagaaccactggcagtgatggacttctataccatgtatatgtatgtctagacgggtgtataataatcaagacagccagcagagcgcaacaaaaagtgctcaagtggaccaagaacaccctaaactgtcctttcgactcggaccgatg

SEQ ID NO: 6272 - DNA, 203 bp, Homo sapiens
ggcgcgccagtcctgtcaggcatacaacacgccatgtatctcagaggggtgaacaggagcttacacggaatatggccagaaaagatatgcactgggatcccgacacacttggcaacagacactgagttaaaaagaatatcaggaatgatggatgcaagtgaggaaaccaattacacttgttgtaggttcgactcggaccgatg

SEQ ID NO: 6273 - DNA, 203 bp, Homo sapiens
ggcgcgccagtcctgcagagacatgagtggaacaagcacggatggtgtaactggttcaacatagaaccctggatagcattgatgaacagaacccaagccaacttgacggaaggcccccccccgaaggagtgtgccgtcacatgcagatatgacaagaacacggaaactaacatcgtcacacaagctagcgactcggaccgatg

SEQ ID NO: 6274 - DNA, 203 bp, Homo sapiens
ggcgcgccagtcctggacaggccaacgatgttaactggctgcaaaaaagggaagaacttctccttcgcaggtacggtgataaaggggccctgcaattttgacgtgtccctggaagacatcctgttcaaagatgaagggtgcggtaatatgatgcaggatgcagccatccaagaggtcgacggaatcaccgactcggaccgatg

SEQ ID NO: 6275 - DNA, 203 bp, Homo sapiens
ggcgcgccagtccttaccgtttttatttttgaagaggtaagtcaggtcgtaaagctggtacttagggcattgagggacttaactaggatctggaatgctgcttcaaccactgcttttttgatatgtttagtcaaagtgttgaggggacaggtaatccagggcatagtgtggctcttactggttacgggcgactcggaccgatg

SEQ ID NO: 6276 - DNA, 203 bp, Homo sapiens
ggcgcgccagtcctggcacaaggggcaataacttgtgaacccgaataccagtatgcactggcaaggagtaaaaggataggcccactgggagcagaggatctagtgacaacgtggcatgactacaaatttgacctgaaaatacaagaccccttagtaatggtgtattgtaaaaacgaccagttttttgtcgactcggaccgatg

SEQ ID NO: 6277 - DNA, 203 bp, Homo sapiens
ggcgcgccagtccttggcaagaggtgcaaggcaggagaggccagatacctggccaagatacactggcgggccttgccaacttctgtggtcttcgaaaaggttctggaagaaaacccaccagaggaactaccactagaagataactttgaatttggactttgcccttgtgactctagaccagtcgtgaacgactcggaccgatg

SEQ ID NO: 6278 - DNA, 203 bp, Homo sapiens
ggcgcgccagtcctgggcaatttcaataccaccttgatcaaccacagtgccttccaactagtctgccccataggatgggtgggaaccattgaatgcacgttggtcaacacggacacactagcaaccacagtagtcaagaggtatacaagaacaacccctttccctatgcgggctgggtgcgtggtgtacgactcggaccgatg

SEQ ID NO: 6279 - DNA, 203 bp, Homo sapiens
ggcgcgccagtcctggggaaggctggttacaggtttgtgagtgaagaaccatgcaacagggaaggtgttgaaatctccacaaaaggcaagctcaagtgtataatagagaagacacaagtaaaggtatatgctgctgacaacaccttagggcctatgccttgcaaacccatggaaattatatcaagtgacgactcggaccgatg

SEQ ID NO: 6280 - DNA, 203 bp, Homo sapiens
ggcgcgccagtcctattccttgtagtgagagatgaaccagtaaagaaatgggtaatctgtctataccactgcttaacaatgaagccaataaaaacagcagctgttctagtccttctgatgagtaacgtagtaaatggggaaggcgggagtaaagcaggggcaggaattgacttatacttcctcacaaccgactcggaccgatg

SEQ ID NO: 6281 - DNA, 203 bp, Homo sapiens
ggcgcgccagtcctactagggatggtagtatttctggtgttggctaggagagaccccatgctcatccctttagtggtggctatagccacattcaagacaactaagtatactgctggcttcagtgtagatgtagctctggccgttctactcatagtgctccttatctgtagttacaccagtgattacttcgactcggaccgatg

SEQ ID NO: 6282 - DNA, 203 bp, Homo sapiens
ggcgcgccagtccttaagtacagaaaactgctacaatgcctgcttagtataggggcagcagtgttccttataaggagcttgaaatggctaggtggagtcgggctaccatctattgagttgcccactcagaggcccctattctacatactggtgtatctgatcgctacagctttggtaacctcttggaacgactcggaccgatg

SEQ ID NO: 6283 - DNA, 203 bp, Homo sapiens
ggcgcgccagtcctgtgtggaggaacagggccaccaatcagctgcgggatgaccctagcggactttgaagagagacattacaaaaggatattcataagagaagactcaatgaatacgatgatgtgcaaccgatgccagggaaagcataggaggtttgaaatggaccgggaacctaagagtgccagatacgactcggaccgatg

SEQ ID NO: 6284 - DNA, 203 bp, Homo sapiens
ggcgcgccagtcctctgtgctgagtgtaataggctgcatcctgctgaggaaggtgacttttgggcagagtcaagcatgttgggcctcaaaatcacctactttgcgctgatggatggaaaggtgtatgatatcacagagtgggctggatgccagcgtgtgggaatctccccagatacccacagagtccccgactcggaccgatg

SEQ ID NO: 6285 - DNA, 203 bp, Homo sapiens
ggcgcgccagtcctcgagcacctaggctgggtgctacgaggcccggccgtgtgcaagaagatcacaagtcatgaaaaatgccacacgggaattgccgacaagctgactgcattctttggaatcatgccgaggggtactacaccaagagctcccgtgaggttccctaacgcccttctaaagatcagacgcgactcggaccgatg

SEQ ID NO: 6286 - DNA, 203 bp, Homo sapiens
ggcgcgccagtcctcatatttgaagcctctagtggtagagtagtcggtagggtcaaggtagggaagaatgaaggggccaaaccgactaaactgatgagtgggatacaaacagtgtccaagagcacggctgatatcacagagatggtaaaaaagatagtggcaatgaacaggggtgagttcaaacagatcgactcggaccgatg

SEQ ID NO: 6287 - DNA, 203 bp, Homo sapiens
ggcgcgccagtcctgatgaaagaaggggacatggctacgggcataacatacgcatcctatggatacttctgccagatgccccaaccaaaactgagggcggccatggtggaatactcatatatcttccttgatgaataccactgtgctacagctgagcagttggcaatcatagggaagatacaccggttcgactcggaccgatg

SEQ ID NO: 6288 - DNA, 203 bp, Homo sapiens
ggcgcgccagtcctaggcaacatgctagtcttcgtccccactagaaatatggcggtcgagacagcaaagaaattgaaagctaaagggtataattcaggttactactacagtggagaggacccggccaacctaaaagtagttacatcacagtcaccatatgtggtcgtggctacaaatgccatcgaatccgactcggaccgatg

SEQ ID NO: 6289 - DNA, 203 bp, Homo sapiens
ggcgcgccagtcctatattacagaagccaagagacagccacaggctcaaaggactaccattatgatctgctacaagcccaaaggtatgggattgaagatgggatcaatgtaaccaagtcatttagggagatgaactatgactggagtttgtacgaggaggatagtttactgatcacccaattggaggtcgactcggaccgatg

SEQ ID NO: 6290 - DNA, 203 bp, Homo sapiens
ggcgcgccagtcctcttcctgaacgctaggaaactaggtgaggatgtgcctgcatacatctatgccacggaagatgaagatttagccgtggacttactaggacttgactggcccgacccgggggtgcaaagtacaactgaaactagcagagctttaaagcaggtcatgggactatccacggctgagaacgactcggaccgatg

SEQ ID NO: 6291 - DNA, 203 bp, Homo sapiens
ggcgcgccagtccttgctctactggtggccttgttcggatacgtgggctaccaagcactatccaaaagacacatacccattgtcacagacatatatactgtagaagaccacagattagaagacaccacacatctacaatttgcacccaacgcaataagaacagatgggaaggaaacagaattgaaagacgactcggaccgatg

SEQ ID NO: 6292 - DNA, 203 bp, Homo sapiens
ggcgcgccagtcctcacatggttagcctacgtatttgtcgatgaagacgtgggcactataaaaccgtgtttaggtgagaaggtaatacctgaaaaaacaggtgacgtatctctccagagtgaggtcatcctcgacacaacatcggtcggaatctctgtagtgggaggcagtgacagggcaactactggcgactcggaccgatg

SEQ ID NO: 6293 - DNA, 203 bp, Homo sapiens
ggcgcgccagtcctagatgtagatgtggttaaaacaaaagcaaaggaactgggggctacggatgacacaaagatagttaaagaggtgggggccaggacatatacaatgaagctgagctcctggtttacccagcagtcaaacaagcatcacagccttctccccctgtttgaggaggttttacttcagtgcgactcggaccgatg

SEQ ID NO: 6294 - DNA, 203 bp, Homo sapiens
ggcgcgccagtcctcaccatgacgtctatagggatcaaacttgaaaagttgcctgttgtgagggcccaaacagatacaactagtttccatgatgctataagggacaagatcgataagaaagagaacctccagaaccccacactacatactaagctaaaggagatcttcaacaacctcagtagaccagacgactcggaccgatg

SEQ ID NO: 6295 - DNA, 203 bp, Homo sapiens
ggcgcgccagtcctctatgaagggaagacgcctctcttcttgatatttgacaaagtgaagaaagaatgggatcaattccaggaccctgtcgcggtgagtttcgacaccaaggcatgggatacccaagtgacaagcagggacctggagttgattagagacatccaaaaatactattttaagagaaagtgcgactcggaccgatg

SEQ ID NO: 6296 - DNA, 203 bp, Homo sapiens
ggcgcgccagtccttaggttcgaggacatagagttttgttcccataccccagtccccgtaagatgggctgaccacaccagcagctacatggcagggaggaacacagccacaatcctgtcaaagatggcaaccagattagattcaagtggagacagaggaacagcggcttacgagaaagctgtagcattcgactcggaccgatg

SEQ ID NO: 6297 - DNA, 203 bp, Homo sapiens
ggcgcgccagtcctagggagcgggtacgtagtgcaaggcagacattatgaagagctaagtatcactaagagaccagatagacaaacaagtaacggtcttgagagatataacttgggacctatagtgaacttagtcctgaggagattgagggttatgctgatggcttctatcggcagaggcatctgagccgactcggaccgatg

SEQ ID NO: 6298 - DNA, 203 bp, Homo sapiens
ggcgcgccagtcctagtaagcagctcccaatgtaacataatgtaaataaatgtgactttatgtaaatgcaaggcagtaagcagctcccaatgtaacataatgtaaataaatgtaactttatgtaaatgcaagtagagtagttagagttctaaggacatactacatagagacaacaactacctcattttcgactcggaccgatg

SEQ ID NO: 6299 - DNA, 203 bp, Homo sapiens
ggcgcgccagtcctaatgtaacataatgtaaataaatgtaactttatgtaaatgcaagtagagtagttagagttctaaggacatactacatagagacaacaactacctcatttttaaaaacagcactttagctggaaggggatattccgacgtccactgttggtctaggaaaaaaccctgaaggcccccgactcggaccgatg

SEQ ID NO: 6300 - DNA, 203 bp, Homo sapiens
ggcgcgccagtcctggatagtcgtcagtagttcaacgcaggcacggttctgccttgagatgctacgtggacgagggcatgcccaagacttgctttaatctcggcgggggtcgccgaggtgaaaacacctaacggtgttggggttacagcctgatagggtgctgcagaggcccacgaataggctagtatcgactcggaccgatg

SEQ ID NO: 6301 - DNA, 203 bp, Homo sapiens
ggcgcgccagtcctaccgtagaaaatgctaggcaaggggctgcaaaattgacatcctggctagggaagcaattgggtataatggggaaaaaattagaacacaagagtaaaacgtggttcggagccaatgcacaatcaccttactgtaatgtaacaagaaaaatagggtacgtctggtacacaaacaatcgactcggaccgatg

SEQ ID NO: 6302 - DNA, 203 bp, Homo sapiens
ggcgcgccagtcctgtattgttgtttgaagaggcaggacaagtagtgaagttggtactaagggccataagggacttgacaagggtctggaacagtgcatcaacaacagcctttcttatatgcctagttaaggtgttaagaggccaggtagtacagggactagtgtggctattactggtaactggtgcacgactcggaccgatg

SEQ ID NO: 6303 - DNA, 203 bp, Homo sapiens
ggcgcgccagtccttacaaacaagacctgtaccattgccagatgggaggtaactggacgtgcatgagaggtgaagtagtcaaatatgtggggggtccagtaaagaagtgtgagtggtgcggctacgtgtttaagaagagagagggtctcccacactatccaattggtaggtgtatgctaagaaacgagcgactcggaccgatg

SEQ ID NO: 6304 - DNA, 203 bp, Homo sapiens
ggcgcgccagtcctactggttacagaagcgtggatgacacaccatgcgatagaggtggagtcgtgatcagcaaaaccggtgagctggaatgcttaataggtaagactacagtgaaagtatttagctcggataaaaaattgggacctatgccatgcagaccaaaagaagtcatatccagtgaaggaccgcgactcggaccgatg

SEQ ID NO: 6305 - DNA, 203 bp, Homo sapiens
ggcgcgccagtcctgtggtagccctgctaggggggaggtatgtcttatggttaatggttgtctacatgatcctggcagatcaaatgacctcagcaataaacctgggccaaggagaggtggttctgataggaaatttaataacacatgaggaccatgaggtggtagtatatttcctcctgttatacttacgactcggaccgatg

SEQ ID NO: 6306 - DNA, 203 bp, Homo sapiens
ggcgcgccagtcctatagtgaaggatgagccagtaaagaagtggatattgttcctctttcatgctatgaccaacaaccctgtaaagacaatatcagttggactgctaatgttaagtgggctagtgaagggggaaggggcaggaatgacctactgggagggcctcgacctgcagtttaccttgctggtacgactcggaccgatg

SEQ ID NO: 6307 - DNA, 203 bp, Homo sapiens
ggcgcgccagtcctatgataactgcatcactattagtggcaagaagggacgttaccacataccctttgataataacagtgatagcattaaagaccacctgggtgaatagtggcccggggattgatgcagcaatagcaacaatcacgactgggctattgatgtggacatttataagtgactactacaaacgactcggaccgatg

SEQ ID NO: 6308 - DNA, 203 bp, Homo sapiens
ggcgcgccagtcctaaaagagtgtcagatgtttatgagatagatgaatcccaggaagccgtatatctgttcccctctaaacagaaggaagggacgatcacagggggtttgctaccactaataaaggccatactgatcagctgcattagtagcaagtggcagtgcttctacctcctatatctggtggtgcgactcggaccgatg

SEQ ID NO: 6309 - DNA, 203 bp, Homo sapiens
ggcgcgccagtcctaaacataaggtgaggaatgaagtggtagcccactggttcaatgaggaagaggtctatgggatgcccaagctagtgagtgtagtgaaagcagcaacacttaaccggagcaggcattgtatactttgcacagtctgtgaaagcagagactggaaaggagagacctgtccgaagtgtcgactcggaccgatg

SEQ ID NO: 6310 - DNA, 203 bp, Homo sapiens
ggcgcgccagtccttgccaaagtaataataggatgacagatgagactgaatatggagtgaaaacggactcaggttgcccagagggtgctaggtgctacgtgttcaaccccgaggcagtgaacatatcggggaccaaaggagccatggtacatctacagaaaacaggtggtgaatttacttgcgtgacccgactcggaccgatg

SEQ ID NO: 6311 - DNA, 203 bp, Homo sapiens
ggcgcgccagtcctgacttaactgacatggtgaaaaagataacaacaatgaatagaggggagtttaagcagatcacactggccacgggtgcaggaaagactacagaattacctagggcggtgatagaagaaataggccggcacaaaagagtgttggtcttgataccactcagggcagcagcagagtcacgactcggaccgatg

SEQ ID NO: 6312 - DNA, 203 bp, Homo sapiens
ggcgcgccagtcctgatgaataccactgtgcaacgcctgaacaattggccataataggaaaaattcacaggttttcagaacagttgcgagtcgtggcaatgacggcaacgcccgctgggacggtgaccactacagggcagaagcacccgatagaggaatttatagctccagaagtgatgaagggtgaacgactcggaccgatg

SEQ ID NO: 6313 - DNA, 203 bp, Homo sapiens
ggcgcgccagtcctatgaattatgattggagtctatacgaagaagatagcctgatgatcacgcaactagaaatcctaaataacctattgatatctgaagaactaccagttgctgtgaagaacattatggccagaacagaccaccctgaaccaattcaactggcatacaacagctatgaagtccaagtacgactcggaccgatg

SEQ ID NO: 6314 - DNA, 203 bp, Homo sapiens
ggcgcgccagtcctccagtgctgttccctaagatcaggaatggagaagtaacagacagctatgacagctattcgttcttgaatgccaggaaactgggcgacgatgtgccagcatacgtctacgccacggaagatgaagacttggcagtggagctacttggtatggactggcccgacccgggaaaccaacgactcggaccgatg

SEQ ID NO: 6315 - DNA, 203 bp, Homo sapiens
ggcgcgccagtcctcatctgcagtttgcacccaacgcaattagaacggatggtaaagaaactgagctaaaagaactggcacaaggagacatccagaggtgtgcagaggcaatggttgggtacgcacagcaaggggtgcaattcatcaaaacccaagccctgaaggtgcaagagaatcatgtattcaaacgactcggaccgatg

SEQ ID NO: 6316 - DNA, 203 bp, Homo sapiens
ggcgcgccagtcctgcttttgggggtgagtctataaacgaccacgtgaaacaggctgcaaccgacttagttgtatattacataatcaacagaccccaattcccgggagacactgagacacaacaggagggccggaaattcgtggctagcttactagtctcagccttggctacatacacctacaaaagccgactcggaccgatg

SEQ ID NO: 6317 - DNA, 203 bp, Homo sapiens
ggcgcgccagtccttggaactatagcaatttatcaaaagtggtagagcctgcacttgcttgtctgccctacgcttcccaggcactcaaattgtttgctccaacgcgcctggagagtgtagtcatcctcagcacagccatttacaagacttacctggcaatcaggcgtggtaggagtgatggtctactgcgactcggaccgatg

SEQ ID NO: 6318 - DNA, 203 bp, Homo sapiens
ggcgcgccagtcctgcggacaataggatcaggctcccccacgagaactaccttagagtcgtcaccaggtgcagatgtgggtaccggacgaaggcagtaaaaaactgtgcaggtgagttaatactggaggaggaagagggctcattcttctgcagaaacaaatttgggaggggagcacccaactacaaacgactcggaccgatg

SEQ ID NO: 6319 - DNA, 203 bp, Homo sapiens
ggcgcgccagtcctaaaagatacacaggggctgggtacaaaggtgccttcctaggggatgaacccaaccacaaaagcctgatcgagaggacctgcgcaaccgtgtgcaaggataagatatacttttcaaagatgaagaaaggctgtgccttcacgtatgatctatctctaagcaacttggtaagattgcgactcggaccgatg

SEQ ID NO: 6320 - DNA, 203 bp, Homo sapiens
ggcgcgccagtcctgtcgacttggttcacaggaacaagcttgaagagaaagatatcccggaacgaactgtaacaacgtggctggcgtatacattcgtcaatgaagacgtgggtaccatcaagccagtcctgggggagaaggtcataccggaagagagtgatgagataaatttgcaaccaacagtaacacgactcggaccgatg

SEQ ID NO: 6321 - DNA, 203 bp, Homo sapiens
ggcgcgccagtcctgtgaatatgtctaagtgtcaggtaacagtggtaggcgaggccaaaaatatgaccaccggggtggttccactcacagtgaccaaagaggcatgtaatggtcaagaccggtcagttctaaacattggaatggaagaaggggaatacccgggccctgctgtaagcactgtcactgtgcgactcggaccgatg

SEQ ID NO: 6322 - DNA, 203 bp, Homo sapiens
ggcgcgccagtcctggtgaagctgttcaaagtaaagatgtgcgcccatatgtattggtgataggttccaataaggcaacatcaaacagggcaaagacagctaagaacgttaagttgtataaaggaggagatgctgtcgaagtcagagacctaattaagaaaggggagatgctggtcgtagctttggcccgactcggaccgatg

SEQ ID NO: 6323 - DNA, 203 bp, Homo sapiens
ggcgcgccagtcctcaagctgaaagaggggatgcaaacctcaaacccttatttgaagaacttctgctacagtgcccacccgggagaacagtcaaaggcggaaccatggtgtcggcataccagcttgcacaggggaactggacgccaactagctgtaaagtatacatggggactataacagcaaaaagacgactcggaccgatg

SEQ ID NO: 6324 - DNA, 203 bp, Homo sapiens
ggcgcgccagtcctgtaaaaatacacccatatgaagcatatataaaattgaaggagcttatagaagagtacaacatgaaaagggtgactggagatacaggtctaaagagacataatgaatggatcttaaagagaatcaaacaccacgggaacctgaggactaagaaaatactgaacccaggtaaagtacgactcggaccgatg

SEQ ID NO: 6325 - DNA, 203 bp, Homo sapiens
ggcgcgccagtcctaaaaacaaggtagaggacataattagagatttaaaatctggaagacctatcaagtattacgaaactgcaatcccgaaaaatgagaagagagatgtcaatgatgattgggagagcggcgattttgtagatgaaaagaaaccgagagtgatacagtacccagaggccaaagtcaggcgactcggaccgatg

SEQ ID NO: 6326 - DNA, 203 bp, Homo sapiens
ggcgcgccagtcctaattggctggtaaacgcagataggccggagagcagaaaaacaggaaaggtctacttgcaaagtggaggccataccgtaagagggaggcattatgaagacctgatattgcctaggatggtgaaaccaacatttcaaggagtagacagatacaaattgggacccatagtcaacgtacgactcggaccgatg

SEQ ID NO: 6327 - DNA, 203 bp, Homo sapiens
ggcgcgccagtcctaataagtcgcgaccagcaacgagcccaatgccaaagggcttcgtgctgtcgcgcatgctggggattctttggcacgccgtgacaggcacggccagacccccagtgctgaaaatgttctggaaaacggtaccactgcgccaggcggaggctgttctgaagaagataaagagagttcgactcggaccgatg

SEQ ID NO: 6328 - DNA, 203 bp, Homo sapiens
ggcgcgccagtcctgtcagggtacaaaacggaacgtgcgtcatcctggcaacagacatgggagagtggtgtgaagattcaatcacctactcttgcgtcacgattgaccaggaggaagaacccgttgacgtggactgcttctgccgaggtgttgatagggttaagttagagtatggacgctgtggaaggcgactcggaccgatg

SEQ ID NO: 6329 - DNA, 203 bp, Homo sapiens
ggcgcgccagtccttggctcatggttgatagttggatggccagagtgactgtcatcctcttggcgttgagtctagggccagtgtacgccacgaggtgcacgcatcttgagaacagagattttgtgacaggaactcaagggaccaccagagtgtccctagttttggaacttggaggctgcgtgaccatccgactcggaccgatg

SEQ ID NO: 6330 - DNA, 203 bp, Homo sapiens
ggcgcgccagtcctacagctgagggcaagccatccattgatgtatggctcgaagacatttttcaggaaagcccggctgaaaccagagaatactgcctgcacgccaaattgaccaacacaaaagtggaggctcgctgtccaaccactggaccggcgacacttccggaggagcatcaggctaatatggtgcgactcggaccgatg

SEQ ID NO: 6331 - DNA, 203 bp, Homo sapiens
ggcgcgccagtcctacggtgctggggggagctttcaacaccctttttgggggggttggattcatccctaagatgctgctgggggttgctctggtctggttgggactaaatgccaggaatccaacgatgtccatgacgtttcttgctgtgggggctttgacactgatgatgacaatgggagttggggcacgactcggaccgatg

SEQ ID NO: 6332 - DNA, 203 bp, Homo sapiens
ggcgcgccagtcctgattatggatgtgccattgacccagaaaggatggaaatccgctgtggagaagggcttgttgtgtggaaagaggtgtcggaatggtatgacggctacgcctatcacccagaatcacctgacacgcttgcacaggctctcagagaggcctttgagagaggcgtttgtggggtcgtgcgactcggaccgatg

SEQ ID NO: 6333 - DNA, 203 bp, Homo sapiens
ggcgcgccagtcctccccaaaacagacttgaaatggccatgtggagaagcactgctccggaactcaacttggtgctgagtgagggagaagcaaacttgaccatcgtggtagacaaaacagatccggcagactataggggaggcactcccatggttctaaagaagactggaaaagagagcaaggtgtcccgactcggaccgatg

SEQ ID NO: 6334 - DNA, 203 bp, Homo sapiens
ggcgcgccagtcctgaagcttcaaaagagtgtgacacaggagtgatgggagcagccgtgaagaatggaaaagccatccacacggaccaaagtatgtggatgagctcctttcggaatgacacgggcacgtacatccatgagcttattctcactgatctcaggaactgcacatggccagcaagtcacactcgactcggaccgatg

SEQ ID NO: 6335 - DNA, 203 bp, Homo sapiens
ggcgcgccagtcctgaggagatcgtgcgctatgtcatagcagttggggtcactttccacttggaattgggaccagagaccatggttcttgtgatgctgcaggcggtcttcaacatgcgcacatgttatctcatggggtttcttgtcaagagggtgatcaccacacgtgaggtggtgactgtttacttccgactcggaccgatg

SEQ ID NO: 6336 - DNA, 203 bp, Homo sapiens
ggcgcgccagtcctggagtggtggagtggaaccctgagttggtcaatgagggaggtgaggtaagcttgaaggtcagacaggatgccatggggaacttgcacttgacagaggtggaacgggaggagcgtcgtttggccttatggcttgtgttcggcctactggcatcggcttatcattggtccggaatacgactcggaccgatg

SEQ ID NO: 6337 - DNA, 203 bp, Homo sapiens
ggcgcgccagtcctgtacacgcattccctccggacagtggacacaaaatccatcaatgccagccaggaaagctgaaccttgagggggggagagttctgggggccatcccgatagacctcccacgtggtacttcaggtagcccaatcatcaatgcacagggagatgtgctgggtctgtacggcaatggtcgactcggaccgatg

SEQ ID NO: 6338 - DNA, 203 bp, Homo sapiens
ggcgcgccagtcctgtcaaccgccggctcttgccacaagggagacagaactgggaggtggccataatggatgaggcacattggaccgacccacacagcatagctgcccgaggccatctttactccttggccaaggagaacagatgtgcactcgtgctgatgactgctaccccacctggcaagagcgagcgactcggaccgatg

SEQ ID NO: 6339 - DNA, 203 bp, Homo sapiens
ggcgcgccagtcctgcgttccctgaatccaaaggagccatagtgagtgaggaaaaacccattcccgaaggagagtggagagatggctttgattggataacagaatttgagggtcgaacagcctggtttgtgccatcgatagccaagggaggcgccatagcacggacactgagacagaaagggaaaagccgactcggaccgatg

SEQ ID NO: 6340 - DNA, 203 bp, Homo sapiens
ggcgcgccagtcctttgattggcacgagacgagtgacgacagcatcagctgcgcaacgcagagggcgagttggaaggcatgaaggacgcacggacctctatgtgtattctgggcagtgtgatgatgatgacagctccttagtgcagtggaaagaagcgcagattctgcttgacaacattactacagtgcgactcggaccgatg

SEQ ID NO: 6341 - DNA, 203 bp, Homo sapiens
ggcgcgccagtcctcggaaatggacctgggaaggtcccgacgagaatgccattgatggtccaggcggcgaactggtcacgttcagaagccccaatggagcggaacggaagctgaagccaatctggaaggacagtagaatgttccgggaggggagagatgtggcagacttcatccagtacgcttccggtcgactcggaccgatg

SEQ ID NO: 6342 - DNA, 203 bp, Homo sapiens
ggcgcgccagtcctctcacggtactgcaaccagaaccgggaaagcagcgtagtggagaggataaccgactggccttcctgttgattggactggggagcgtggtgggccttgtggcagccaatgagctgggctatctggaacaaacgaaaactgacatttcaggactctttagacgtgaggaccagggacgactcggaccgatg

SEQ ID NO: 6343 - DNA, 203 bp, Homo sapiens
ggcgcgccagtcctgggatggtttgggacgcatggacgaacatcgacatacagcctgcccgatcctggggaacttatgtgctcattgtctccctctttactccatatatgctccatcagctacaaacaaaaatccagaggctggtgaacagctcagttgcagcgggaacacaggccatgagagaccttcgactcggaccgatg

SEQ ID NO: 6344 - DNA, 203 bp, Homo sapiens
ggcgcgccagtcctgggggaggcaccccattctttggtgtagctggacatgtcgtggcactcggtgtgacctctttggtaggagcgacgcccacctcccttgcattgggtgttgccttggctgccctccatttggccgtggtcacatctgggctggaggctgaactgacccagagggcgcaccgggcacgactcggaccgatg

SEQ ID NO: 6345 - DNA, 203 bp, Homo sapiens
ggcgcgccagtccttttttctcagccatggtaaagaatccaatggtggatggagagatcatcaaccccattccggatggagacccaaaaccagctttgtatgagaggaagatgagtttgtttctcgccatcggcctgtgcatagcggccgtagccttgaacaggactgccgcggcgatgacagaagctcgactcggaccgatg

SEQ ID NO: 6346 - DNA, 203 bp, Homo sapiens
ggcgcgccagtcctgagggaagcacccttggtgacatttggaagcagcggctgaactcatgcaccaaagaagaattttttgcctacaggcgcacaggggtcatggagacaaaccgagaccaagctcgtgaattgcttcgccgaggtgagactaacatggggttggcagtatcgcgaggctgtgccaaacgactcggaccgatg

SEQ ID NO: 6347 - DNA, 203 bp, Homo sapiens
ggcgcgccagtcctccctcaccccaagggggatgtgtgatggacgtgatcacaaggagagaccagaggggatcaggacaggtcgtcacatacgccctcaacaccatcacaaacatgaaagtccaactcatccgcatgatggaaggagaaggagtcataggaccagctgactcacaggaccctcgtctgcgactcggaccgatg

SEQ ID NO: 6348 - DNA, 203 bp, Homo sapiens
ggcgcgccagtcctgcgtacgggcagatgtggcttctcaactactttcatcgcagagaccttcgcacccttggtttcgccatatgttctgctgttcccgtgagttgggttcccatgggtcgcaccacttggagcatccacgcgagtggtgaatggatgacaacagaagacatgctgcgcatctggaaccgactcggaccgatg

SEQ ID NO: 6349 - DNA, 203 bp, Homo sapiens
ggcgcgccagtcctgcctcctggaaggctcaccaggagttaggccgtttaggagcccccgagcataactcgggaggagggaggaagaaaattggcaatcttcctcgggatttttccgcctcctatactaaatttcccccaggaaactgggggggcggttcttgttctccctgagccaccaccatccagcgactcggaccgatg

SEQ ID NO: 6350 - DNA, 203 bp, Homo sapiens
ggcgcgccagtcctaactcgggaggagggaggaagaaaattggcaatcttcctcgggatttttccgcctcctatactaaatttcccccaggaaactgggggggcggttcttgttctccctgagccaccaccatccaggcacagatagcctgacaaggagatggtgtgtgactcggaaaaacacccgctcgactcggaccgatg

SEQ ID NO: 6351 - DNA, 203 bp, Homo sapiens
ggcgcgccagtccttcgacgagcgtcgaaagtggccccaaagaagacgcgtcagttgcgggtccaaatgccaaatggacttgtactgatgcgcatgctgggagttctgtggcatgccctgactgggactgcacgaagcccagtactgaaagcgttttggaaagtcgttcctttgaagcaggctactctcgactcggaccgatg

SEQ ID NO: 6352 - DNA, 203 bp, Homo sapiens
ggcgcgccagtcctggcactgcgtaagatcaagagaacggtgagcaccctcatggtaggcctgcaccgccgaggaagtagaaggacgaccattgactggatgactcccttgttgatcactgtcatgcttggaatgtgcctcacggcaactgtccgtagagagagagatgggtcaatggtgattcgtgccgactcggaccgatg

SEQ ID NO: 6353 - DNA, 203 bp, Homo sapiens
ggcgcgccagtccttgaagggcgagatgctgcaacccaggttagagtggagaatggcacttgtgtcattcttgctacagacatgggatcatggtgtgatgactcgttggcttacgaatgcgtgaccattgaccagggagaggaacccgttgatgtagactgcttttgcagaggtgttgagaaggtgaccgactcggaccgatg

SEQ ID NO: 6354 - DNA, 203 bp, Homo sapiens
ggcgcgccagtcctactggagtatggacgttgtggaaggcgtgaaggttcacgttccaggcgctccgtgctgattccgtcacacgcacagcgtgacctgaccgggcggggacaccaatggctcgagggagaggctgtgaaggcacacctgacccgcgttgagggttgggtgtggaagaacaaattgttcgactcggaccgatg

SEQ ID NO: 6355 - DNA, 203 bp, Homo sapiens
ggcgcgccagtcctgatgcagctccctcctggagataacataatctatgttggtgacctgaaccatcagtggtttcagaaggggagcagcatcggcagggtcctccagaagaccaggaaggggattgagagactcaccgtccttggagaacatgcttgggactttggctcagtgggaggtgtcatgaccgactcggaccgatg

SEQ ID NO: 6356 - DNA, 203 bp, Homo sapiens
ggcgcgccagtcctcatgactctgggggttggagccgatgtgggctgcgcagtggacacagagcgaatggagctccgatgtggagaaggactggtggtatggagagaggtgtcagaatggtacgacaactacgtgttccacccagagactccggcggttctggcatcggcagttcagagggcctatgacgactcggaccgatg

SEQ ID NO: 6357 - DNA, 203 bp, Homo sapiens
ggcgcgccagtcctagaggaaatctgtggcattgtccctcaaaatagactggagatggccatgtggagaagctctctagtggagctcaacctggctctagcggagggtgaggcaaacctgactgttgtggtcgacaaggcagaccccagtgactacagggggggcgttcccgggctccttaacaagggcgactcggaccgatg

SEQ ID NO: 6358 - DNA, 203 bp, Homo sapiens
ggcgcgccagtcctaacccgagtgaccattgacaaggcatgtgacaagagaggggcgtcggtgagaagcactacagagagtgggaaagtcatacccgaatggtgctgtcgcacctgtgagctgcccccggtcacatatcgcactgggactgattgttggtatgccatggagattaggccggtacacaccgactcggaccgatg

SEQ ID NO: 6359 - DNA, 203 bp, Homo sapiens
ggcgcgccagtcctgacgggactagtctctgtggagagtctgtttcgttaccttgtagcagtcggtctggtgtttcagctggaactgggaccagaggctgtggctatggtgcttctacaggcagtttttgagatgagaacgtgtctactgagtgggtttgtgcttcgtagaagcataaccacgagagacgactcggaccgatg

SEQ ID NO: 6360 - DNA, 203 bp, Homo sapiens
ggcgcgccagtcctaattgtgacagtgtacttcctcctcctggtgttggagatgggcattccagtgaagggtctggagcatctctggagatggactgatgcgctggcgatgggggccatcatcttcagggcatgcactgcagaggggaagacaggcattggtttgcttttggctgcattcatgacccacgactcggaccgatg

SEQ ID NO: 6361 - DNA, 203 bp, Homo sapiens
ggcgcgccagtcctctttcactggtcggggatccttatcgtcatgggactgtggaccatttcggagatgcttggctcacccaggagaacggatcttgtgttttcaggatgctccgaagggcgaagtgacagccgtccgctcgatgtaaaaaatggagtgtaccgcatatatactccaggcctgctctgcgactcggaccgatg

SEQ ID NO: 6362 - DNA, 203 bp, Homo sapiens
ggcgcgccagtcctgggacaaagacagattggagtgggctacggggcaaagggtgtgctacacaccatgtggcatgtcactaggggggctgccctgctggttgatggagttgcagtgggcccctactgggctgatgtgcgggaggatgtggtttgttatggaggcgcctggagtctggaaagcaggtgcgactcggaccgatg

SEQ ID NO: 6363 - DNA, 203 bp, Homo sapiens
ggcgcgccagtccttggcctgtatggaaacggcctcaagactaatgacacgtatgtcagcagcatagcacagggtgaagtggaaaaaagtagaccaaatctcccacagtcagtagttggcacgggctggacagccaagggacagatcacggtgttggatatgcaccctggctcggggaagacccatcgcgactcggaccgatg

SEQ ID NO: 6364 - DNA, 203 bp, Homo sapiens
ggcgcgccagtcctgtgccatgctacatatgtcaacagaagactcctcccacaggggagacaaaactgggaggtggctatcatggatgaggctcattggactgacccccacagtatagcggccagaggacacctctactcccttgccaaggaaaacagatgtgctttcgttctcatgacggcaacacccgactcggaccgatg

SEQ ID NO: 6365 - DNA, 203 bp, Homo sapiens
ggcgcgccagtcctaccggggaagagtgaaccctttcctgagtccaacggagccatagccagtgaggagagacagatccctgatggggagtggcgggacgggtttgactggatcacagagtatgagggtaggacagcctggttcgttccgtcaattgccagaggaggagccatagcaagggctttgagcgactcggaccgatg

SEQ ID NO: 6366 - DNA, 203 bp, Homo sapiens
ggcgcgccagtcctgcagcgagggaagagtgtcatttgcttaaacagcaagacctttgacaaggagtactcaagagtgaaggatgaaaaacccgactttgtggtgaccacggacatatcagagatgggggcgaatcttgatgtcacccgcgtcattgatggccggacaaacatcaaaccggaggaggtcgactcggaccgatg

SEQ ID NO: 6367 - DNA, 203 bp, Homo sapiens
ggcgcgccagtcctggacggcaggatcgaactcacagggacgagacgtgtgacaaccgcgtctgctgcacagcgcaggggaagagtgggcaggcaggggggtcgcacagatgaatacatatactcaggccagtgtgatgatgatgacagtggtcttgtgcagtggaaagaggcccagatactcttggacgactcggaccgatg

SEQ ID NO: 6368 - DNA, 203 bp, Homo sapiens
ggcgcgccagtcctcctgacggcagtggagatgcttgtcctggggcttgcaaccctgggagttgtctggtgttttgttgtgcgcacctcggtcagtaggatggtgttggggaccctagttctcgccacctcactgatcttcctgtgggccggaggtgttggctacgggaacatggctggggtggcactcgactcggaccgatg

SEQ ID NO: 6369 - DNA, 203 bp, Homo sapiens
ggcgcgccagtccttagagaccaaggggagactgtgcgatggggggagtggaccaatttggacatccagccggcaagatcatggggcacatatgttctggtggtatctttgttcaccccctatatgctgcaccaattgcagacaagaatccagcagttggtgaacagtgcagtggcttcaggagcccacgactcggaccgatg

SEQ ID NO: 6370 - DNA, 203 bp, Homo sapiens
ggcgcgccagtcctggcagttactgaggcaggagccgtgggagtggctgcagcaatgcagttgctgagacctgagatggacgttttgtggactatgcctgtggcctgtggcatgagtggagtggtcaggggaagcctgtggggccttctgccactcggccacagactgtggctccggaccactgggaccgactcggaccgatg

SEQ ID NO: 6371 - DNA, 203 bp, Homo sapiens
ggcgcgccagtcctcatggtaaccagcctcgggtggaacctgataaaattcagagcaggcatggatgtgttctcaatggagcctcatcgagcagatgcaatcctatgtgacataggggaaagcaatccagacgcagtggtggaaggagagagatcacggcgtgtgattcttcttatggagcaatggaacgactcggaccgatg

SEQ ID NO: 6372 - DNA, 203 bp, Homo sapiens
ggcgcgccagtcctaaatcgcaatccaacagcgacatgtgtgttcaaggtcttggctccttatcgtcccgaggtaatagaggcactgcacaggttccaacttcaatggggagggggtcttgtgaggacacctttttcccgaaattccacccatgaaatgtacttctcaactgccatcacggggaacatcgactcggaccgatg

SEQ ID NO: 6373 - DNA, 203 bp, Homo sapiens
ggcgcgccagtcctggcctgtctatcgaaggcttacggacaaatgtggctgttgagctacttccacaggagggacttgaggactctggggttcgccatatgttcggcagtgcccgtggactgggtcccaacaggaagaacaacctggagcatacatgcaagtggtgcctggatgacaaccgaagacatcgactcggaccgatg

SEQ ID NO: 6374 - DNA, 203 bp, Homo sapiens
ggcgcgccagtcctgcaagtcaacaggagatgataactcgtacgagctgatctccaacacacaagaaaaatggtgggatgcggcaacgcacgaggctcgtgacggggaaatgatcgctcccgacgcacccctccattggagacaacttcgtgagatcccccaggtgtttaggggcacacgcctgaggtcgactcggaccgatg

SEQ ID NO: 6375 - DNA, 203 bp, Homo sapiens
ggcgcgccagtcctgcaaaatgggtacgtagttaaccactgcgtatcaggattgcaggccacgaagggtatttgcatatctttctatgcggtattacggcttaaaacccgttgtatcttgtagtttgactgcctgtatcactagtggccattttatttaggttagagacccctgatagtaggagagttcgactcggaccgatg

SEQ ID NO: 6376 - DNA, 203 bp, Homo sapiens
ggcgcgccagtcctacaaactctttaaaaattgttgaccccggaaaagatggtgacccctgtaagtagttgatctagaagatctatgcgctggcatagtaatccagtgtttcctgttttaggatgacctctgaaagtagatgaccgtggaaagtcacgtagtgccccaataagcacgtttgggcagcgcgactcggaccgatg

SEQ ID NO: 6377 - DNA, 203 bp, Homo sapiens
ggcgcgccagtcctgttatggcaactgtatcagaacaatggagtcaggttaaaggaaaagttttgaaacttttcttaattttagtcaaatttttaactggtttattactcgtttctctaggtcttaaaattttaaaggatttatccgcattaagtgtaattaaaacatttttatttttactctttggtcgactcggaccgatg

SEQ ID NO: 6378 - DNA, 203 bp, Homo sapiens
ggcgcgccagtccttggttccgtagttctgttattttagcgtcttccaatcttaccgcagagaacttgcaatcgaaagttcattcgttaaactaccctgtagctttacttaggagatttgatttagttgtagaagtagaaatagcccctggttgtactaagcctcgtgctggacaacctttttccaaacgactcggaccgatg

SEQ ID NO: 6379 - DNA, 203 bp, Homo sapiens
ggcgcgccagtcctgtgcgaaaacaagtaatgaaggcaaaggaggaatctcatttaacaatagaaccatcggaaaataatcttttggctacacaaggttggttaagttggtttgtagatagctatgaggaagaaaatgatcttgggtatgataacttcttcgatgaagttgttacacccgaccaatatcgactcggaccgatg

SEQ ID NO: 6380 - DNA, 203 bp, Homo sapiens
ggcgcgccagtccttctcaagaaaaacttggcgctattccacacgtgaaaattgagcaaagtgtttttaacgccacagaggacagtgtgaatatgcagtgtaatggtaatgtagagaacttagcgctacagaattattattccaaagttaatgaaatgttgactgtggaaggatgttcagatcagaatcgactcggaccgatg

SEQ ID NO: 6381 - DNA, 203 bp, Homo sapiens
ggcgcgccagtcctgaatatggatctaattataaatatgaatctcgatatccttttgaaacagcgtgtgaaggaattgacagtgaccctactttcaattcaataaaaaggaaaacttcagctggatatccattgtgttctaaagttaagaatggcaaacaagaaatatttgggagtgatggtcccttccgactcggaccgatg

SEQ ID NO: 6382 - DNA, 203 bp, Homo sapiens
ggcgcgccagtccttctctcccctcaggacacttcctaacttccattattaatagtatttttgtaaatatagctatgtgttatgcgtttgtagaatctcaagaaaagggaaatagatctgaggagaacatacgtgttttcttcaacgatttctctatagtaacttatggggatgaccacgtaattggtcgactcggaccgatg

SEQ ID NO: 6383 - DNA, 203 bp, Homo sapiens
ggcgcgccagtcctttagaacccataaattggtctaatttctttattaaagtgtatagtccattagtaagtaagcagacagaccagctagatctcgtattatgggctagatttaaggatataaaattaggttacccaactgtattacctgttaagacccctactacagatttaattttgcagtcaggacgactcggaccgatg

SEQ ID NO: 6384 - DNA, 203 bp, Homo sapiens
ggcgcgccagtcctcctaattatatagatagtttttcatatagtagtacaataacctccccaactaccatttggtcgactcatttgtgtcctttcttcctttcgaagacggacatacaaggccaccctcaacccacgcttttgtattatttgtccaacttcttcttatactggagaggttctttaaaacgactcggaccgatg

SEQ ID NO: 6385 - DNA, 203 bp, Homo sapiens
ggcgcgccagtcctgaggttagcggaggtgatgactttgaattacaagctcccatcaatgaagggtgggtaggctttgattcggcgtcatcttctcaactaaccttacaatccggagatacttttggttcaacgggcattagagacagtagagtcaatactgtggacaataaagtagattttcaaagtcgactcggaccgatg

SEQ ID NO: 6386 - DNA, 203 bp, Homo sapiens
ggcgcgccagtcctcatctagaatgaacacagaatttctccggacaatgacatccaaccctaagtgtaatagcgaagtgattcaatactatacgacaagaactgatactcaaaaatcagacgtaagtttagccttcatgaacttgaagcctttatttacagcttagtacctgccgcgtccgtgtgggacgactcggaccgatg

SEQ ID NO: 6387 - DNA, 203 bp, Homo sapiens
ggcgcgccagtcctttttcttagggcctttttcacctgggtaaagtgtagttattgcgtataactctggtatcaataccacccggaagaaattatttatctgccatcatgtctcaattaatccaaaccaaaatctctagttataagaattatgttaaccagaaaattaaggaaggaaggtccaacatccgactcggaccgatg

SEQ ID NO: 6388 - DNA, 203 bp, Homo sapiens
ggcgcgccagtcctcaccccttgcttcgggcaactccgaattttgtggaagatgttgaatcggatttgaaaaatttgaatgaagcaatccggactacagatgtttttaaaaattatgttgttgagttgacactaggtcatcaagatctcgattttggctattttaagctatacaatcgtgatcttgagcgactcggaccgatg

SEQ ID NO: 6389 - DNA, 203 bp, Homo sapiens
ggcgcgccagtccttatgaatctccaaatgtaaaacctgtaagagttgaaatgagcttcccaagtggaagagtttctggttccgagatgaatcttgcttctttacaacttgataattatatcaaggaagtgaaggagcagggtgtctccgaccagaatgctgccgaaatttgttcgaagctcgtaacacgactcggaccgatg

SEQ ID NO: 6390 - DNA, 203 bp, Homo sapiens
ggcgcgccagtcctgcggcgagtcaagtgctcctcaacgtctccagagatatgctcggatcgactgaagaagatctgcttgttatgcaagtacttctggaatccctcctctcaagtgttcatctcaataataattatgtatatatgtggttgaaaggtctcccttcaggacactttttgacagctattcgactcggaccgatg

SEQ ID NO: 6391 - DNA, 203 bp, Homo sapiens
ggcgcgccagtcctgccagtttgtttaagcaaattggattgtcatatactttggaggataaagatgcgactgtgaatgctccgtatcggagtttgaatgaagtgtcttatctcaagagaaaatttctctgggatgaagacaagcgtcaatacttggcccctttgagtttagagactattctcgaaactcgactcggaccgatg

SEQ ID NO: 6392 - DNA, 203 bp, Homo sapiens
ggcgcgccagtcctgccagaagctttgtgctcaacgaaaatgtgtgatctgattagaagtaagaaaattcctagttataatatttttaatactgctacatttttaagacccttagttatttagctttaccgcccaggatggggtgcagcgttcctgcaatatccagggcacctaggtgcagccttgtacgactcggaccgatg

SEQ ID NO: 6393 - DNA, 203 bp, Homo sapiens
ggcgcgccagtcctcgataatgctcctgtaattgattcttcaatcgcaggggaaacgaatctcaaacctagtttagtaacggatttccatgataatagacaacatagtgttatttcctttcttcaacgtcctcagttgatcaaaactgttgaatgggctcctggaactgctcagggatccttgttgaccgactcggaccgatg

SEQ ID NO: 6394 - DNA, 203 bp, Homo sapiens
ggcgcgccagtcctaaccattgacatacctgatgatcttatgacatctatggtatatgacaagttagatggtttcgccactttcaaggcggatactatcttccgtgttcaagtcaatgctcagccatttcaatgtggccgtcttgtgatggcttacattccaatgcctgattcgttgtcgaccaggaccgactcggaccgatg

SEQ ID NO: 6395 - DNA, 203 bp, Homo sapiens
ggcgcgccagtcctcgctgagttgaccagggcgatagatcgcattattgcactaccgcatgttcaactcgacattagtgaacaatctgaggttacactgcgagtaccatatatctccccctactctgcctacaatttaattgaaggaagatataggtggggacgtgtggttgttgccgtgtattcccccgactcggaccgatg

SEQ ID NO: 6396 - DNA, 203 bp, Homo sapiens
ggcgcgccagtccttttcccaactaaaatagctgctagcatcaacggtgtaattcagaaaggttctgatatcttgggtaatgttttaccgcagactaagagttttaccaacccagttgctaaaatttcagatgctgcgtttgacattatttccatgataccaggatttaagaaacctgataaaactaacgactcggaccgatg

SEQ ID NO: 6397 - DNA, 203 bp, Homo sapiens
ggcgcgccagtccttcacggtgaaactgtacttttccgaccaacacagtactttggtaatgttgatggtgtagagcattctcataaacttggatatcatgcgatgaatcgcattgatttccaacctgatttcgctggtagtaagatggatgaaatgtcatttgattatgttaaacgcataccaaattacgactcggaccgatg

SEQ ID NO: 6398 - DNA, 203 bp, Homo sapiens
ggcgcgccagtcctcattgattcattttcctattcgaattcaaatgtttatggtgatactctgtggtcaactgcagtttcgccttgttatagatctgccgattatacaacaacaaatggtgctagaaatttttcatttcctacccctacttctcttacttatgcaataggacctttctctttgtggagcgactcggaccgatg

SEQ ID NO: 6399 - DNA, 203 bp, Homo sapiens
ggcgcgccagtcctcaccgtgccttatgctgggactacccctttcaaacgcattagacctgaaatcaaccctctttcctcttctggaattagtgttgatgatttcaatgtgtttgcaacgggtgttcttggtgtaagagcccttactcccttagttttaggatcaactgttgtaccatccacaattcacgactcggaccgatg

SEQ ID NO: 6400 - DNA, 203 bp, Homo sapiens
ggcgcgccagtcctaatattagtggaaatgaaaggtggacctgattttgaggttgagtgccctaacagcaccggctggatgccaatacatagtattactccagccgctactggtagggacactgtagactctgagttggtttcgactgcgcaagaacaagctaactttgcgtctactggacaacatgacgactcggaccgatg

SEQ ID NO: 6401 - DNA, 203 bp, Homo sapiens
ggcgcgccagtcctagggaattgattgtataggcgagttgattagcaaagcttttgagttcgcaagaatctctttttataaatatgttttaaaatctgatgtacctataactcaagaatctccagtaactaagtggtctggtgaagtacaaaaatattacatgaaatatttggaatctcaacttgtatcgactcggaccgatg

SEQ ID NO: 6402 - DNA, 203 bp, Homo sapiens
ggcgcgccagtcctctccagttactatttatatttctggagatacgggtgtgggcaaaagtacactatcttatcctttatctgccgatattataaagaaaatagcaggtgatacaactcatgatctgaaaaataattggaagaaattgatctatacccgaaattctgagcaagaattttgggatggttcgactcggaccgatg

SEQ ID NO: 6403 - DNA, 203 bp, Homo sapiens
ggcgcgccagtccttaatttataagggacctgattctcaaaatatatacttaagatctgcatgggagtattcacttgatactcaatctggtgattgtggtgctcctttaattttaagaaaccctatgtgtagaggaaagatctgtggaatacatgtagctggtctaccaactggtggactcggctatgcgactcggaccgatg

SEQ ID NO: 6404 - DNA, 203 bp, Homo sapiens
ggcgcgccagtcctttgttgatgcattaaaagatgaaaggaaaccgagagagaaagctcataaaacaagagctttttcaggatgtcctttggagtaccttgcggtatgtaagatgtattttcagggtatcgtctcggtattgaccaaatgcaaaaacgaaacgcatattagtgtaggaactaatgtgtcgactcggaccgatg

SEQ ID NO: 6405 - DNA, 203 bp, Homo sapiens
ggcgcgccagtcctagcgtgagattgatgtcccaattcgttctttagatgaaattgcttatttaaaaagaagtttcgttttagacgaagaaagacaacaatggatcgctcctctgaccctggatactgtattggaaacgccaagttggattcatcgttgtgatgatccgatagaagcaactgtttctacgactcggaccgatg

SEQ ID NO: 6406 - DNA, 203 bp, Homo sapiens
ggcgcgccagtcctcctgatgcacttatgtcacctatgattagagaaaaattatctggttttacatcttttagtgctagtaccgtctttcatatacaagtaaatgctcatccatttcaatgtggaagattggttttagctgctgtacctgttccagatattttacctctacataggttgaacatgttacgactcggaccgatg

SEQ ID NO: 6407 - DNA, 203 bp, Homo sapiens
ggcgcgccagtccttatgatgatgttatggattcggatggtaagatagttagagatgaatacgtctatcgtgtagtcgtagaccttcgtgaccagactgaggctactttagtagtcccttttacctcccttactccttataaagtgtgtgcggatgtgtttaattcagcaaatcgtcctaaatacaaccgactcggaccgatg

SEQ ID NO: 6408 - DNA, 203 bp, Homo sapiens
ggcgcgccagtcctatgtgcttttatatgtttgtgtctgtgtctttcaggtttcttcttgattcttcctgagggtactaatcgaatcatgtattttgttttattattatatacgtttttgttcgctttgtccgttcagtggaccaagttttggcaatagctgacacttgtttcacagcttctttctgccgactcggaccgatg

SEQ ID NO: 6409 - DNA, 203 bp, Homo sapiens
ggcgcgccagtcctgaaccaatactttactacccattccgttacaactggaatattaagattcttgacctcacagataaggagggtcaagagagtgtcaataagaagtttttaaggaagtttactaaacttaggaagctttgtttgagacttcaaaaggacactgccttctggaaaaatactagaagtcgactcggaccgatg

SEQ ID NO: 6410 - DNA, 203 bp, Homo sapiens
ggcgcgccagtcctaggttagatatgattcaggatgacatagacaaaatggtcgcacaaagtggccctgttatgagtcagagcttaagtgacagggttgaccgcatgtaccatgagttaatacatacgaatgtcgctcaaatgaatttctctataccgttttcacataatttgtccaaggattcaaagcgactcggaccgatg

SEQ ID NO: 6411 - DNA, 203 bp, Homo sapiens
ggcgcgccagtccttgtagtcgtcattttaacaatgtgcaggaagcttttaattttacaatgagctttatgagatttttagctttggcttatgccatctttttcctcatttcacgagcaactaagttctttggagcgtcattttctacgatatctactgttctgataactcttattactatgacagtacgactcggaccgatg

SEQ ID NO: 6412 - DNA, 203 bp, Homo sapiens
ggcgcgccagtcctactgacaagttagttaagaaatttttggtcgattactactcaaaacacatggaaaatgctaaaatgttagcccaagcaggagaggaagactcgtcttttctatcctacgtcattcccccattgtttttagaatcagttgtagatacaaaatctaacttgtttaagaggatttggcgactcggaccgatg

SEQ ID NO: 6413 - DNA, 203 bp, Homo sapiens
ggcgcgccagtcctaagagtaaagacctggaccttgttgttaagaggttgtcgtattttggtgatgctaaaatatacaatgcctttgacaatataggcacgtggttgactacgatgatcaacaagacagtaaattatgtaaaggttacactcttgggccatgatcctgaagaatttttggagaatcagcgactcggaccgatg

SEQ ID NO: 6414 - DNA, 203 bp, Homo sapiens
ggcgcgccagtcctgttaagagggctccttctgaaagtggtacattctctactgattgttatactttcgtggaatatgatccatttgaccactgcaacatcgttaaatcaatgtctttcaatgaattgatagatgaggtggttgccatgtatttccacgaaggagagtttgtatcttccgtagataaacgactcggaccgatg

SEQ ID NO: 6415 - DNA, 203 bp, Homo sapiens
ggcgcgccagtcctcgatttccatcatcgttgacctttgatcaagcagtgttggggatacctggagaagactatgtcaattcaataaaacgtgatacctcttgcggttatcctttcgttaaggaaggatggacacgagctaaaatcttcggtaacggtgatgaatatgacatgtctacctcgggtgttcgactcggaccgatg

SEQ ID NO: 6416 - DNA, 203 bp, Homo sapiens
ggcgcgccagtcctcaaatgttacgagagaaagtacaggaatgcatagaggcggcgagacaagggaagatattggaccattattttatagatacattaaaggacgaaaggaagcctaaacataaggctcataagtctcgaatgttttctaatggaccaatagattatcttgtttggagtaagatgtatcgactcggaccgatg

SEQ ID NO: 6417 - DNA, 203 bp, Homo sapiens
ggcgcgccagtccttttaatccgatagtagcggtgttgtctgagcttaaaaatgtagaccatatttccgtggggtccaatgtgtattctacggactgggacgttattgcaaggtacttgaagtcgaaatctcaccatatggtggctggagacttcgagggctttgatgcttcggaacagtccgacatacgactcggaccgatg

SEQ ID NO: 6418 - DNA, 203 bp, Homo sapiens
ggcgcgccagtcctgttgtattggaaatgcctatgtggaccaaatccagcaaggacattgtaactaatgtattctgtaatttggaacacgccctcaaggagttatcattgcatgataaagaattgtgggaaaaatggagtcctgtattgcattcaaagagtgaggaagtcctgaaaatggtttcttctcgactcggaccgatg

SEQ ID NO: 6419 - DNA, 203 bp, Homo sapiens
ggcgcgccagtcctctgaaatttcaagatgaggtcagggagattgctcttggcctttcaggttatgagtagttttcttgacttctcttaaaaccaacaatgtgatcttgcttgcggaggcaaaatttgcacagtataaaatctgcaagtagtgctattgttggaatcaccgtacctatttaggtttaccgactcggaccgatg

SEQ ID NO: 6420 - DNA, 203 bp, Homo sapiens
ggcgcgccagtcctgatagtgcttgaagatggaccgcagatggaagaacctcttccttatgcattccatggacagcatactgataatcgtcaacatacggtggttaatttcttgcaacgtccccaggttattttcgattcgtcttgggcgtctgatctccctcgaaacaaacaatttatggattcgatcgactcggaccgatg

SEQ ID NO: 6421 - DNA, 203 bp, Homo sapiens
ggcgcgccagtcctaggcgcagcttttaaacaatctgtttcaaagctgggcgaacatttacctttcctcaaatctggagcgaactgggtcagtgagaacattctacaacctgcagatgaaatcataggacctattttatctctttttgggttctcgaagccccttttgcccattaccaatcccaccgtcgactcggaccgatg

SEQ ID NO: 6422 - DNA, 203 bp, Homo sapiens
ggcgcgccagtccttcacatcagtactcctttggcaatagaacaaatacctataaagggagtcgcagagttccaaataccgtactatgctccatgtttgtcatcttcgtttagagcgaattcggaaacattttactatagttcaggtcggaataatctcgatatagccacttcacctcccaccgtcaacgactcggaccgatg

SEQ ID NO: 6423 - DNA, 203 bp, Homo sapiens
ggcgcgccagtccttcgctattatgcggttggtgcgggagatgatatggacttttccatctttatcggtacgccgccctgtattcatgcatctcagacggcccagtttaccaagataaaacaaggtaaagtgtatgatttgaggtatgatcagtacgacccttttagggaagtccaggacggtacggccgactcggaccgatg

SEQ ID NO: 6424 - DNA, 203 bp, Homo sapiens
ggcgcgccagtcctgttcctcaatgctcgtagtattgaggatagcgatttgttgtgagctcctttagagggagggctcactttatctattgcttaattcggtaagccacaaatttttctaagtgtcatgagtttcttctcggttcttctcatgattactaatcgaaccgtgtgtagagtcagaatgttcgactcggaccgatg

SEQ ID NO: 6425 - DNA, 203 bp, Homo sapiens
ggcgcgccagtccttacaatgtgatcatgtcttttcaacaaacaaacaacaacgcaaccaacaacatcaactcccttgaggagcttgctgctcaagaactaatagcagcacaatttgaaggaaatcttgatggtttcttttgcactttttatgtgcagtccaaaccacaactattggacttagagagtcgactcggaccgatg

SEQ ID NO: 6426 - DNA, 203 bp, Homo sapiens
ggcgcgccagtcctggacaattgaacggaaatttaacaagaatttgtgattttttggaaaactctctaccgacactaacagcccaaattcaaacaacagttttgacaacaacagacaaatatgtgaatttgaaagaagacttgctaaaggttgccattctacttgtcctagtccgtcttttgatggtccgactcggaccgatg

SEQ ID NO: 6427 - DNA, 203 bp, Homo sapiens
ggcgcgccagtccttgggatgaaacatacttttcaaacttactttcacaaggctttatggcaggaaaatctctgatagaaatggaagctgaatttgctagtgatgctgaaacgttcaacgcatatattgagtacaaaaagaatattcccaaagaaaccaaatggagcaagtggatgaccattttggaccgactcggaccgatg

SEQ ID NO: 6428 - DNA, 203 bp, Homo sapiens
ggcgcgccagtcctggagacagtaaaacgcaaaaacagcgaaacacaaaagtagaagttggcaaagaacttgaaaaagaagctgaaactcaaggttgcagcgacccagcagctcatgctttggtgcttgatgtgttgcagaagaatacgtactgtttatattatgagcgaatggtgaaaggagaaatgcgactcggaccgatg

SEQ ID NO: 6429 - DNA, 203 bp, Homo sapiens
ggcgcgccagtcctggaacgttggcaacatttcatcagagtgctaatgaactgtgtcgtgcatatcagtggctacaagccatccgtcctttggaccaagaaattaccatttatcatgaagataccgacatgtttgattacgagagtgaaagctatacacagcgggattgctatgaatacaatgcgcctcgactcggaccgatg

SEQ ID NO: 6430 - DNA, 203 bp, Homo sapiens
ggcgcgccagtcctaataacattacagtgcaatgctgctttgaaccaccatcagatatcaaagataccatgagtggagaaacgcctgaaggaaaattttgcgctatcggaaagagtaatatcaaggttggtcaggcggtaaaaacaactttactaaaatcttgtatctatggaatgttgagcaaaccacgactcggaccgatg

SEQ ID NO: 6431 - DNA, 203 bp, Homo sapiens
ggcgcgccagtcctcaccaactacaacgaactgtcgcacctttgcaaaaagatgttatttacgaaatgctaaactggacacggaacactattgacccaaacgaaattctaatgatgaacataaacacagcttttagagaaatagtataccatggaaagagtgagtaccagaagttgcgtagcggaattcgactcggaccgatg

SEQ ID NO: 6432 - DNA, 203 bp, Homo sapiens
ggcgcgccagtcctgcaactaacctttggtcatctagtgaccctgtagaaaaacaattgtatacagccaatttcccagaagttctaatttctaatgctatgtaccaagacaaattgaaaggtttcgtaggacttcgcgccacacttgttgtcaaagtacaggttaattcccaacccttccagcaaggtcgactcggaccgatg

SEQ ID NO: 6433 - DNA, 203 bp, Homo sapiens
ggcgcgccagtccttacgccggtgatttaacactggctgataccagaaagattgaagcagagagaacgcaagagtattccaataatgaagacaatagaataacaactcagtgtagcagaatcgtcgcacaggttatgggagaagatcagcaaattccacgaaatgaagcacagcacggcgttcaccctcgactcggaccgatg

SEQ ID NO: 6434 - DNA, 203 bp, Homo sapiens
ggcgcgccagtcctttacaagactcttttaattcccttatttcaacgagttcttctgcagtgacgaccacagttttaccatccggcactattaatatgggtccatccacacaagtaattgacccaactgtagaaggcttgatagaggtagaagttccctattacaatatttcacatattacacctgctcgactcggaccgatg

SEQ ID NO: 6435 - DNA, 203 bp, Homo sapiens
ggcgcgccagtccttgtcctgcactgaacttgtttctgtctctggagtgctctacacttcagtaggggctgtacccgggcggtcccactcttcacaggaatctgcacaggtggctttcacctctggacagtgcattccacacccgctccacggtagaagatgatgtgtgtctttgcttgtgaaaagctcgactcggaccgatg

SEQ ID NO: 6436 - DNA, 203 bp, Homo sapiens
ggcgcgccagtccttgtgaaaatcgtgtgtaggcgtagcggctacttgagtgccagcggattacccctagtggtaacactagcctctgggcccaaaaggcatgtcatttgaccactcaggtacacaaccccagtgatgcacacgcttagtaatggcttagtaacaaacattgattgatcatttgaaagcgactcggaccgatg

SEQ ID NO: 6437 - DNA, 203 bp, Homo sapiens
ggcgcgccagtcctactctaccgcaggcattttggcccaatcaagattttccagcatgggggcagtctcgttattttgcagcagtgcgctgtggctttcatattcaagtacagttgaatgttaacatcggttctgctggttgcttgattgccgcgtacatgccaaagacggcccatgatcatatgaaccgactcggaccgatg

SEQ ID NO: 6438 - DNA, 203 bp, Homo sapiens
ggcgcgccagtcctggttcacctacaacagtggatgtgaccatttttggttcattactcgacttggattttcagtgtcctcgtcctcctggtgcagacacagtaatttacacacaagggaaaagaactgttcgaaagaccaagacatcaaagttcaaatgggtcaggaataaaattgacatagctgaacgactcggaccgatg

SEQ ID NO: 6439 - DNA, 203 bp, Homo sapiens
ggcgcgccagtcctccagatggtcgaaggggctatttcacctggtcacatacaatctcacctgttaattgggtttttgatgaccacatttatttggaaaacatgcccaatctgagattattctcctcctgttacaactattggaggggctcctttgttattaaactgacagtttatgcgtcaactttccgactcggaccgatg

SEQ ID NO: 6440 - DNA, 203 bp, Homo sapiens
ggcgcgccagtcctaacaaaggacgcttgaggatggcatttttcccaaacagagaaggcgcctacacacaggatgaagctcagaacgcaatctttgttgtgtgtgatataggcttgaataatacctttgagatgaccatcccctacacttggggcaactggatgagaccaacaagaggaaactccttgcgactcggaccgatg

SEQ ID NO: 6441 - DNA, 203 bp, Homo sapiens
ggcgcgccagtcctgttccattaagatgtgttaaaggttcagacaggaattcagccggacttggttctctcttcacacaggctgtgggcagaacaatctctaatcgggtacaaatctttgtgagcttccgctgtcctaattttttcttcccactacctgcgcccagggaagccacgtctcgaagcatacgactcggaccgatg

SEQ ID NO: 6442 - DNA, 203 bp, Homo sapiens
ggcgcgccagtcctgggaaatttttgaaccaatgtggtgacgtggaaaccaacccaggccctgacattgagttggtctataaaaacagaggcttctataagcattatggagttagatttggtggtcatatctaccacttgaattcacaagacattctgtcaaccgcaattacaggcaagtctgacttccgactcggaccgatg

SEQ ID NO: 6443 - DNA, 203 bp, Homo sapiens
ggcgcgccagtcctaaagccttggggattattggggtcatcttgttgtcagcctctcttctttcattgcttgctgtaccctgggattattcctcacttcaaactgtttataaccaatccattgaaggtgatgcttctggcctcacactcctaagtcaaagatgcatgacttttttttccaatacaatgcgactcggaccgatg

SEQ ID NO: 6444 - DNA, 203 bp, Homo sapiens
ggcgcgccagtccttgtgaaacttttaataatgatcttgttaagtttattattaagattttggtgcggcttttgtgctacatcgttctttattgccatgcaccaaatatgctgacaaccatgtgtctgggaactcttcttgttttggacattacaacttgtgaaatcttgtctgctaacaccaaagcacgactcggaccgatg

SEQ ID NO: 6445 - DNA, 203 bp, Homo sapiens
ggcgcgccagtcctctctttcaggcattggttgatggtgatgtgaagagtcttgtctggaaaattgctgagaatatgcaatttgcccaatccaaggatgaacaagctgaggacatggcagcaaccttcaactttgcctctgacatggttaattttgtgccaatggaacagatgagacaagaaggctggcgactcggaccgatg

SEQ ID NO: 6446 - DNA, 203 bp, Homo sapiens
ggcgcgccagtcctggtggtagggcttggaagaccctctccatggatgaacttgtgaaacaaatcacggcagtttacacacagaggtcagatgcccttatggtttggaaaaggaagttgaataccatcaggaacgaaatgagccctggatcatccaccggcaggatttttgaacccttagaggaaacacgactcggaccgatg

SEQ ID NO: 6447 - DNA, 203 bp, Homo sapiens
ggcgcgccagtcctaaccctcaaactgcaatttctaagaaggggggtaagcctaagctctcattagtgaaaaccacaaactttgttaatgaagcaccctatatgcaagatcttgaacattgctttgcacaaacggcctacatttcttctccagaaacccaagatataatacattgtgctgccttgagtcgactcggaccgatg

SEQ ID NO: 6448 - DNA, 203 bp, Homo sapiens
ggcgcgccagtccttcaaaaaaaggaatgtgtgggggccttttggtcactagagtgcatggcacattcaaggttctgggaatgcacattgcaggcaatgggcaagttgcacgagctgcagcagttcactttatatccaatggtgcagctggctttatggatcaaggtgttgttgtggccaaagaaaagcgactcggaccgatg

SEQ ID NO: 6449 - DNA, 203 bp, Homo sapiens
ggcgcgccagtcctttacaaaagcccatttatttgccatctaagacagctttgaatcccagtcccttgaatggtgtagtccccgtgaaaatggaaccagctgtgcttagtcctcatgacaccaggcttgaagtcatcatgcccagcgttgtgaaaacagcggcagctaagtatagagttaatatttttcgactcggaccgatg

SEQ ID NO: 6450 - DNA, 203 bp, Homo sapiens
ggcgcgccagtcctttaattaaaagttgaacctgtagcgtcagtaaaacgcagtaaccgcaagcaattgcctgtagcgtcagtaaaacgcaatacacaagatttgagcctgtagcgtcagtaaaacgctgcaaccacaagctattgactgtagcgtcagtaaaacgcaaacattcttgtggcgctcgccgactcggaccgatg

SEQ ID NO: 6451 - DNA, 203 bp, Homo sapiens
ggcgcgccagtcctgtagcgctcaagtgcagagcttcccggctttaagggttactgctcgtaatgagagcacatgacattttgccaagatttcctagcaattgtcacgggagagaggagcccgttctcgggcacttttctctcaaacaatgttcgcgcgcctccgcgcgccccccctttttcagcccccgactcggaccgatg

SEQ ID NO: 6452 - DNA, 203 bp, Homo sapiens
ggcgcgccagtccttaagtggatctccaatttggcctgttctgaactacaccatctactgctgtgaagaatgtcctgaaggcaagctggttacagccctgatcaggagccccgctcgtgactctcgatcgacgcggggtcaaaaactgtctaagcagcagcagaaacgcgggagcgtttctttttcctcgactcggaccgatg

SEQ ID NO: 6453 - DNA, 203 bp, Homo sapiens
ggcgcgccagtccttatttgtttcatgatggcggcgtctaaggtatacagagtgtgcgagcagactctactagcaggcgctgttcggatgatggacaaattcttgcaaaagaaaacagtttttgtgccacagcttgacaaacaggtaaggttgactggtcttcacaattatgacaacacatgctggctcgactcggaccgatg

SEQ ID NO: 6454 - DNA, 203 bp, Homo sapiens
ggcgcgccagtcctagagacacccaaaacagaagatgtactagttttcgcgccctatgactttgagtcattgggcaaagaccctcctaagttacatcagaggtatgagaaggcgtttgaacgccttagcggagctggtacatcgactccaacgactggcaaccagaacatgtcaggaaacagtggttccgactcggaccgatg

SEQ ID NO: 6455 - DNA, 203 bp, Homo sapiens
ggcgcgccagtcctcacgctttccagacattacacattcaaagtgggtgagtggcctcattcacaatcacacggccacgcctggatttgtccactgcctggagacaagctgaaaaagatgggcagcttccacgaggttgtcaagtctcaccacctggtcaagaatggctgggatgtggttgtacaagtcgactcggaccgatg

SEQ ID NO: 6456 - DNA, 203 bp, Homo sapiens
ggcgcgccagtcctcaaggcaaaatttttggttgcttttgtgcctccccacactgctgcgccaaaaacgcgcgacgaagctatggcatgcattcatgctgtgtgggatgttggcctcaattctgcattctcatttaatgtgccttattcttccccatctgacttcatggctgtttattctgcggatgccgactcggaccgatg

SEQ ID NO: 6457 - DNA, 203 bp, Homo sapiens
ggcgcgccagtcctggatggcgagcccggtgagacagaaccacggcacgctttgtcccctgtggacatgcatgtccacacagacgtcagttttctgcttgacagattctttgatgttgagacaattgaactttcaaatttaacaggctccccaactactcatcttttggatccttttggttccactgccgactcggaccgatg

SEQ ID NO: 6458 - DNA, 203 bp, Homo sapiens
ggcgcgccagtcctccagcttgcttgggctcgacttctcaacacttgtacatacttcttctccgacttggagttgtctattcagtttaagtttaccaccaccccatcttcagttggagagggctttgtgtgggtcaaatggttcccggttggagcaccaaccaagaccactgatgcctggcagctaaacgactcggaccgatg

SEQ ID NO: 6459 - DNA, 203 bp, Homo sapiens
ggcgcgccagtcctggagtccacttacaattggctgcccggtgctcactttggctctatattgctgacatctgatgcacatgacaaaggagggtgttacttgcggtaccgctttccgcgagcaagcatgtattgccctcggcccattccaccggctttcactcgccctgctgacaaaactaggcacaacgactcggaccgatg

SEQ ID NO: 6460 - DNA, 203 bp, Homo sapiens
ggcgcgccagtcctagagacatattctcctttttacaagacggcaaaaatgctttttaaacttgcaacactggctgtgacggcaatgcggaccaaggacccggtggttgtggtcatgctgattgctgattttggattagaggtgtttgacacaggttttttcttttcctattttcaagaaaagctgcacgactcggaccgatg

SEQ ID NO: 6461 - DNA, 203 bp, Homo sapiens
ggcgcgccagtcctgttcaaggacatgcaacagcgtgctctcgctgtgaaagataaaggcctcttttccctgctgcaaatcccactagtcaacttgcccacaagcaggccagagcctgttgtgtgtatccttcggggtgcatcaggacagggaaaatcttatttggcaaatttgatggctcaggcaatcgactcggaccgatg

SEQ ID NO: 6462 - DNA, 203 bp, Homo sapiens
ggcgcgccagtcctccccatggctcacttggatgataagggcattccattcacttcccctgttgttatttgtaccacaaacctgcattcatcttttacacccattactgtttcttgtccagaagctctcaagcggaggtttcggtttgatgtgacggtatctgtaaagcctggctttgtacgtactgtcgactcggaccgatg

SEQ ID NO: 6463 - DNA, 203 bp, Homo sapiens
ggcgcgccagtcctaaacagacaagacacacacaaaatgcccatttttaaacaatcgtggtctgacttgtttaagaaatgttcaactgatgaggagcaaaaaatgttacaatttttgattgacaataaggattcagaaattttgagggcttttgtgtcggaacgctcaattttgttgcatgaagagtacgactcggaccgatg

SEQ ID NO: 6464 - DNA, 203 bp, Homo sapiens
ggcgcgccagtcctctcgcgggggtattgtggcgcagcaattgtggcaggctcacctgcccgcatcattggcattcattctgctggtactgggtctgtagccttttgctccctggtgtccagagatgcgctggagcgcactctccctcagaaacagggcaacgttgttcgtcttgatgatgatgtgagcgactcggaccgatg

SEQ ID NO: 6465 - DNA, 203 bp, Homo sapiens
ggcgcgccagtcctccagaaatggcttctgcgcgcagctcatgtttatgctcaacgggtctttgcccgtattggatttgacaaccaggctttgactgagcaggaagccatttgtggcattcccggccttgacaagatggaacaggacaccgctcccgggttgccctatgctcaacaaaacaaaagaagcgactcggaccgatg

SEQ ID NO: 6466 - DNA, 203 bp, Homo sapiens
ggcgcgccagtcctgatgccccatgtggtggttggtaggcagcttttgggccggtttgtggcaaagtttcatgaggcaaatggatttgagactggttctgctattggatgtgacccagatgtggattggactcggtttggtcttgagctggaacgttataggtatgtgtatgcctgtgattactcccgcgactcggaccgatg

SEQ ID NO: 6467 - DNA, 203 bp, Homo sapiens
ggcgcgccagtcctctgtacatccattttaaacactgttttaaacaatgtttacattcttgcagctatgatgaaggcttttgagaactttgagccggatgatatccaggtgatttgctatggggatgattgcctcattgcttctgaccttgagattgactttcaaaagttggtgcctgtgttttccagcgactcggaccgatg

SEQ ID NO: 6468 - DNA, 203 bp, Homo sapiens
ggcgcgccagtccttgaaaagctcctgtctgttgcgcagttggctggccactgcgaaccagaacagtatgagcgcctgtttgagccttttgctgggatgtattacgtccctacttggcgtgatttgcgcctgcagtggctaatgaagcttggatgctaaatctttttctggttttgtttttctttgttcgactcggaccgatg

SEQ ID NO: 6469 - DNA, 203 bp, Homo sapiens
ggcgcgccagtcctgacacccccagcaaggctgagcagtccgttgagcgaggatttacgtttcagcttgcacagtgggagacatccagaaacatttgggaccatttgacaatccctcttcccatgtgccctggtcttattaaggtctctggaatgtacaaagctttcattgaaacccacgcctacattcgactcggaccgatg

SEQ ID NO: 6470 - DNA, 203 bp, Homo sapiens
ggcgcgccagtccttcttggttgccggagcgcagttttatacctggaaagttcactgatttcctgcaagtagctgttataccaactttggctgaagtttctgttcaaaactacaaaccagtgccttcctttccagtgagtaatgttttacagactaagcctcttgtaaatactgatttgacttttactcgactcggaccgatg

SEQ ID NO: 6471 - DNA, 203 bp, Homo sapiens
ggcgcgccagtccttctatgactttccgcaacacttatgtgtctgcgctttctcttcagtacacccagtatagaggttccatttgtatggatttactttttacaggaagtgctatgtgtcaaggaaaatttgttgtgtgttatgtgcctcctggtcgggaacctcagtctttggatgaggccatgcagcgactcggaccgatg

SEQ ID NO: 6472 - DNA, 203 bp, Homo sapiens
ggcgcgccagtcctgagcaaggaactgcttcgcgtacactcgtgcgcactaaccacataacagcagaatttgtggagaaaacacccctgaatggtttggctgcagtttttacgtcattgtctactagtggttattctactaagcttgtttctgaacccatccccgaagcaactttgtctaccattctgcgactcggaccgatg

SEQ ID NO: 6473 - DNA, 203 bp, Homo sapiens
ggcgcgccagtccttctgagggtgccacaaatttttctttgttgaagttagcaggggatgttgaacttaaccccggcccaactatttggtcagtgatgcccggtggtgaactcattgaatttgctacaaaggtctctcaagtttacaagaccatcaaagaaaaatgcactgaccctaccacttggattcgactcggaccgatg

SEQ ID NO: 6474 - DNA, 203 bp, Homo sapiens
ggcgcgccagtcctaggtctatccggcgcacctttttcgacgactcgtcatccgagtccgaagatggagaaccggaggttcctcaattcagaccccaggtctaccctaggccacgcagtatgagagtagtcagacatcccatgacagcgcgacgcgcccaacgcgtcattgacatgggatactctgatcgactcggaccgatg

SEQ ID NO: 6475 - DNA, 203 bp, Homo sapiens
ggcgcgccagtcctcagcgcgttcattgcgaggagaatcaggcccttttgtccgaggggatttcctccactctctcagttttgaatggtttcttcaatcttttcaaaaatgtgcaatggtttttggatttcctcaaaagctgctatggcaaactttccaagcaattgaaaccaatgcagtctctccgccgactcggaccgatg

SEQ ID NO: 6476 - DNA, 203 bp, Homo sapiens
ggcgcgccagtcctcaagaagcggtcactcgccgctattggaaggtgattgatgttagcgcagatgatcagtataaaactgtggatggcaggctggactacgccaaagccacgcaacctacccagattccccctgaattggctgtgttcaaaactcatgtccctcttttgaagggcgctctgcgtgaccgactcggaccgatg

SEQ ID NO: 6477 - DNA, 203 bp, Homo sapiens
ggcgcgccagtcctactgctgaacatcgcagacgcttcgtcgaacaaaatccaacttttcattttaaggaaactgaagctgacttttatgaacgtgttgcattcctttctggcattcatggtcgaaagcaatccattcttaagaaaatcaaggagtggttcgcggacggcgtgcgtgtcagaaatcttcgactcggaccgatg

SEQ ID NO: 6478 - DNA, 203 bp, Homo sapiens
ggcgcgccagtcctcacattacagctggacgcaattctgcaactcgcgaccagctggaggcagtggatgtaattgatcagtttgacatgccaagtgacgctgtcgcggttaagtttccagacaagcgcggctcctcctacaaaaacatcatgcaccaccttgcctccaccctccctattcgtggaaaacgactcggaccgatg

SEQ ID NO: 6479 - DNA, 203 bp, Homo sapiens
ggcgcgccagtcctaccaaattgagacccactgtcgcaatcaacacttttgagtgcgacgtggaaccagccgtcctgtccaaattcgacagacggctcgaggaacctgacagttttgagttgacccttctgcacaagaatgacaggcgctatccagaggacacttctatggacaagcacctggaggctcgactcggaccgatg

SEQ ID NO: 6480 - DNA, 203 bp, Homo sapiens
ggcgcgccagtcctgctgttgaggcttatgcttcctcattgtttgcacagattggtactgacaatggaatcatttcagagtatgaagctgttactggcattgagaatttggactcagtggagacaacaacgtcacctggactaccctacacgacagcggggattccaagagaggcgctgtttgacccacgactcggaccgatg

SEQ ID NO: 6481 - DNA, 203 bp, Homo sapiens
ggcgcgccagtcctggccgaatgctgcttggaaaatttacagctaaaatgcatgctaacaatggattaggcattggttcagccgttggttgcaatccagatgtagactttactagatttgcttaccaaatcttggaatgggactatgtttatgacattgattacaaaaattttgatgcttcacattctcgactcggaccgatg

SEQ ID NO: 6482 - DNA, 203 bp, Homo sapiens
ggcgcgccagtcctatgggaatgcaggactggacttgtgctgcctgacagggtcgcggctggccgtctgtactttgtatagtcagttgaaactcaccatggcatgtttgaaaattttctctctgaaacgcaaagataagagccactcatactctcctcgtgagattgagttgaaatataattcagattcgactcggaccgatg

SEQ ID NO: 6483 - DNA, 203 bp, Homo sapiens
ggcgcgccagtcctggacctctagaatggaaaatggtaataccaataactctggcaacactggagtgatcaattacaatttttactccaactcatacactgacgcagttgatctatctggagcaatgtcttcgcaggaatcaaatgctgctgagaatgctgcatcagggcctacatctcttcttaaagcgactcggaccgatg

SEQ ID NO: 6484 - DNA, 203 bp, Homo sapiens
ggcgcgccagtcctttgccgatgagggtacatcaggtggcccggcagtctcacggtttgtgacccttagggcccaatcgtggtcgacatctcaagatgtgtattcattccaagctgctcacctgccatatgctcttgttgcacaggaaacaccattcaaggcccttatgtccaaacaccagctgcttacgactcggaccgatg

SEQ ID NO: 6485 - DNA, 203 bp, Homo sapiens
ggcgcgccagtcctataatccagacaagatgtatagcacatggcactaccaccacacttttgatgatacagataagcattggtacaaaccagaagaacagccatacggtggcatatcacctcagtccctgttttgctttccccatcagctgattaatcctaggacaaattcatcagcaacattgtgtgcgactcggaccgatg

SEQ ID NO: 6486 - DNA, 203 bp, Homo sapiens
ggcgcgccagtccttaccttatgtggactgtggccccataactgatgtcactgtccactgtccctgggctattgtgattgtggttttgcgccagctactggtggccaacggtggaacacccagtgttgacattaatgtttccttggctccatgcaatgttgagtatcatggactccgtcagagttctgcgactcggaccgatg

SEQ ID NO: 6487 - DNA, 203 bp, Homo sapiens
ggcgcgccagtcctagaattgtaggcttgttttggcctggacatcacagggctttaacgcaccaatgccaaccactatggctgaagcaatgcaaggccattatgttatctatgacaccggtgtggacagcagtgtagatttagttgttccctatgtggcaccatatgattttacccctgtgcgaactccgactcggaccgatg

SEQ ID NO: 6488 - DNA, 203 bp, Homo sapiens
ggcgcgccagtcctttctaaagggaccctccaacatctcctccggcttccagggaaacatggattctccacttcagccagctgagacgggatgtgacaaggcaatggcacccagtgcttcaaatgagaaccccgtccctctgtcagttgagagcattggttcgtccagggtttcgttcttctgggacacgactcggaccgatg

SEQ ID NO: 6489 - DNA, 203 bp, Homo sapiens
ggcgcgccagtcctggtatttccacatctcaacaatcacaaagatgactaatgttgacccgcaatacttgcggttgaacatctcagacatcctgcgggaccctgtaatacgtcagtccctacatgccacctatttgagatgtgggctatctgttgctgtgagagtgatgccagcaaatccagctagtacgactcggaccgatg

SEQ ID NO: 6490 - DNA, 203 bp, Homo sapiens
ggcgcgccagtcctgcaagaaagagggttgctgctgtggtaacaaacacaactaccctgatgaactgaaccctttttcagagaatgggttctggagccgcttcaagaaagggcacctccaaggtccaatgcaggatgtgagctctttgattaacatcctgaagggtgcagaatggatttaccaccaatcgactcggaccgatg

SEQ ID NO: 6491 - DNA, 203 bp, Homo sapiens
ggcgcgccagtccttgagaaaatgtgctgcccatgttaacccaagattgatgggcatgtttcctgaatttgacccatctccacctgatcctactcgccccgagccagttgttgtcgtcttgcgcggcgcacctgggcagggtaagagtgtgtgttctgagatgcttgccagaatgctttcttacacctcgactcggaccgatg

SEQ ID NO: 6492 - DNA, 203 bp, Homo sapiens
ggcgcgccagtcctctcttttaaagttagttgagatgcaagggccaaaaggacaagccaatatggaaatggaaagaactttaatgaagaagaacatagtggaaatgacatatgagaagcacaacgggaggtttcaaactaccacagtcctgtttgtgcgtgatcggatttttctgatcaacactcacacgactcggaccgatg

SEQ ID NO: 6493 - DNA, 203 bp, Homo sapiens
ggcgcgccagtcctctggcacaccaatagttggcttgatgaagacagaaggtagcagttatatctggtctggtgaatgtctcccatttaaaaatacaatgaacacttatgaaggctgtgttcctcatgtgttaccatataaggccgtgacagcccatggctactgtggctctgtcatggtcgcagatgcgactcggaccgatg

SEQ ID NO: 6494 - DNA, 203 bp, Homo sapiens
ggcgcgccagtcctctggagtctggaaaggcatttgtggcatacactccttaggagatggtgccataggtgcagcaacagttttgtcaagacagcatttgctcaaccttcttgagggattcctggaattccagggaaaaatttatgatgtgcagaaaacagactttgtgtacacacccactagaacctcgactcggaccgatg

SEQ ID NO: 6495 - DNA, 203 bp, Homo sapiens
ggcgcgccagtcctggctctttgccttctttcacaagaatcccggttggaatacaggatcagctgttggagttaatccagacttggcctggacacagatcttttatactgcccctagccggaatgtattggctatggattactctggatttgatgcttcacatacttctggcatgttttgcattttgacgactcggaccgatg

SEQ ID NO: 6496 - DNA, 203 bp, Homo sapiens
ggcgcgccagtcctagcattttctgaccactcttggttatggaactttacagctttcctatattgattctctctgttattctaaacaccactgggatgatgaaacctaccgccttgacggaggattgccttctggatgctctggcacaacaatttttaacaccattatgaacaacattgttgcccgagcgactcggaccgatg

SEQ ID NO: 6497 - DNA, 203 bp, Homo sapiens
ggcgcgccagtcctcacagtgcacgttccttaaacggggatttgtgctggatggtagtctcgtgcgaccagtcatggaagaacaacatttggctgaattgctaaaatgggctaggccaggaacattgcaggccaagttgctgtccattgcccagttggcatttcatcttccgcgctcggcgtataatccgactcggaccgatg

SEQ ID NO: 6498 - DNA, 203 bp, Homo sapiens
ggcgcgccagtcctgcgctcggcgtataatcgccttatgctcccatttgaagaggctggatatgaaatccccagccatgaacgcctgaatgaggagtggcgcgagatgttcatttgaatggctacagttgtgagcagtttagtgattttctgcctgttgcttaagtagtttagttgagcccaaaaaaacgactcggaccgatg

SEQ ID NO: 6499 - DNA, 203 bp, Homo sapiens
ggcgcgccagtcctgagcttccaggttgggaaacctggactgggtctatactgcctgatagggtcgcggctggccgcctgtaactagtatagtcagttgaaaaccccccatggaatctactactactctttcattttgcaactggatccccaagaaacagagagcccgtgtgtaccttaccaccagtgcgactcggaccgatg

SEQ ID NO: 6500 - DNA, 203 bp, Homo sapiens
ggcgcgccagtccttcacacacgagaagtcgattggaccgtacacatacatggtctcagacatgattatgaaagaaaacagtagaacctcccttgccatggcatacgtggaagggaagacacttgtgttcaacaacggaacacaactaggacaagtacattcatccaatactgggaacaaaccacaagcgactcggaccgatg

SEQ ID NO: 6501 - DNA, 203 bp, Homo sapiens
ggcgcgccagtcctaagagggctatagtgacagattaatgcaattaacagcaggtaattcttgcataacaacacaagaggcagccaaggcggtggtggcatatggacaatggcccagttacaatatagatgcaggagaacatttagaccttgcaactactcctggtacatctgtagataggttttacacgactcggaccgatg

SEQ ID NO: 6502 - DNA, 203 bp, Homo sapiens
ggcgcgccagtccttgttttgtggtagccagatggccacaggtaaattacttattgcatataccccacctggtggttcctcccctacaacgagaactgatgcaatgctagctacacatgttatttgggatataggtttacaatcaacatgcaagcttgtggtcccctatatatcatcttcacagtacacgactcggaccgatg

SEQ ID NO: 6503 - DNA, 203 bp, Homo sapiens
ggcgcgccagtcctggcaaaacaacctgacaagaaccactttgtcatacaatggatgggtaactgtattccagcaaacagcactggttgtacccccaggtgccccaacaacatgtcagttagtggtgacagtgagcgctgcggacaactttgtactaaggatccccactgatacagcatattttgcagcgactcggaccgatg

SEQ ID NO: 6504 - DNA, 203 bp, Homo sapiens
ggcgcgccagtcctccaattcgactagcatttatactagagtagggaactgcccagcctcatttagaataccatttatgtctgtttgtaactattatacctccttttatgatggtgatggcaattttgaccagaacggtgctgcctatggtattaatcctggtgattttataggaaccatatctattacgactcggaccgatg

SEQ ID NO: 6505 - DNA, 203 bp, Homo sapiens
ggcgcgccagtcctatgaggtgtgccaaactaagaacgccactgaattaacagagaccaaatgggctaactattcatgctcagttaggtttgatagaggttcatttacagcatggtttgtgggagaagacctgttactggtaccctaccatgcagcaaataattggagtcagacaacacatgtatacccgactcggaccgatg

SEQ ID NO: 6506 - DNA, 203 bp, Homo sapiens
ggcgcgccagtcctctcttttgaaagctttagacctttatggatatgatttaccctttactacttacttaaaggatgagctgagaccaaaggagaaggtgaagatgggcaaaaccagggttattgagtgttcatcactcaatgataccataatgatgaagcaaacttttggtcgtctgtttcaggtgtcgactcggaccgatg

SEQ ID NO: 6507 - DNA, 203 bp, Homo sapiens
ggcgcgccagtcctggatatatggtacgctgtgcaaacggcggaaattaatcctaccgttaaccgcccacctactccgagaagcctagtacctaattggatttatcaatggagttgcgctcagcaggtgaccctgacctgccagctccggctgatggacctgggctttccccacaggcgactgtggcccgactcggaccgatg

SEQ ID NO: 6508 - DNA, 203 bp, Homo sapiens
ggcgcgccagtcctatgggaccgactactttggagagtccgtgtttctattgtttctttaatcaatcttatggtgacaatttatagtgccctgagtattgattggttgttgcttttgacaattattgagacatcacatagacataatgggagctcaagtaagcaggcaaacgtctggtgcgcatgacacgactcggaccgatg

SEQ ID NO: 6509 - DNA, 203 bp, Homo sapiens
ggcgcgccagtcctcccggatacgggctgaacagggcgcaaacattcattatactaatatcaattattatagagatgcagctagcaatgcagcaagcaaaatggactattcccaggatccggacaagttcacgaaaccagtacttgatgctataactgaaccattacccacgctgaagtcccctagtgcgactcggaccgatg

SEQ ID NO: 6510 - DNA, 203 bp, Homo sapiens
ggcgcgccagtcctgcactctactggtcttagcaataccagaatgggagattggggtgtctaatgctgatagggcatcctttaatctaacaaaccccgataagaacgggcatactatgactggtcaagaagcttattgcttacataatgggactaacatccattcttcactggtatttccacatcaatcgactcggaccgatg

SEQ ID NO: 6511 - DNA, 203 bp, Homo sapiens
ggcgcgccagtcctcaatggcgtgcgagtttaacggactgcgcaatgccatcacccaagggctgccagtactcaatacacccggctctgggcagtttgtgactacagataatttccaatcaccaaacttgattccaaattttgatgtgacacaagtctttaatagtccaggtgaaattattaatttaccgactcggaccgatg

SEQ ID NO: 6512 - DNA, 203 bp, Homo sapiens
ggcgcgccagtcctaggatgatttctcgatgcgcttgttgcgggatacagcagagatttcgcaagacggatttctgcaaggaccaatagatcaagcaatagaaaaagtaatcactgatgtagtgtctgacacgcgtgagtctagtagtgactttagcattggggctgttccagcattgaatgcggtggcgactcggaccgatg

SEQ ID NO: 6513 - DNA, 203 bp, Homo sapiens
ggcgcgccagtcctaccaggacacacacctaaacaagatgactactgatagggcgaacataaagactgttaccaattatatcatgtctggcagcacgcggacagttgaatcagaagtagctgtggtcgaggattcacttaagcaatatggtccagcaactgggggtgtagtggttgggcagtataagacgactcggaccgatg

SEQ ID NO: 6514 - DNA, 203 bp, Homo sapiens
ggcgcgccagtcctcaatctctgatcttctctgtagcgttgactcaggggaggtccgagattattgcagacgaaggggctggatagttccagacactcctactgagatcacggtttcccgtgattatggcaaactcagcatcattttacaagcggtaaccacatttgttacaatagcaggggtcatttcgactcggaccgatg

SEQ ID NO: 6515 - DNA, 203 bp, Homo sapiens
ggcgcgccagtcctcaaggatagggcagtgtggcggagtgattgctaccactggtagggttcttggcatacatgtagggggtaatggagcacagggttttgcagctagcttatttagaaaatactttgccatcacacaaggaagtattgagttcaagagaaggttgagctggcagggcttaagagtgtcgactcggaccgatg

SEQ ID NO: 6516 - DNA, 203 bp, Homo sapiens
ggcgcgccagtccttagtcaaggtgtataaacgaatctctttgtctgatttgaggatgatagcatatggtgatgatgtaatagcctcactcccttataagattgatgctggaaaattggcgattgctggacgagactatggtctaacaatgactccggctgacaaaggagagacattcactgatgtgacgactcggaccgatg

SEQ ID NO: 6517 - DNA, 203 bp, Homo sapiens
ggcgcgccagtcctcttgggagaatgtcaccttcttaaagagatactttaggtcagatgagagatttcctttcctaattcatccagttatgcctatgagtgaaattttcgagtccattagatggacacgaaatgcaaaacacacccaagaacatgtcacctccctgtgctatttggcttggcacaatgcgactcggaccgatg

SEQ ID NO: 6518 - DNA, 203 bp, Homo sapiens
ggcgcgccagtccttagaaacgaggcgtcacgtgccgaaaatccctttgcgtttcacagaaccatcctaaccatgggtgtagtatgggaatcgtgtatggggatgattaggatctctcgtagagggataggtgtgccattcaaatccagggagtactctggctctgacattgggacatttgatgtaaccgactcggaccgatg

SEQ ID NO: 6519 - DNA, 203 bp, Homo sapiens
ggcgcgccagtcctcggacctggttcagtatccgggttgtcctgtattgttacggtgtatccgtcttggcacactgaaagggtatttttgggtaatcctttcctactgcctgatagggtggcgtgcccggccacgagagattaagggtagcaatttaaacatgagcaaactattttctactgtaggcacgactcggaccgatg

SEQ ID NO: 6520 - DNA, 203 bp, Homo sapiens
ggcgcgccagtccttccctggttctagagtgacacaaggtgagaggtttttccttattgatcagcgtgagtggaactcaacacagagtgaatggcagttattgggcaagattgacatagtaaaagagttgcttgatcagtcatatgctgttgatggccttttgaaataccattcttatgcgaggtttgcgactcggaccgatg

SEQ ID NO: 6521 - DNA, 203 bp, Homo sapiens
ggcgcgccagtcctgcttggacgtcattgttcagattaatccaacatcattccaggcagggggtctcatagcagcccttgtaccttatgaccaggttgatattgaatcaattgctgccatgactacttattgccatggcaagttgaattgcaacataaacaacgttgtaagaatgaaggtgccatacacgactcggaccgatg

SEQ ID NO: 6522 - DNA, 203 bp, Homo sapiens
ggcgcgccagtcctagatgatgcgcaacgaatttcgactgtcgtcatctagcaacattgtcaatttggctaattatgaggatgcaagagccaaagtgtctctagcgctgggacaagaagagttttccagagactcgtcaagtaccgggggggaattgttgcatcatttttcacagtggacgtcgattccgactcggaccgatg

SEQ ID NO: 6523 - DNA, 203 bp, Homo sapiens
ggcgcgccagtcctcgtgccttgccttcacttttacattccccggcacggtagggccaggcactcagatctggtcaaccacggtggaccctttttcctgtaacttgagggcgtctagcactgtgcaccccactaacttgagctcgattgcgggtatgttctgtttttggagaggtgacattgtatttgcgactcggaccgatg

SEQ ID NO: 6524 - DNA, 203 bp, Homo sapiens
ggcgcgccagtccttctctgacacaccttacagggtgaatccaacgactcataagtccctctggccttatgcaactggcaagcttgtgtgctatgtgtacaatagactgaacgcacctgccagtgtatcaccaagcgtgtccattaatgtgtacaaaagtgctgtggatctggagttgtatgcacctgcgactcggaccgatg

SEQ ID NO: 6525 - DNA, 203 bp, Homo sapiens
ggcgcgccagtcctgttttgtgacgggtacacttaggtggtttttaagtcttttccaactgtatcgtggttctctcgacattaccatgacatttgcaggaaaaactaatgtggatggcattgtgtactttgtgcctgagggtgttgcgatagagactgagagggaggagcagacccctttgctcacatcgactcggaccgatg

SEQ ID NO: 6526 - DNA, 203 bp, Homo sapiens
ggcgcgccagtcctagagcaaaaatctggacaaatggtgctttgccttgtctccacgcatagataggacactcatatgtgagacagccaacctgatggtgggacgcgaggttgagtatgatatctttgtgaagaattgtgagacatatgctcggggtattgcatcaggcgactatgggacaaaagaagcgactcggaccgatg

SEQ ID NO: 6527 - DNA, 203 bp, Homo sapiens
ggcgcgccagtcctggttaaatatggccaatttggagaagaaagggacacagttcaactcaccattcattatagcatcttctaatctttcccatccttgtccgaagacagtgtactgtacagatgccatcgctaggaggttgcatattaaggtcaaggttagcccgaaagaagaattctctactcatgcgactcggaccgatg

SEQ ID NO: 6528 - DNA, 203 bp, Homo sapiens
ggcgcgccagtccttgataaatgtccctcgtttgcctaaatttagggacatacgcaatcacttttctactgaggagaacatacgcagggcagaaggcatgccagggactttgtgcactttggaccatgagaggttcacccttgttactgagagcgaccttaagatggtggaggcagctacatatgtctcgactcggaccgatg

SEQ ID NO: 6529 - DNA, 203 bp, Homo sapiens
ggcgcgccagtcctccaaagacgaattgcgtcctctaagtaaggttatgctgggcaagaccagagccatagaggcttgccccgtttcgttcaccatcctatttcgcaggtatttgggatacgctttggcgcagattcagagccaccctggttttcacacagggatagcagtgggcgtggaccctgacccgactcggaccgatg

SEQ ID NO: 6530 - DNA, 203 bp, Homo sapiens
ggcgcgccagtcctttgttaattccgttcatcagttgggctccatgagatactatgtccatggttctatgccatctggcacacctgctacatcggtgctcaattctataattaatgttgtgaacatctgccatgtgttgtgtgcattggagaaaataagtgtatttgaggttttcaaattattcaagacgactcggaccgatg

SEQ ID NO: 6531 - DNA, 203 bp, Homo sapiens
ggcgcgccagtcctgaacattctatgtggatgagtggtccatctgtcatccgcgtatttctgaggagactgtttattcgatgctggcttggaagagcgacaatgcatccatgaaggatctgatagaaacgagtatatggtttatgttccatcatggcccccggaagtatgttagattctgtacttggccgactcggaccgatg

SEQ ID NO: 6532 - DNA, 203 bp, Homo sapiens
ggcgcgccagtccttgcgcggtgttctgtgccgtgtgggtattgggctctacattccaacttacaaagagctggaggtgaggtatgataggcttgtcaagtataggttcatagatgatagcttttagattttacatatttgagtttccatttctgtgtagttttagtgagtataggagcttatgtatgcgactcggaccgatg

SEQ ID NO: 6533 - DNA, 203 bp, Homo sapiens
ggcgcgccagtcctcacttgcgcaactcgcgtgactggttagtactcttaccactttccgcctgcctggtcgttcagcgctgctgacaggcactcccattgagggccgttcggcgctccactgaggcgtctacgtttagtgtggctacggtgttgaggccgtttcgcgcggccgactcgcctacgcgccgactcggaccgatg

SEQ ID NO: 6534 - DNA, 203 bp, Homo sapiens
ggcgcgccagtcctactttaaggtaacaccgagactggtacttggtttctggagacaggctaaggatgcccttcaggtaccccgaggtaacaagcgacactcgggatctgagaaggggattggggcttctatccaagcgcccaatttaaaaagcttctatgcctgaataggtgaccggaggccggcaccgactcggaccgatg

SEQ ID NO: 6535 - DNA, 203 bp, Homo sapiens
ggcgcgccagtcctggctgaataccattttacagttgtttcgttacgtcgatgaacctttcttcgactgggtctacaactcgcccgagaacctcacgctgcgagcgattgaacagctcgaggaactcactgggcttgagttgcgcgagggaggaccacccgccctcgtgatttggaacatcaagcactcgactcggaccgatg

SEQ ID NO: 6536 - DNA, 203 bp, Homo sapiens
ggcgcgccagtccttgctctacactggcatcggcacggcctcgcggcccagcgaggtatgcatggttgacggtactgacatgtgtcttgctgatttccacgcaggtatcttcttgaaaggtactgagcatgccgtgttcgccctgttgacttccgacggatggtacgccatagacgatgaggacttttcgactcggaccgatg

SEQ ID NO: 6537 - DNA, 203 bp, Homo sapiens
ggcgcgccagtccttgctcgctgacaagaagacagaggagactgctcttttggaggaccgcatcctcaccacgaggcacggtaccactacttccaccacacagagttctgttgggatcacctacgggtatgccgacagtgactctttcaggcctggccccaatacctcgggcctcgagactcgtgtggcgactcggaccgatg

SEQ ID NO: 6538 - DNA, 203 bp, Homo sapiens
ggcgcgccagtcctatggtggtttccaaaacactgaccccaagtccgcagatccaatctacggacatgtgtacaacccctcaaggaacgactgccacggtaggttttctaacctgctggacgtcgcagaggcgtgtcccacactcctcgacttcgatgggaagccatacgtggtgaccaaaaacagcgcgactcggaccgatg

SEQ ID NO: 6539 - DNA, 203 bp, Homo sapiens
ggcgcgccagtcctcgggcattgaggtcaggggactacccaaaacacctgaggatgcagcacactgttaccattctgaatgggacacaggtctgaactcgagctacacgttcgcggtaccatacctgtcgtccggtgacttctcctacacgcacaccgacaccccagccatggccacaaccaacggctcgactcggaccgatg

SEQ ID NO: 6540 - DNA, 203 bp, Homo sapiens
ggcgcgccagtcctaggtcacgacaccccgccgggtccataccgatgtggcgtttctccttgaccgcagcacacatgtgcacacgaacaagaccacctttgcggtggacctgatggacaccaaggagaaggcgctagtgggagcaatcctgcgctcagccacatactacttttgtgacctggaaatcacgactcggaccgatg

SEQ ID NO: 6541 - DNA, 203 bp, Homo sapiens
ggcgcgccagtcctcatgtgtgggcgaacacaagcgcgtgttttggcagcctaacggtgcgccacgcacaacccagttgggcgacaacccaatggtgttctcccacaacaaagtgacccgctttgcaatcccgttcacagcgcctcacaggttgttgtccacggtctacaacggggagtgcgagtacacgactcggaccgatg

SEQ ID NO: 6542 - DNA, 203 bp, Homo sapiens
ggcgcgccagtcctcaaaaacagtcaccgcaattcgcggtgatagagaggtgttggcgcggaaatactcttccgccaagcactctctgccatccaccttcaacttcgggtttgtgaccgccgacgagccagtcgacgtttactaccggatgaagcgtgcagagctgtactgcccccgtgccctgcttccgactcggaccgatg

SEQ ID NO: 6543 - DNA, 203 bp, Homo sapiens
ggcgcgccagtccttgcagaacgacatgtccactaaacacggtcccgacttcaaccggttggtgaccgcatttgaggagctgacacaaggagttaaggctatcaaggatggtctcgacgaggccaagccctggtacaaaatcatcaaactcctgagccgcctgtcgtgcatggccgctgtagcagcaccgactcggaccgatg

SEQ ID NO: 6544 - DNA, 203 bp, Homo sapiens
ggcgcgccagtccttcaccatgacggaccttgtgcctggtatcttggagaaacagcgtgatctcaatgatccgtccaagtatcatgaagcaaaggagtggctcgagaatgcccgccaggcatgcctcaagaacggcaatgtccacatcgccaacctttgcaaagtcacagcaccagcaccaagcaagtcgactcggaccgatg

SEQ ID NO: 6545 - DNA, 203 bp, Homo sapiens
ggcgcgccagtcctcaagaccagaaccagtggtcgtttgcctccgtggtaaatctggccaaggtaaaagtttccttgcgaacgtgcttgcacaggcaatctccacccacttcacgggcagaaccgactctgtgtggtactgtccaccagaccctgaccacttcgacggctataaccaacaagctgtcgcgactcggaccgatg

SEQ ID NO: 6546 - DNA, 203 bp, Homo sapiens
ggcgcgccagtccttggtgatggatgatctgggacagaatcccgatggcaaggacttcaagtacttcgcccaaatggtatcaaccacgggattcatcccgcccatggcgtccctcgaggacaaggggaaacctttcaacagcaaggtcatcattgcaacctccaatctgtattctgggttcaccccaccgactcggaccgatg

SEQ ID NO: 6547 - DNA, 203 bp, Homo sapiens
ggcgcgccagtcctccgttgaaatgaagagactgcaacaagatatgttcaagcctcaaccaccaattctcaacgtctaccaacttgtggatgaggtgattgagagagtcaacctccacgagaaggttgcctcgcagccaatcttcaaacagatctcgcttccttcccaaaagtctgtgctctacttcccgactcggaccgatg

SEQ ID NO: 6548 - DNA, 203 bp, Homo sapiens
ggcgcgccagtcctcactgaaggttaaagccaaagcccccgtcgtgaaggaaggaccatacgaggggccagtgaagaagcctgtcgctttgaaagtgaaagcaaagaacatgatagtcacggagagtggagcgccacctaccgacttgcaaaagatggtaatggccaacacaaagcctgttgagctcacgactcggaccgatg

SEQ ID NO: 6549 - DNA, 203 bp, Homo sapiens
ggcgcgccagtcctagtcgatgctgctgcaaatgaaggcacacgttgaccctgaaccacaccacgaggggttaattgtggacaccagagatgttgaagagcgtgtacacgtcatgcgcaaaaccaaacttgcacccaccgttgcacacggtgtgttcaaccccgagtacgggcctgctgcactgtccacgactcggaccgatg

SEQ ID NO: 6550 - DNA, 203 bp, Homo sapiens
ggcgcgccagtccttcggttgcaacccagatgttgattggcagagattcggaacccattttgcccagtacaaaaacgtgtgggacgtggactattcggcctttgatgctaaccactgcagtgacgccatgaacatcatgttcgaggaggtattccgtccggaatttggcttccaccccaatgcggagtcgactcggaccgatg

SEQ ID NO: 6551 - DNA, 203 bp, Homo sapiens
ggcgcgccagtcctactcgatgatctcctacggagatgacatcgttgtggctagtgattacgatctggactttgaagcactcaagcctcacttcaaatctgtcggtcagaccatcaccccagctgacaaaagtgacaaaggttttgttcttggtcagtccatcactgacgtcactttcctcaagaggccgactcggaccgatg

SEQ ID NO: 6552 - DNA, 203 bp, Homo sapiens
ggcgcgccagtcctagggtctctttgagattccaagctacagatcactttacctgcgttgggtgaacgccgtgtgcggtgacgcataatccctcagatgtcacaattggcagaaagactctgaggcgagcgacgccgtaggagtgaaaaggccgaaaggtcttttcccgcttccctgatttttgcgaacgactcggaccgatg

SEQ ID NO: 6553 - DNA, 203 bp, Homo sapiens
ggcgcgccagtcctgtttaccggactgtctttaagaacttggcaatcaggagccctaaaggagctgtggctataatgaaatggggtgtcggttaccttaagaagagaaagcaaaagaggcaaaaatctagtggtggctatgaaattgaggctgcaagacaggctctctatccaattactttaggagttcgactcggaccgatg

SEQ ID NO: 6554 - DNA, 203 bp, Homo sapiens
ggcgcgccagtcctatggtcattttttgtggctatcagagtggaaatgaacctgtgtgtgtcgatttcaacaatcagactaacatcgttccttatgagaatgggaaagttatctttgggaacgtcaccattgtccctccaattgatagatttggtcttttgattccaacagacaattatgacactatacgactcggaccgatg

SEQ ID NO: 6555 - DNA, 203 bp, Homo sapiens
ggcgcgccagtcctgagtgcgttaggatgagtcctggcattgaattgagtgaagaagtttgtggattcatggggccaaagtatgatgtccttttgagaacacaatggggaaaaagagagacagaacacatgcacagaactagaagaagtgttacagagacaacccatgagagctctggtggagaacatcgactcggaccgatg

SEQ ID NO: 6556 - DNA, 203 bp, Homo sapiens
ggcgcgccagtcctgagaaatttgacatcatagaagctggtggctacacgaaaatgacaacattccttaaacatgacaaatgtttcatggttagggttccagaacatgatgtggttgaaataacagttgttaagaaaacaattaggccaactactgggtgtaaaacattcttactaggggctagtgtccgactcggaccgatg

SEQ ID NO: 6557 - DNA, 203 bp, Homo sapiens
ggcgcgccagtcctaagattaccatgccattgattccatcattaccttaccaagtaactttaattggtcttgatccaaaatatggtattaccatttatagggttgattcccaggaagagtacacaaatttggccaaagttttaagtgaaaaatatgatctggttaggaaaataacaggttggtatggacgactcggaccgatg

SEQ ID NO: 6558 - DNA, 203 bp, Homo sapiens
ggcgcgccagtcctagagcactaattggagacaaaatgttgttctgcgaggcaaactgggttgattgtaacactcatgattatgaattaagcttttggacatcagcattgatcacaacaaaaagccgaagttatgaacataaaccttgcaaaattcaacctaaagatgagatctttgaagatgccgatcgactcggaccgatg

SEQ ID NO: 6559 - DNA, 203 bp, Homo sapiens
ggcgcgccagtcctctaataattccaactgttttccagttaatggtgaatggaataataacgtcaattgtctcaataacagtgttcttttgcgggagcatgaagaatacgttggtaactgcaacagacatagtagaagggatcaatcttggacactggaaaaggactgccatggtgacactaatggtgcgactcggaccgatg

SEQ ID NO: 6560 - DNA, 203 bp, Homo sapiens
ggcgcgccagtcctctctgctggaaatatcaaattggaattggctatgttcacaatggcactctcaccacccaataccacgtcacttgtggccgagatctttggtggaagggtaaaagttactctccagttgaagagaatgttgtctctgactatgcttgttactttggtccgtggtctttcccgaaacgactcggaccgatg

SEQ ID NO: 6561 - DNA, 203 bp, Homo sapiens
ggcgcgccagtcctgctggcaactccatcgtatttggaggtgaaagtgtccaggtgggtgagaacccttcctttgctcctcacttggacggtaaaattaaacagttgctcaacacaaggggatgctgggaagaatttgttctaaagtgtggagctggaaaaacaagaggtgtaatcaaggatacaatccgactcggaccgatg

SEQ ID NO: 6562 - DNA, 203 bp, Homo sapiens
ggcgcgccagtcctagagtctttagtggcattaggatgcaatcatcaggagagggttgtgaattgttctcaattttatttggggttcaatgttatggatggatgacttactttgacatgccagcgtcttggatagctttggctcaccaagctttgccgccacaatggagggagactatcaccccaatgcgactcggaccgatg

SEQ ID NO: 6563 - DNA, 203 bp, Homo sapiens
ggcgcgccagtcctcccatctggcaaattctttttgtggtcttcattacagtcatagttgtggaaacagtttgtggtataacacagagggagaagtcaactggtgaagtcactcaactagtaaccataggtgcagtgatcttcattatctattacatactggctgatggtgaaatactgaccttaatccgactcggaccgatg

SEQ ID NO: 6564 - DNA, 203 bp, Homo sapiens
ggcgcgccagtcctcctgatttgaacggtaaaaaggtctacaaaaaatttaattgggaaattggagacttatttaaaaagagaattagatgtgacacatttgtcatggacattggagaatctcatcccaatcaagagattgaagccataggagatctaaaaaggttgaattggtttaaagaaaatgtgcgactcggaccgatg

SEQ ID NO: 6565 - DNA, 203 bp, Homo sapiens
ggcgcgccagtcctgattgtaagaattggtgcattaaaataatggtaccaactcatgaacaggtgctacatgctctcccaaaaggttccacattaattcgaaacccttggagcagaaattctaccttggaaatgtattgtgttccagggtcgaatgaaccagggagaatggttagtaatgtgattaaacgactcggaccgatg

SEQ ID NO: 6566 - DNA, 203 bp, Homo sapiens
ggcgcgccagtcctccaccccaacctttgggtaactacaaaagtgaatttcaagagaagttcaaatgggttcaacaatggtacaaatcaaaaaacaagcatggtaggatactaactaatgaggaagttatttcaaaatttaagagtgatggtgctctcggctttaggtgccaacattatggatccatacgactcggaccgatg

SEQ ID NO: 6567 - DNA, 203 bp, Homo sapiens
ggcgcgccagtcctgttcgccactccttggacatggagcgtggttccacaattcacaccaatgagagatcaaattggaaaaagtttctccttgagaaaatggttccagatctaagtaggagaaataatacagctccaaacatgaattggttggttaggaatggaaacaggggtaatcttttagtttaacgactcggaccgatg

SEQ ID NO: 6568 - DNA, 203 bp, Homo sapiens
ggcgcgccagtcctgcttcacgcacctcgcgtgaccggccagtactcttaccactttccgcctacttggtcgtcagcgctgttttgggcactcctgttgggggctgttcgacgctccacggtctcctccgtactgacatctacggtgttggggccgccacgtgcgagccgctcgcctggtgtgcttcgcgactcggaccgatg

SEQ ID NO: 6569 - DNA, 203 bp, Homo sapiens
ggcgcgccagtcctactgtcacccgacgcccgcctttcacccccccccccctaggttctaccgtcgttcccgacgtttgaagggaggaaaccacacgcttgcaacaccactcccggtgtcaacgggatgcaaccgcaagatggaccttcgcccggaagtaaaacggcagctttacacagttttgcccgcgactcggaccgatg

SEQ ID NO: 6570 - DNA, 203 bp, Homo sapiens
ggcgcgccagtcctcggtccactggcgggtgttagtagcagcactgttgtttcgtagcggagcatggtggccgtgggaactcctccttggtgacaagggcccacggggccgaaagccacgtccagacggacccaccatgtgtgcaaccccagcacggcaacttttactgcgaacaccaccttaaggtgcgactcggaccgatg

SEQ ID NO: 6571 - DNA, 203 bp, Homo sapiens
ggcgcgccagtcctacactggtactggtactcggtcactggtgacaggctaaggatgcccttcaggtaccccgaggtaacacgggacactcgggatctgagaaggggattgggacttctttaaaagtgcccagtttaaaaagcttctacgcctgaataggcgaccggaggccggcgcctttccattaccgactcggaccgatg

SEQ ID NO: 6572 - DNA, 203 bp, Homo sapiens
ggcgcgccagtcctccactactaaatccatgaatacgactgactgttttatcgctctgctatacgctctcagagagatcaaagcactgtttctgtcacgaacacaagggaagatggaattcacactttacaacggtgaaaagaaggtcttctactccagacccaacaaccacgacaactgttggctgacgactcggaccgatg

SEQ ID NO: 6573 - DNA, 203 bp, Homo sapiens
ggcgcgccagtcctacgccatcctccaactgttcaggtacgttgacgagcccttcctcgaatgggtctacgactcacctgagaacctcactctcgaggcgatcaacaaactggaagaaatcacaggtcttgagctacacgaggggggaccgcccgcccttgtcgtctggaacatcaagcacttgctctcgactcggaccgatg

SEQ ID NO: 6574 - DNA, 203 bp, Homo sapiens
ggcgcgccagtcctggacaccaaatccggccgacgttttggtttttgttccgtacgatcaagaaccattcaacgcagaatggaaagcaaaggttcagaagcggctcaggggcgccgggcaatccagcccgacgaccgggtcacaaaaccaatctggcaacactggcagcattattaacaattactacacgactcggaccgatg

SEQ ID NO: 6575 - DNA, 203 bp, Homo sapiens
ggcgcgccagtcctccgaacggttcttcaaaacccacctgtttgactgggtcaccagtgacccgtttgggcggtgtcacttgttggagctaccgactgaccacaaaggcgtctacggtagcctgaccgactcgtacgcatacatgaggaatggttgggacgttgaagtcaccgcagtgggtaaccaatcgactcggaccgatg

SEQ ID NO: 6576 - DNA, 203 bp, Homo sapiens
ggcgcgccagtcctagataacacacgggaaagccgacggtgacgccctggtcgtgctagctagtgctggcaaagactttgacttgcgtctgccggtcgacgcccgaacccaaaccacctctgcgggtgagtctgcggaccccgtgactgccaccgtcgagaactacggtggtgagacacaagtccagacgactcggaccgatg

SEQ ID NO: 6577 - DNA, 203 bp, Homo sapiens
ggcgcgccagtcctggcgccagcacacggacattgcgttcatactggacaggttcgtgaaagtcaagccaaaggaacaagttaatgtgttggacctgatgcagatccctgcccacaccttggtaggggcgctcctgcgaacggccacctactacttctctgacctggagctggccgtcaagcacgaggcgactcggaccgatg

SEQ ID NO: 6578 - DNA, 203 bp, Homo sapiens
ggcgcgccagtcctgcgatctcacctgggtcccaaacggcgcccctgagacagcactggacaacactaccaacccaacagcttaccacaaggaacccctcacacggctggcgctgccttacacggctccacaccgtgtcttagcgaccgtctacaacgggagcagtaagtacggtgacaccagcactacgactcggaccgatg

SEQ ID NO: 6579 - DNA, 203 bp, Homo sapiens
ggcgcgccagtcctccatcatgctggccgacaccggcctcgagattctggacagcaccttcgtggtaaagaagatctccgactcgctctccagtctcttccacgtgccggctcccgccttcagtttcggagccccgatcctgttggccgggttggtcaaagtcgcctcgagtttcttccagtccacaccgactcggaccgatg

SEQ ID NO: 6580 - DNA, 203 bp, Homo sapiens
ggcgcgccagtcctccgaagacctcgagagagcagaaaagcagctcaaagcacgtgacatcaacgacatatttgccgttcttaagaacggtgagtggctggtcaaactgatcctggccatccgcgactggattaaggcatggatcgcctcagaagagaagtttgtcaccatgacagacctggtgcctgcgactcggaccgatg

SEQ ID NO: 6581 - DNA, 203 bp, Homo sapiens
ggcgcgccagtcctgcatccttgaaagacaacgggatctcaatgaccccggcaaatacaaggaggccaaggaatggctggacaacgcgcgtcaagcgtgtttgaagagcgggaacgtgcacattgccaatctgtgtaaggtggtcgctccggcgcccagcaagtcgagacccgaaccagtggtcgtgtcgactcggaccgatg

SEQ ID NO: 6582 - DNA, 203 bp, Homo sapiens
ggcgcgccagtcctgccttcgcggcaaatccggccaagggaaaagctttctcgcgaacgttctcgcgcaggcaatttccacacacttcactggtaggaccgactcggtctggtactgcccgcccgaccctgaccactttgacggttacaatcagcagaccgtcgtcgtgatggacgacttgggccaaacgactcggaccgatg

SEQ ID NO: 6583 - DNA, 203 bp, Homo sapiens
ggcgcgccagtcctacccagacggcaaagacttcaagtactttgcccaaatggtatccaccacggggttcatcccgcctatggcctcgctcgaggataagggtaaacccttcaacagcaaggtcataatagctacaaccaacctgtactcgggattcaccccaaagaccatggtgtgccccgatgcgccgactcggaccgatg

SEQ ID NO: 6584 - DNA, 203 bp, Homo sapiens
ggcgcgccagtcctttaaccggaggtttcactttgacatcgacgtgagcgccaaagacgggtacaagatcaacaacaaactggacatagtcaaagcacttgaagacacccacgctaacccggtggcgatgttccaatacgactgcgctcttctcaacggaatggccgttgaaatgaagagaatgcagccgactcggaccgatg

SEQ ID NO: 6585 - DNA, 203 bp, Homo sapiens
ggcgcgccagtcctcgcgcaagaggtaccaatcggtggatgacccactggacggcgacgtaactcttggcgacgcggaaaagaaccctctggagacgagtggcgctagcgctgtcggtttccgagagagatcccccaccgagcaagggacgcgcgaagacgcgaacgctgagcccgtcgtgttcggtacgactcggaccgatg

SEQ ID NO: 6586 - DNA, 203 bp, Homo sapiens
ggcgcgccagtcctctgcctacctcgtgcctcgtcatctcttcgcggaaaagtacgacaagatcatgttggacggcagagccttgacagacagtgactacagagtgtttgagtttgagattaaagtaaaaggacaggacatgctctcagacgccgctctcatggtgttgcaccgtgggaatcgcgtgccgactcggaccgatg

SEQ ID NO: 6587 - DNA, 203 bp, Homo sapiens
ggcgcgccagtcctgtgacatcacgaaacactttcgtgacgtagcgagaatgaagaagggaacccccgtcgtcggtgtgatcaacaatgctgacgtcgggagactcatattctctggtgaagcccttacttacaaggacatcgtcgtgtgtatggatggagacaccatgcctgggctctttgcctacacgactcggaccgatg

SEQ ID NO: 6588 - DNA, 203 bp, Homo sapiens
ggcgcgccagtcctaggggttgatcgtcgacaccagagatgtggaggagcgtgtccacgtgatgcgcaaaaccaagctcgcgcccaccgtggcgcacggtgtgttcaaccctgagttcgggcctgccgctctgtccaacaaggacccgcgcctgaacgaaggggttgtccttgacgatgtcattttctcgactcggaccgatg

SEQ ID NO: 6589 - DNA, 203 bp, Homo sapiens
ggcgcgccagtcctcgcccggtctcccctgggctctccaagggaaacgccgcggcgccctgatcgacttcgaaaacggcaccgtcgggcctgaggttgaggcagcactcaagctcatggaaagccgcgagtacaaattcgtctgccaaaccttcctgaaggacgaaattcggccgctagaaaaggtaccgactcggaccgatg

SEQ ID NO: 6590 - DNA, 203 bp, Homo sapiens
ggcgcgccagtcctgcgctggcaagacacgcattgtcgacgtgttgcctgttgaacacattctctacaccagaatgatgattggcagattctgtgctcagatgcattcaaacaagggaccgcaaattggatcagcggtcggttgtaaccctgacgttgattggcaaagatttggcacacatttcgccccgactcggaccgatg

SEQ ID NO: 6591 - DNA, 203 bp, Homo sapiens
ggcgcgccagtcctttgttgttgaaggtggaatgccgtccggttgttccgcaacaagcatcatcaacacaattttgaacaacatctacgtgctttacgccctgcgtaggcactatgagggagtcgagctggacacttacaccatgatctcttatggagacgacatcgtggtggcaagtgactacgacccgactcggaccgatg

SEQ ID NO: 6592 - DNA, 203 bp, Homo sapiens
ggcgcgccagtcctctgattgtttccgcaagcatccggaagccacatactctcggtgcggctccggtccctggattacacccaggtgcatggtcgactacccgtataggctttggcactatccttgtaccatcaattacaccatattcaaagtcaggatgtacgtgggaggggtcgagcacaggctggcgactcggaccgatg

SEQ ID NO: 6593 - DNA, 203 bp, Homo sapiens
ggcgcgccagtcctggattgtcttgtccgggaagccggcaattatacctgacagggaggttctctaccaggagttcgatgagatggaagagtgctctcagcacttaccgtacatcgagcaagggatgatgctcgctgagcagttcaagcagaaggccctcggcctcctgcagaccgcgtcccgccaagcgactcggaccgatg

SEQ ID NO: 6594 - DNA, 203 bp, Homo sapiens
ggcgcgccagtcctttttttttttttttccttttttttttttttttttttctttccttcttttttcctttcttttccttccttctttaatggtggctccatcttagccctagtcacggctagctgtgaaaggtccgtgagccgcatgactgcagagagtgctgatactggcctctctgcagatcatgtcgactcggaccgatg

SEQ ID NO: 6595 - DNA, 203 bp, Homo sapiens
ggcgcgccagtcctaatgcagtattgggtagaaagaaacaaaggtctgccaagacggtgtgggttctcttcagcatgttggctttgatggtggccatggagattgagcaacagggcacgtcattagtcattaagcctcaaaggagtgatgttggacggccagttcgagttagcacaggctactgcatgcgactcggaccgatg

SEQ ID NO: 6596 - DNA, 203 bp, Homo sapiens
ggcgcgccagtcctttctccgctatggacattgggataacgtgtgagaaaaccatacagtatgagtgtgttactttaaccacatctgaagagccgtttgatgttgattgttactgtaggaatgtcacaaatgtgttggttgagtattcaacgtgcaatccaacagtggaacgtgcaaaaaggtctctgcgactcggaccgatg

SEQ ID NO: 6597 - DNA, 203 bp, Homo sapiens
ggcgcgccagtcctgtgatccaagatcacccacactctgaaactgtggctaaaccaacactgtggctgaaatggaatacagttaatgatcgagtgggcatgactgaggaatgggtgatgagaaatacctggaaggcaacaattcttaccctggctattatagctgtcactggactcaactggaaaggacgactcggaccgatg

SEQ ID NO: 6598 - DNA, 203 bp, Homo sapiens
ggcgcgccagtcctcctggagggcatgttgattgccgagttagcctagtgaacctgaagctaaagggaacaacttacccttattgtggtgactcattcgtttggaagcggcgccctacggctacccatcatggtacagttgcaatggaagtcacctaccaaggaactgatgttccgtgcaaggtatctcgactcggaccgatg

SEQ ID NO: 6599 - DNA, 203 bp, Homo sapiens
ggcgcgccagtcctgttatcgtggaaaaagatggacagaacggaggtaatgcaggaagtttgattacatcaaatccaatcatcacagcacaagggtcatcagtgttcttagaactggaggttccactgggtttttccactattaaggttggtgcagcaaaacagcaatggagacaggatggcagttcacgactcggaccgatg

SEQ ID NO: 6600 - DNA, 203 bp, Homo sapiens
ggcgcgccagtcctgaaatcaatgacttcaagcatggttacaagtattatcctgaggacccagaaacattcctggcaagtttggttcaagacggtgaaaaacactgtgggtatcaaccttcaaacctgatagagttgcgaatgtggcagtctctagaaaaggaattgaacctttacttggaagaccagcgactcggaccgatg

SEQ ID NO: 6601 - DNA, 203 bp, Homo sapiens
ggcgcgccagtcctatgattgtgcatggctctccttggatgtggatggagagctatgaagtgaatggaactgtgcaactacaaaagttgactctcacccacacagttgaatgtctctggccaattacacacactcttggaaacagaatggttttggactccaaattgatattgccaaaagaaatgggacgactcggaccgatg

SEQ ID NO: 6602 - DNA, 203 bp, Homo sapiens
ggcgcgccagtcctggtccagcttctatcttgaatatggttgaaggctattcagaacaaaacaagtgtccctggaatcaaggtcctgtgacagtggaaagaggttattgtgaagggactgaagttgagatatccgaagactgtgaagaaaggggaccttgtacgaggtcaaaaacccaaggaggaacacgactcggaccgatg

SEQ ID NO: 6603 - DNA, 203 bp, Homo sapiens
ggcgcgccagtcctctggttctttactacctaggcattctaacaaagattgaaaaagggaattggggaccttccttgattgtcacaatctccatcatgatgtggttacatatcatcgatgtaactgaattgttgcattacttgttggctgttggttacacatttgtctggcaaacatctgagcccatgcgactcggaccgatg

SEQ ID NO: 6604 - DNA, 203 bp, Homo sapiens
ggcgcgccagtcctctgtggattgtggccatgcaagctatttttcagttgagacctgggtttgctgtagggttcgccctgtgcaaaacctggaggtttgaacggattgtcggcatggttgcttgcatgtggacaattcaagagttaacaactccatatgaagccttttggagatttatggatgcactgcgactcggaccgatg

SEQ ID NO: 6605 - DNA, 203 bp, Homo sapiens
ggcgcgccagtcctggcttgcttgtgtatgcttactcagcctcccactcaacacgacagagttatctctatgtcgtcttgatgctatcactcaccaaaattcagaatgcgacaatcagactggctgttggaatgtttggtaccatgctactaatgttagtaggaaggaagtttgctgagagtgattggcgactcggaccgatg

SEQ ID NO: 6606 - DNA, 203 bp, Homo sapiens
ggcgcgccagtcctaatacagatccttggataattggagttatggcattggtccttcttttctttctttttcaggttagttctggagagatggtagcagagtgggctgggtaccacgagtggaaaaaggactgtcctaagtctgttggttctataagtcttgaagtgaagagaatggctgatggcagacgactcggaccgatg

SEQ ID NO: 6607 - DNA, 203 bp, Homo sapiens
ggcgcgccagtcctgtgagttttcattcatcagctgtgtcaagtaaaacacctggaagtctgattgatgtgatgtgtcatgccacatttgttaaccgcaaattaatccatatgcctcaaaagaactatgaacttatcatcatggatgaagcacattggacggacccatccagcatagcggctaggggacgactcggaccgatg

SEQ ID NO: 6608 - DNA, 203 bp, Homo sapiens
ggcgcgccagtcctaggaccgcctggtttgttccctcccagaatgctgcgcaagggattgcgaaaaccttaagggagcatgggaagaaagttgctatcttgacaagtaaaacctttcatgatgtgtatccaaaattgaaaactgaaaagcctgattttattttgacaacagacatttctgaaatgggtcgactcggaccgatg

SEQ ID NO: 6609 - DNA, 203 bp, Homo sapiens
ggcgcgccagtcctgctcccgtgtggctggacaccagactaaccagagaaaggaaagatttggctgggttcatagaatatgctgagaagaggagaagtagtgttttaacagccatcccaggactgctttatagtaggttcttgtcagcctttgacaccatttacatctactccacttctgatccatctcgactcggaccgatg

SEQ ID NO: 6610 - DNA, 203 bp, Homo sapiens
ggcgcgccagtccttggattggaggagctcctttgagtctggttgcagcactggttttgatatcatttattttgcttgtgtgcttaataccagagcagggaatgcagaggacccaaatagacaccacattggctacactggttttggctattgtgacatttggcttacttgtgtttgccaatgagatgcgactcggaccgatg

SEQ ID NO: 6611 - DNA, 203 bp, Homo sapiens
ggcgcgccagtcctagatggcttgaaaacacaaagaaagatttgtttggccagcctcaaactagtcctagtgtgaatactggaggaatcatccaggatctccttcagcttgatattagaccaatgaatgtgtggggaacctatgttgcactggtgacggttgctcggccacaagcgctccataatctacgactcggaccgatg

SEQ ID NO: 6612 - DNA, 203 bp, Homo sapiens
ggcgcgccagtcctaaaatgttcactaagaagatagtgtcgggagtggtcgcaggaaaggagagtgcaatggaaagactcccgaccggtggagcttggatgaatctcaggatgggtgacctcactcttctggcaacaaccttgaagggaatgacctgtttcaatctattgggaggtttaacctttgctcgactcggaccgatg

SEQ ID NO: 6613 - DNA, 203 bp, Homo sapiens
ggcgcgccagtccttggttgaatgagatgcaaaaaattaggaaggacattgacctgtggaaaccttcagcaggtcattgcaactgggaggaagtagagttctgttccaaccactttcacaagcttgttatgagagatgggagaaccttggttgttccttgcagacatgaagttgagcttgtggggcgtcgactcggaccgatg

SEQ ID NO: 6614 - DNA, 203 bp, Homo sapiens
ggcgcgccagtcctgccagcgtcaaccagggtggttcaacagggatttctgggactgcttgtttagctaaggcatatgcacaaatgtggctgcttctttacttccacaggagagatctcagaattttgggaatggcaatttgttcagcagttccagccaactgggttccaacaggacgaacgacctggcgactcggaccgatg

SEQ ID NO: 6615 - DNA, 203 bp, Homo sapiens
ggcgcgccagtcctactaatggaaaaaatgcgagtgagggcaactctgggattagctcaatgggtgtgacgaccctacccttccgcatttgtaaataattgagccagtcatttccgtagggaagagagttattcgctcctctcgagattgagcggcctgctccttggagcatgagatgggaggcccgacgactcggaccgatg

SEQ ID NO: 6616 - DNA, 203 bp, Homo sapiens
ggcgcgccagtcctagcaaagctgaaaggactagcggttagaggagaccccttccatctctggtatcaaatttcatggagtttactccatggtggctagaacccatagcgggggtgaaccacattggctaaggttcaccagcttttgctcccgcgtttttcaaattgcctcatcttgaatggggggcgcgactcggaccgatg

SEQ ID NO: 6617 - DNA, 203 bp, Homo sapiens
ggcgcgccagtcctacacctataatcttattatgtgtaggtgccttaatatttaccaaactagcatcaactatagaagtgggattagagaccacagtcagaagagctaaccgtgtactaagtgatgcactcaaaagataccctaggatggacataccaaaaatcgctagatctttctatgatttatttcgactcggaccgatg

SEQ ID NO: 6618 - DNA, 203 bp, Homo sapiens
ggcgcgccagtcctggcttaggcataataggtatgtatcgcgggagagtgccaaacacagaactattttcagcagcagaaagctatgccaagagtttgaaagaaagcaataaaattaacttttcttcattaggactcacagatgaagaaaaagaggctgcagaacactttctaaatgtgagtgacgaccgactcggaccgatg

SEQ ID NO: 6619 - DNA, 203 bp, Homo sapiens
ggcgcgccagtcctgattatgaccatgaacaatcccaaaggcatattcaagaagcttggagctgggacccaagttatagtagaactaggagcatatgtccaggctgaaagcataagtaaaatatgcaagacttggagccatcaaggaacaagatatgtgctgaagtccagataacagccaagcaacctcgactcggaccgatg

SEQ ID NO: 6620 - DNA, 203 bp, Homo sapiens
ggcgcgccagtcctctcaaaacagtctctgctgaccaattggcaagagaggaacaaattgagaatcccagacaatctaggtttgttctaggagcaatagcactcggtgttgcaacagcagctgcagtcacagcaggtgttgcaattgccaaaaccatccggcttgagagtgaagtcacagcaattaagcgactcggaccgatg

SEQ ID NO: 6621 - DNA, 203 bp, Homo sapiens
ggcgcgccagtcctaacagaaggtttctaaatgttgtgcggcaattttcagacaatgctggaataacaccagcaatatctttggacttaatgacagatgctgaactagccagggccgtttctaacatgccgacatctgcaggacaaataaaattgatgttggagaaccgtgcgatggtgcgaagaaagcgactcggaccgatg

SEQ ID NO: 6622 - DNA, 203 bp, Homo sapiens
ggcgcgccagtcctagtatggttgcactgtctcctcttggggctctggttgcttgctacaaaggagtaagctgttccattggcagcaacagagtagggatcatcaagcagctgaacaagggttgctcctatataaccaaccaagatgcagacacagtgacaatagacaacactgtatatcagctaagccgactcggaccgatg

SEQ ID NO: 6623 - DNA, 203 bp, Homo sapiens
ggcgcgccagtcctaaaataaaatttgggacaaatcataatgtctcgcaaggctccatgcaaatatgaagtgcggggcaaatgcaacagaggaagtgagtgtaagtttaaccacaattactggagttggccagatagatacttattaataagatcaaactatctattaaatcagcttttaaggaacaccgactcggaccgatg

SEQ ID NO: 6624 - DNA, 203 bp, Homo sapiens
ggcgcgccagtcctggaagggctagggttgagaagtaatctgcaaggtatgttaactaataaactatatgaaactgtagattatatgctaagcttatgttgcaatgaaggtttctcacttgtgaaagagttcgaaggttttattatgagtgagatccttaggattactgaacatgctcaattcagtaccgactcggaccgatg

SEQ ID NO: 6625 - DNA, 203 bp, Homo sapiens
ggcgcgccagtcctagaagagcaaagtggtctatatagatatcacatgggcggtattgaaggatggtgtcaaaaactctggacaatggaagctatatctttattggatgttgtatctgtaaagacacggtgtcaaatgacatctttattaaacggtgacaaccaatcaatagatgtaagtaaaccagtcgactcggaccgatg

SEQ ID NO: 6626 - DNA, 203 bp, Homo sapiens
ggcgcgccagtcctcaagttatctgaaggtttagatgaagtgaaggcagattatcgcttagcagtaaaaatgctaaaagaaataagagatgcatacagaaatataggccataaacttaaagaaggggaaacatatatatcaagggatcttcagtttataagcaaggtgattcaatctgaaggagtgatcgactcggaccgatg

SEQ ID NO: 6627 - DNA, 203 bp, Homo sapiens
ggcgcgccagtcctagctgttggatcagaacgacaagcaaaagtaacaagtgacatcaatagaacagcagttaccagtatcttaagtctttccccaaatcaacttttcagtgatagtgctatacactacagcagaaatgaagaagaagtgggaatcattgcagaaaacataacacctgtttatcctcacgactcggaccgatg

SEQ ID NO: 6628 - DNA, 203 bp, Homo sapiens
ggcgcgccagtcctaatgagatgggtgtataaagggacaccaggcttgcgacgattactcaacaagatctgtcttgggagtttaggcattagctacaaatgtgtaaaacctttattacctaggtttatgagtgtaaatttcttacatagattatctgtcagtagtagacctatggaattcccagcatccgactcggaccgatg

SEQ ID NO: 6629 - DNA, 203 bp, Homo sapiens
ggcgcgccagtcctggacttcaaaatattcctatgtgtctttaaaactaaacttttatgtagttggggatctcaagggaaaaacattaaagatgaagatatagtagatgaatcaatagataaattgttaaggattgacaatactttttggagaatgttcagcaaagttatgtttgaaccaaaggttaacgactcggaccgatg

SEQ ID NO: 6630 - DNA, 203 bp, Homo sapiens
ggcgcgccagtccttatgaaagacctaaatcctaaagttttgtactttattggagaaggagcaggaaattggatggccagaacagcatgtgaatatcctgatattaaatttgtatatagaagtctgaaagatgaccttgatcatcattatcctctggaataccagagagtgataggtgaattaagcagcgactcggaccgatg

SEQ ID NO: 6631 - DNA, 203 bp, Homo sapiens
ggcgcgccagtcctttataatcctagagtgccaaggagttgcgtgtcatcattgattgggaagatcaaggaaacaatttgttccaataatatcgtacatcttgactaagtcgaacaaggggaagtcgatatggatcgtgggaccagaagaatctgggtgtcgcaaaatcaaggtgatactgatttagacgactcggaccgatg

SEQ ID NO: 6632 - DNA, 203 bp, Homo sapiens
ggcgcgccagtcctactgcctgaagaggagactacagaagcaaatgcagggcaatttctctcatttgcgagtttgtttcttcccaaactggttgtgggagagaaggcttgcttggaaaaagtccagcgacaaattcaggttcatgcagaacagggtttaattcaatatcccactgcatggcaatcagtcgactcggaccgatg

SEQ ID NO: 6633 - DNA, 203 bp, Homo sapiens
ggcgcgccagtccttggacacatgatggtaatcttcagattgatgaggactaatttcttgattaaatatttactgatccaccagggtatgcatatggtagctggccacgatgccaatgatgctgtcattgctaattcagttgctcaggctcgcttttcaggactcctaattgtcaaaaccgttcttgacgactcggaccgatg

SEQ ID NO: 6634 - DNA, 203 bp, Homo sapiens
ggcgcgccagtccttcatattctgcaaaaaaccgaccaaggagtaagacttcaccctttggcccgaacagccaaagtgcgtaatgaggttaatgcatttaaggccgccctaagctcacttgctaagcatggggaatatgccccttttgctcgccttctcaatctctcgggagttaacaacctagaacacgactcggaccgatg

SEQ ID NO: 6635 - DNA, 203 bp, Homo sapiens
ggcgcgccagtcctaataccgttccctgggcctataagcaacaacccagaccaagatcatctggaggatgatcctagagactccagagacaccatcattcctaatggtgcaattgaccccgaggatggtgattttgaaaattacaatggctatcatgatgatgaagttgggacggcaggtgacttggtcgactcggaccgatg

SEQ ID NO: 6636 - DNA, 203 bp, Homo sapiens
ggcgcgccagtcctacaaggaggtcaatacaactggcaccgaggcccagaacgtacgaccgccaatcgaagactctcaccagtgcacgaagaggacacccttatggatcaaggtgatgatgatccctcaagcttacctccgctggaatctgatgatgacgatgcatcaagtagccaacaagatcccgacgactcggaccgatg

SEQ ID NO: 6637 - DNA, 203 bp, Homo sapiens
ggcgcgccagtcctgaatgcgcttaaaggaaaaatcgatgatccaaacagctatgtaccagatgctgtgcaagaggcttacaagaaccttgacagtacatcgaccctgaccgaggaaaattttgggaaaccttatatatctgctaaagacctgaaggagatcatgtatgatcatctacctggttttggcgactcggaccgatg

SEQ ID NO: 6638 - DNA, 203 bp, Homo sapiens
ggcgcgccagtcctctgcaacctggacagacgaaactccagcaggagcagtcaatgctcttcgtcctgggctctcactccatcccaagcttcgtccaattctcctgccggggaagacaggaaagaaaggacatgcttcagacttaacatcacctgacaagattcaaacaatcatgaatgcaataccggcgactcggaccgatg

SEQ ID NO: 6639 - DNA, 203 bp, Homo sapiens
ggcgcgccagtcctgaattgcaaccgatgtcccatcagcaacaaaacgctggggatttcgttcaggtgtgcctcccaaggtggtcagctatgaagccggagaatgggcagaaaattgctacaatctggagatcaaaaagtcagacggaagtgaatgcctccctctccctcccgacggtgtacgaggatcgactcggaccgatg

SEQ ID NO: 6640 - DNA, 203 bp, Homo sapiens
ggcgcgccagtcctgcatttccaaattccatcaacccacaccaacaactcctcagatcagagcccggcgggaactgtccaaggaaaaattagctaccacccacccgccaacaactccgagctggttccaacggattcccctccagtggtttcagtgctcactgcaggacggacagaggaaatgtcgaccgactcggaccgatg

SEQ ID NO: 6641 - DNA, 203 bp, Homo sapiens
ggcgcgccagtcctccaaggtctaaccaacggagagacaatcacaggtttcaccgcgaacccaatgacaaccaccattgccccaagtccaaccatgacaagcgaggttgataacaatgtaccaagtgaacagccgaacaacacagcatccattgaagactcccccccatcggcaagcaacgagacaatcgactcggaccgatg

SEQ ID NO: 6642 - DNA, 203 bp, Homo sapiens
ggcgcgccagtcctttaccactccgagatggatccgatccaaggctcgaacaactccgcccagagcccacagaccaagaccacgccagcacccacaacatccccgatgacccaggacccgcaagagacggccaacagcagcaaaccaggaaccagcccaggaagcgcagccggaccaagtcagcccggcgactcggaccgatg

SEQ ID NO: 6643 - DNA, 203 bp, Homo sapiens
ggcgcgccagtcctgtcttctatgtgagacccacctacggcatgagggcctcggacaggaccaagctgattctgtattagaggtctaccaaagactccacagtgataaaggagggaattttgaggctgccctgtggcaacaatgggaccgacagtcattaataatgttcatctctgcttttctcaacacgactcggaccgatg

SEQ ID NO: 6644 - DNA, 203 bp, Homo sapiens
ggcgcgccagtcctcagtcaccaggctgttctcagtagtctgtccttggaagctcttggggagacaaaaagaggtcccagagagtcccaacaggttggcataaggtcattaacaccagcatagtcggctcgaccaagactgtaagcgagtcgatttcaactaaaaagattatttcttgttgtttaaaccgactcggaccgatg

SEQ ID NO: 6645 - DNA, 203 bp, Homo sapiens
ggcgcgccagtccttttgatgtaagtcaaaaaggcatggctcttctgacaagactcaaaacaaatgactttgctcctgcctgggcgatgacaagaaatcttttcccacatctgttccagaacccaaattcggttattcaatctcccatctgggctttgagggtaattttggcagccggattgcaggatcgactcggaccgatg

SEQ ID NO: 6646 - DNA, 203 bp, Homo sapiens
ggcgcgccagtcctctattttcgctaattgcattgagcactgctaataggtttgtatcacgttaaagatttagagtgtatgaattgtgcagatttaaacttgggttttgccttatgcttcataggtggtctttttgaaatggagattatcagcatttcttaaatgggaggagttagcaatcagaaattcgactcggaccgatg

SEQ ID NO: 6647 - DNA, 203 bp, Homo sapiens
ggcgcgccagtcctggagataaatggacatcgggatagaacaatgcctaactattgggcggcttccatttttacatgtgtatataaccaatcttttcctatctttgcttatattggtgtaactttattttaataacatgtcaatgctatactgttaagagaaggtctgaggaagattaagaaaaaggccgactcggaccgatg

SEQ ID NO: 6648 - DNA, 203 bp, Homo sapiens
ggcgcgccagtcctcttgcaatcaattccttgatgaaattattaattacactcttcatgatgcagcctttcttgattactatctcaaggcaacaggtgcacaggaccatttgacaaacattgcaactagagagaagcttaaaaacgaaattctaaacaatgattatgtccatcaattgttcttctggccgactcggaccgatg

SEQ ID NO: 6649 - DNA, 203 bp, Homo sapiens
ggcgcgccagtcctatgtgctaggttacaatcctccaaacaaattctccactaaaagggtgccggaacaatttctagaacaagaggatttttcaatcgaaagtgtcctgaattatgcacaggaattacattatttattaccacagaataggaatttttccttttctctcaaagaaaaggaattaaatacgactcggaccgatg

SEQ ID NO: 6650 - DNA, 203 bp, Homo sapiens
ggcgcgccagtcctttaagttacgatcagcggtcatgggagacaatcagtgtataaccgtattgtctgtttttccacttaaaacagaccctgaagagcaggagcaaagcgccgaagacaatgctgcaagagtagcagcaagtcttgcaaaagtaaccagtgcatgtgggatctttcttaaaccagatgcgactcggaccgatg

SEQ ID NO: 6651 - DNA, 203 bp, Homo sapiens
ggcgcgccagtcctcaaaccctgtcatgagtcgctttgcagcggatattttttccaggacaccgagtggtaaacgtctccaaatattaggttatcttgaagggaccaggactctattggcctccaaaatcataaacaacaacagtgagacacctgtacttgataagctgaggaagatcaccctacaaacgactcggaccgatg

SEQ ID NO: 6652 - DNA, 203 bp, Homo sapiens
ggcgcgccagtcctcgcagtatctcaaggtggtggtactcaaagtatttctgagtgatatagaaggaatattatggattaatgattacttggctccattattcggggctggttacttgattaaaccgattacatcaagtgcccggtcaagtgaatggtacctttgcttatcaaatttgatatctactacgactcggaccgatg

SEQ ID NO: 6653 - DNA, 203 bp, Homo sapiens
ggcgcgccagtcctacaggagatcggcccatcagactcacaaggcatgtcttggtgttatcagagatgctttgcaagcacaagtccagcgaggcgtgtactggttgagtcacatcgcacagtatgctacaaagaatctccattgtgaatacataggccttggtttcccatctctagaaaaggtcctatcgactcggaccgatg

SEQ ID NO: 6654 - DNA, 203 bp, Homo sapiens
ggcgcgccagtcctatcacaggtataatctagttgatactggactcggtccattgtcgtcagttattagacatttaactaacctccaggcagagatacgagacttagtattagattataacctgatgagggagagtcgcactcaaacgtaccattttattaagactgcaaaaggcagaatcacaaagtcgactcggaccgatg

SEQ ID NO: 6655 - DNA, 203 bp, Homo sapiens
ggcgcgccagtccttaacatagactgaaaatgctaagaagagattggagtaaaagtataaaataaatttaattaaacttcaaagtgattaaatgataatgatcttgggaactcgatatgacctcaagtcaaaaataatgtcaatataattgtttagtaatatgagtgataatgtaaattttgataactcgactcggaccgatg

SEQ ID NO: 6656 - DNA, 203 bp, Homo sapiens
ggcgcgccagtcctgcaccagtgtaccgatagcagtaagaaacgagctattcaaaagatttgtgtcttaattagtaatgatctaaaggagaatggattattagaagaggctaaaacattcaaaccagagtataaatcaatcgcccaagtatatggtaaattcttcaaacgatacatcgccgaaaaggacgactcggaccgatg

SEQ ID NO: 6657 - DNA, 203 bp, Homo sapiens
ggcgcgccagtccttgattacattgagtgtttgagccatcatttaacatcaactgttgacattgacgttcaccagcaagattgtggtaatttaagcgttgtaatatttgcaaaagataataacattaagaaacagctgcagattcaggtatccgcttgagtggccatggagccgtcggtaattttatgcgactcggaccgatg

SEQ ID NO: 6658 - DNA, 203 bp, Homo sapiens
ggcgcgccagtcctgcgtatctgttgacagaacatcaaattgaacagattaaacagaacagtgttgaccctaacaatacaccaaagattgaagtgaggagtcagttctaactgtttactttgcaggagaggaggtaccgagttctgggactcacgtccatcgccactttacttggttacaacctcacgcgactcggaccgatg

SEQ ID NO: 6659 - DNA, 203 bp, Homo sapiens
ggcgcgccagtcctacggtgtgacaaggtgaagcatgacccatcttcgtgtgctaatggtgtgtgctgctaatcgctggactgccggagggaaaccggcacaaggcgtggccgccactggccgttgatgatcatgtggaactgagctttgctcaggccgactcacattaagtataatttagaactgaccgactcggaccgatg

SEQ ID NO: 6660 - DNA, 203 bp, Homo sapiens
ggcgcgccagtcctaagctttgctgacactaagagctaatgactctggaaattgagcttcgaaaggtaccgggcaaccatgctttccgaggggctcttgggactggaaagtagaggatcccgctgggatgtcaaccaccctctaccaacggtgtcggagtgctcccttaataggacaatttgactgaccgactcggaccgatg

SEQ ID NO: 6661 - DNA, 203 bp, Homo sapiens
ggcgcgccagtccttaacgtcactttcaactactgcttcagcagttaactcgtttgcttattcttactgtaatgttccagtggagagttgggattttaacatgattaaactgactgctgaaactagttgtgcttcacttactgcaatgactaatttggttaatacattagtgcctgatgatagggttacgactcggaccgatg

SEQ ID NO: 6662 - DNA, 203 bp, Homo sapiens
ggcgcgccagtcctgtattccattctagtaatcaacacttgttacacggtgatgcaaatcctgataatatcatgagtgatagtgaaggttacttgaaattggttgacccagtttgcttgcttgaaaatcaagtgaatatggtaaatatagagtacgaatcgttaacccaagaagctgagaagaaagtacgactcggaccgatg

SEQ ID NO: 6663 - DNA, 203 bp, Homo sapiens
ggcgcgccagtcctaatcatcgaccaatgatgcctgagctatcagtgcttaatgatttaacttactatgatactggtgaagtgagagatttggttaccgaagatctagatgatgaagatgacgtttaataacacaatatatatattcattgagactaaggaaactcttaacacagatgtacgacctgccgactcggaccgatg

SEQ ID NO: 6664 - DNA, 203 bp, Homo sapiens
ggcgcgccagtcctatttggatccaaacatatcagaggtcaaactgtggttggaatatttcatagggagtgaagatttcttcgggttcaatggaccaaatgtggttgtgtcaaagtctttgttagctgccaaacgttttgaagttgttgttaatcacttaaggaaggttgcagcttttgaattggatgcgactcggaccgatg

SEQ ID NO: 6665 - DNA, 203 bp, Homo sapiens
ggcgcgccagtcctatgagtctaaagaagtgatgactgaatggcttaaatacataatgatcgatccagtttatagatcatataaaaatagaggtgcttttggtaatctgaatcaacatgtgtttgcaaggactaagagtgagggattgtcatggtctcttattgacattggtacgacaaattttgaatcgactcggaccgatg

SEQ ID NO: 6666 - DNA, 203 bp, Homo sapiens
ggcgcgccagtccttaaagccgactaagaaactagctggctcatacgttaagaaattcaacttagttgatgatgtgctggttgaggaatcgttgaaagatttgcgtaatgagggtctatacaagatggctgatataacacgtaggatgattgatgctgatataacgcctgaaaacgtgaagaagggaacgactcggaccgatg

SEQ ID NO: 6667 - DNA, 203 bp, Homo sapiens
ggcgcgccagtcctctcatgggtcaagaaaaattaatagattggacatattattcaagggtggtacatcatctgccagtagtacaaacgaacatgctactgttaacggtaggttcagatacaggtcggagttatatcgggaacgtgatgtaaattcgtcgacagtattcaagacagcaacagctggaccgactcggaccgatg

SEQ ID NO: 6668 - DNA, 203 bp, Homo sapiens
ggcgcgccagtcctgaacaatttatgcagcttcattgatgacagtgcttccggctgttaggttattaagttcaagggctagtaacatgggagctttgagtactcaaggaagtctcgtagaccgtgcaccacatgatgtgatggctcctcaattggctgtgacttccagtgatgacgtctcaaaggtttcgactcggaccgatg

SEQ ID NO: 6669 - DNA, 203 bp, Homo sapiens
ggcgcgccagtcctgtctaatgcctgagtattgtgagaaacatttgaatgaattagtgtacaagacgttagatgataaggtcattcgcgactatacatctgatatcattatttctaatatttgtaaaggtaagttaagtaaagcgccaaaactagcattttatgctaatttctatctttcattgactacgactcggaccgatg

SEQ ID NO: 6670 - DNA, 203 bp, Homo sapiens
ggcgcgccagtcctcttacgatatctctgatcgtacgtatcctaagtttgttaacataacatccagcttgtcaaacagtaatagacgtggttttcagattgaagctatgaagcatgttatatatatggctagacgtggtgtggctgtactcgccaacacacatccaacaaaaattggaaatactgtatcgactcggaccgatg

SEQ ID NO: 6671 - DNA, 203 bp, Homo sapiens
ggcgcgccagtcctgcgattcaacctgatactgctactgcacaactgatcaaaacatattcaaacccaaaacagcgtggagataagggagaaattgtttacgatggagggcagagctctaagcttgccgaggttgttgatcagaccactgagccgcacaatgcagatggagctgtaaaggatgggaggcgactcggaccgatg

SEQ ID NO: 6672 - DNA, 203 bp, Homo sapiens
ggcgcgccagtcctatagctccagtgaagttagatttagagaagcaaaaacttgataaattaaagttatttgaagcatcacctttcgaccctttgacagtgaagaataatcaagatgttgtggacaagttgtacgctactcagtcatcatcaattcaagaagttgtgccgacgaagacttttgccacacgactcggaccgatg

SEQ ID NO: 6673 - DNA, 203 bp, Homo sapiens
ggcgcgccagtccttcattgttgccattagtcgacgcgaatttgaaggaggcatcctcatattacttcaaaaaattgatgccaagcattagcaatgttccagttgacgctcgtactttgcaatcagctacatctgccttggccgctgatacaggtctcgtagaccgtgcaccacatgtttctatgctgcgactcggaccgatg

SEQ ID NO: 6674 - DNA, 203 bp, Homo sapiens
ggcgcgccagtcctaagacgagtgctaactggaaagggtatagcatattagtatcacggtacagaagcctaattcctaatgaactatttgagtcccttagaaacattagcggtgaatacaacattaatccgcaagatgagcactctttcttctttgccttagcacagataaatgctgatgaagaattccgactcggaccgatg

SEQ ID NO: 6675 - DNA, 203 bp, Homo sapiens
ggcgcgccagtcctgctgacaagccattaatctctgagactatgttaaagatattgactattgatggaactacagggaaagatgggtacaggaactggttggataagctagttggtcataattacccggtttatgttgaaccggttgtcaacatcgtgaatttcattagtgcacgcttcatagctgaccgactcggaccgatg

SEQ ID NO: 6676 - DNA, 203 bp, Homo sapiens
ggcgcgccagtcctatgagagcgcaacatgagtatgtaagtccaagctcatcaagagtgtatattaaagacccagctgtagtgtacacgcgatcctaagattgtgatgtgattagatgtggtggaatactatcttacgcttcataggtgtggttgccgacgttgcgtagtggacaaatagaacccgaccgactcggaccgatg

SEQ ID NO: 6677 - DNA, 203 bp, Homo sapiens
ggcgcgccagtcctatcatgcaaacttatcaggtaaatgtttgatgctgtataacagcgagaaggatatcttcgaagggttgggatttaaggttaagggttcaagaatcaatgtttcaaaaactcagatcttgcgcaattatgagattaactttgaaaccattatcggtgtcgaaccgaatggattgacgactcggaccgatg

SEQ ID NO: 6678 - DNA, 203 bp, Homo sapiens
ggcgcgccagtcctcgttgtacgccatagtaggtggtggtcagatcacttcgcatgactttgttaacgccatcataactgatcaagagcagttaattgatttcactcaatctgagagggcattatctactcaagtggtgaaattagtttccttcattttaaaggattcgtttacagcaaaaggactgacgactcggaccgatg

SEQ ID NO: 6679 - DNA, 203 bp, Homo sapiens
ggcgcgccagtcctataaggctgatcatgaacgtgaggctgaactgactgatctaattaacaggattcgtgagaatgaagtcaccgttaatggtattctagagaaccagaaagctataacagctgctgaacgtgcagatttactattagaggttgtcgcttcgaccgctaagtcagtgtcggcagcagcgactcggaccgatg

SEQ ID NO: 6680 - DNA, 203 bp, Homo sapiens
ggcgcgccagtcctatgaccttagaaatacaacacttcattgcaaactagaaggtaagcaaaatatcgctggatatacagtctatgagtatctgattggaccttgggctcattacggtgacatagactactcagttgtagttgatacgctcaatgaggagacgaaatggtattgtgagattattggtacgactcggaccgatg

SEQ ID NO: 6681 - DNA, 203 bp, Homo sapiens
ggcgcgccagtcctacacttggaatcagtataatgcaggtaattggactaacattaaaccgtaagtaaattatcaatcttcggacatatgtaagcgtgggacacgtcaaaacagtgataacctggtcggcggagctacaaatccgcttgtcaggggaaactggatgtactaatgggatttgacccgaccgactcggaccgatg

SEQ ID NO: 6682 - DNA, 203 bp, Homo sapiens
ggcgcgccagtcctagctttgatctttatcgtctttcagattcatgatagctcacaacgcagaggtggtgtttgtactcttttcgatgtattatacaattacctcgtacagcgcaaactgaatcaggagagtgagttcttaagctatggcacgtacaaggaaaagaagtacatatacatcaatgggaacgactcggaccgatg

SEQ ID NO: 6683 - DNA, 203 bp, Homo sapiens
ggcgcgccagtcctttttgggaagacgtacaacattggtcagctgtactacagacagttgaatgttgaagtcaatactttgaagaaggtgttagccaatattgatgatcattcaagggttaagatgcacggtaattcacgtgatggctttgtaaaacgtcttgatgatgctgggaaaagtcgtgctaccgactcggaccgatg

SEQ ID NO: 6684 - DNA, 203 bp, Homo sapiens
ggcgcgccagtcctgtcagatgcaaagttggatgataggattgtacaaggtaagggatcacgttatatgtctgcaagtgtatacagatcacgcctgaatacagaatccactactactaataacgctcagagtcccgtttctgaccctgtcaatgcaagtgctaacgtaaaaacgtcaccagctggtaccgactcggaccgatg

SEQ ID NO: 6685 - DNA, 203 bp, Homo sapiens
ggcgcgccagtcctccacactgatgaatcagtgatgaagaaggaagatcatggagttattgttaatgaaagcacaacatttaaaattaattcagatgttgtctttgacgccgcagaggcaacttttgcagacacaagctccggtttgtcctcattgctaaaaactaagatgaagttttgattatcgatcgactcggaccgatg

SEQ ID NO: 6686 - DNA, 203 bp, Homo sapiens
ggcgcgccagtccttaagatgaagttttgattatcgattagtcgattgtcttcgattctcatctcagaatgagagtttagaatcggtggttgatagggtcatccacgccctgtcctgctgacgaactctcgttcggagtccattgttttgttagaggtgttgtagcgcctaggtaatttagaactgaccgactcggaccgatg

SEQ ID NO: 6687 - DNA, 203 bp, Homo sapiens
ggcgcgccagtcctgaaggattgttgttgttgcatgggggattagcgccaataacattagtgcgtgtttatcacgatgttaatgttggtggtctagtgaccggttcgatcgcagcatccgtttcaactctattgcgtaattgcatgttatacagttttgatatctatttcactccgaatggtgtttgtcgactcggaccgatg

SEQ ID NO: 6688 - DNA, 203 bp, Homo sapiens
ggcgcgccagtccttacttcatctcggcgtaatgatgacgttctcggaacgtgagctattgtgggcttgtcgggctccacattggccgttcaggaaggtgtgagcttatggccgccttctgagagctgatttgttctccactggatggtggggtagcagggaatgaactggtggtataattgactgaccgactcggaccgatg

SEQ ID NO: 6689 - DNA, 203 bp, Homo sapiens
ggcgcgccagtcctgctgccacgcaagtggaagtcgtgaatggaacgtgcatcattctcgccacagacatggggagttggtgtgatgattcaatcatgtacgagtgcgtcactattgactcgggagaagaaccagttgatgtggactgtttctgcaggggcgtcgagcgggtgtccctggaatacgggcgactcggaccgatg

SEQ ID NO: 6690 - DNA, 203 bp, Homo sapiens
ggcgcgccagtcctaggtgtgggaagccagttggcggcagaagcaggaggtcggtgtcgattccagtgcatgctcatagtgatcttaccggaagagggcataagtggcttaggggggactcagtcaagacgcatctgacacgtgtggaaggctgggtatggaagaataagctcctgacgatggcctttcgactcggaccgatg

SEQ ID NO: 6691 - DNA, 203 bp, Homo sapiens
ggcgcgccagtccttgtgcagttgtgtggatggtcacagacagcttaccgacaaggttcattgtcataacagtggccctttgtctggctcccacatatgccactcggtgcacacacctgcagaaccgggactttgtttcagggatccaagggacgactagagtctcattggtgttggaattgggtggccgactcggaccgatg

SEQ ID NO: 6692 - DNA, 203 bp, Homo sapiens
ggcgcgccagtcctcacacgggtgactatttggcagctaatgagtcccacagcaatcgaaaaacggcatcttttacaacgcagtccgagaagaccatcttgacactgggagattatggagacatctctctcacgtgccgggtgactagtggagtggatcctgcccaaactgtggtattggaactggaccgactcggaccgatg

SEQ ID NO: 6693 - DNA, 203 bp, Homo sapiens
ggcgcgccagtcctggcatcctgttgaagtctctggctggagtgcccgtggccaacatagagggcagtaagtaccatctccagagtggtcatgtcacctgtgatgtgggccttgaaaaactcaagatgaaaggaatgacatacacggtctgtgagggatcaaagtttgcttggaagaggccgccaacccgactcggaccgatg

SEQ ID NO: 6694 - DNA, 203 bp, Homo sapiens
ggcgcgccagtcctgctctgcacacagcttttggtgcagcattcaacaccatttttggaggagtgggatttctcccacgtattctgttgggggtggccctggcttggctggggctcaactcacggaaccctaccctctcagtcgggtttttgatcactggtggacttgtgttaacaatgacactggggcgactcggaccgatg

SEQ ID NO: 6695 - DNA, 203 bp, Homo sapiens
ggcgcgccagtcctgttggtgccgacatgggctgtgcaattgatgccaacaggatggagctacgttgtggtgagggccttgttgtgtggagagaggtcactgattggtatgatggctatgcattccacccagaatcgccccctgttcttgcggcatctctaaaggaagcatatgaggagggagtctgtcgactcggaccgatg

SEQ ID NO: 6696 - DNA, 203 bp, Homo sapiens
ggcgcgccagtcctgggattgtgccccagaaccggcttgagatggccatgtggagacgtgtggaggctgtgctcaacttggcccttgcagagagtgatgccaacctcacggtggttgtggatagaagggatcctagtgactacaggggaggcaaagtggggatcttaaagcggtcaggcaaggagatgcgactcggaccgatg

SEQ ID NO: 6697 - DNA, 203 bp, Homo sapiens
ggcgcgccagtcctaagacttcatggaagggatggagccaatcctttgtgtggagtgtcccagaatcgccacggcgttttatggttgggattgaggggactggggagtgtccacttgataaacgccgaacaggagtcttcacggtggcagagtttgggatgggaatgaggaccaagatcttcttggatcgactcggaccgatg

SEQ ID NO: 6698 - DNA, 203 bp, Homo sapiens
ggcgcgccagtcctctacgggagactagttcttcagactgtgacaccggagtcatgggggctgcagtcaagagcggtcatgccgtccacaccgatcagagtctctggatgaagtcacacaggaacgcaacgggagtgttcatatcagaactgatagtgaccgacttacggaactgcacatggccagcccgactcggaccgatg

SEQ ID NO: 6699 - DNA, 203 bp, Homo sapiens
ggcgcgccagtcctctggtgaggtcgatggtgctggctgacaacggagccatgttaagtgaaggtggagtccctggcattgtggccgtattcgtggtcctggagctagtcattaggagacgcccaacaactggcacctcagtggtgtggtgtggagtggtcgttcttggcctagtcgtaactgggctacgactcggaccgatg

SEQ ID NO: 6700 - DNA, 203 bp, Homo sapiens
ggcgcgccagtcctacctatttcttgctcctcgtgctggagcttgggtttccagaggcctcactgagcaacatttggaagtgggctgactccttggcaatgggaacattgattctacaggcgtgcagtcaagagggcagagcccgagtgggctatctcctggcagctatgatgacccaaaaggacatgcgactcggaccgatg

SEQ ID NO: 6701 - DNA, 203 bp, Homo sapiens
ggcgcgccagtcctgccataatccacacaggcttgaccatttttctatcagccgccacggcaatggcggtctggagcatgatcaagggtcaacgggaccagaagggactgtcctgggccacaccacttgtaggcctcttcggaggcgaaggtgtgggtcttagactgctggcgtttcgaaggcttgcacgactcggaccgatg

SEQ ID NO: 6702 - DNA, 203 bp, Homo sapiens
ggcgcgccagtcctgagcgaaggaacagacggtctttcagtgaaccactaacagtggtgggcgtcatgctcactgtggcaagtgggatggtgagacacacatcccaggaggctctgtgcgctcttgtggctggggcctttctcctcctcatgatggtgctgggaacacggaagatgcagctcatcgcacgactcggaccgatg

SEQ ID NO: 6703 - DNA, 203 bp, Homo sapiens
ggcgcgccagtcctgaatggtgcggtgaagtggaatggaacccagacctagtgaatgaggggggagaggtcaatctgaaagtgaggcaggacgccatggggaatctccatctcactgaggtggagaaggaagaacgcgctatggcgttatggcttcttgcagggttggtggcttcagcttttcactggcgactcggaccgatg

SEQ ID NO: 6704 - DNA, 203 bp, Homo sapiens
ggcgcgccagtcctgccggcattctgatagtattggctatatggacattctttgagatgctgagctcggggcgaaggtctgaacttgtcttctctggacaggggaccgggaccgaaaggaatcggccttttgagatcaaggatggagcctaccgcatctacagtcccggtttgctgtggggacatcgccgactcggaccgatg

SEQ ID NO: 6705 - DNA, 203 bp, Homo sapiens
ggcgcgccagtcctcagattggagtggggtatggagccaagggagtcctgcacaccatgtggcacgtcacaaggggagcagccctggttgtggaagaggcaatctccggaccctattgggctgacgtcagggaagatgttgtatgctatggtggagcatggagccttgagagccggtggaggggtgagcgactcggaccgatg

SEQ ID NO: 6706 - DNA, 203 bp, Homo sapiens
ggcgcgccagtcctaccgtccaggtgcacgcatttccaccagggagaccccaagagacacaccaatgtcagccgggagaactcatcctggagaatggtaggaaacttggagcagttcctattgacctgagcaaaggtacctcgggaagtccgataatcaatgctcagggagaggtggtgggtctttaccgactcggaccgatg

SEQ ID NO: 6707 - DNA, 203 bp, Homo sapiens
ggcgcgccagtcctgagctcgtgaggcagtgtgcaaaccgagggatgagaactctagttcttgcccctacccgggtggttctgaaggagatggagaaggcgcttgctggcaagaaggtccgcttccactcacccgcggtagaagggcagagcacagcgggagccgttgttgacgttatgtgccatgcccgactcggaccgatg

SEQ ID NO: 6708 - DNA, 203 bp, Homo sapiens
ggcgcgccagtcctgtggagatgactggaaccagaaagatcacgacagcatcggcagctcaacgccggggcagggtgggaaggacatctggacgcactgatgagtacatatactctggacagtgtgacgatgatgacaccagcctcgttcaatggaaggaggcacagatactcttggacaacattacccgactcggaccgatg

SEQ ID NO: 6709 - DNA, 203 bp, Homo sapiens
ggcgcgccagtcctacactgaggggtccagttgctactttttatggacccgagcagatgaagatgccagaagtggctggccactacaggctgaatgaggagaaaaggaaacacttccggcacttgatgacccaatgtgactttacgccttggctggcatggcatgttgctaccaacaccagcaatgtgcgactcggaccgatg

SEQ ID NO: 6710 - DNA, 203 bp, Homo sapiens
ggcgcgccagtcctgttgaggtggccgttctaggggtggccactcttggcatactgtggtgctttgtggcaagaacttcggttagccgaatgtttttgggcacggttgtgctctttgctgccctcttgttgctgtggattggtggagtggactacggatacatggcagggatagccctgatattctaccgactcggaccgatg

SEQ ID NO: 6711 - DNA, 203 bp, Homo sapiens
ggcgcgccagtcctatcttcctcactgtgctgcagccagagccggggaaacagcgaagtagcgatgataatagactggcatacttcctcctaggactccttagcttggctggacttgtgacggctaacgaaatgggcatgctggataaaacaaaagctgaccttgcagggctaatgtggcacggagagcgactcggaccgatg

SEQ ID NO: 6712 - DNA, 203 bp, Homo sapiens
ggcgcgccagtcctcaaaggcatccagcctgggaggagtggacaaatgtggacatccagccagcacgatcctgggggacgtatgtgttgatcgtctctctgttcaccccctacatgttgcaccagcttcagacaaaaatacaacaactggtgaatagttcggtggctagtggtgctcaggctatgagacgactcggaccgatg

SEQ ID NO: 6713 - DNA, 203 bp, Homo sapiens
ggcgcgccagtcctgaggctggggctgttggtctagctgcgttgggccagttggtccatcccgagactgagacactctggacaatgccaatggcgtgtggtatggcgggactcgtgcgagggagcttctggggcctgttgcccatgggacaccgattatggctcaagacaactggaacacgcagaggacgactcggaccgatg

SEQ ID NO: 6714 - DNA, 203 bp, Homo sapiens
ggcgcgccagtcctggtgccgatggagaaactcttggggacatctggaagaggcggctgaatggttgctctagggaggagttttttcagtaccgacgaagtggagtcatggagacggaacgtgacagggctcgagagcttctgaagagaggtgagacaaacatgggactggctgtctctcgagggacgcgactcggaccgatg

SEQ ID NO: 6715 - DNA, 203 bp, Homo sapiens
ggcgcgccagtcctcctgacgcgtcctgcgtgttcaaggttttggccccgtatagaccagaggtacttgaggctcttcacagattccagcttcaatggggcggggggctagtccgcgtccccttttcccgcaattccacgcatgagatgtacttctccactgctgttagtggcaacatcgtcaattcacgactcggaccgatg

SEQ ID NO: 6716 - DNA, 203 bp, Homo sapiens
ggcgcgccagtcctgtgaacatccagtccaggaagttgttagccagatttggagaccagcggggacctgccaaggttcccgaagtggatctggggactggcacacgctgtgtggtactggcagaggataaggttagggaagctgatgtggccgaaagaataactgctctcaaaacccaatatggtgaccgactcggaccgatg

SEQ ID NO: 6717 - DNA, 203 bp, Homo sapiens
ggcgcgccagtcctgctcgcccctccagctcgggaggctgcgtcatggacatcataactagaagagaccaacgtggttcaggtcaggtggtgacttacgctctgaacaccctcacgaacatcaaggtgcagctcatccgcatgatggagggagagggcgtgatcgggccatcagactcacaggatcctcgactcggaccgatg

SEQ ID NO: 6718 - DNA, 203 bp, Homo sapiens
ggcgcgccagtccttcggagggttactccagctgggaagaggttcccttctgctctcaccatttccatgagctgacgatgaaggacggcagggtcataattgtcccatgcagagatcaagatgagctggtggggcgggcaagagtgtctcctgggtgtggctggagcgtcagggaaacagcatgtctccgactcggaccgatg

SEQ ID NO: 6719 - DNA, 203 bp, Homo sapiens
ggcgcgccagtccttcaaaggcctacggacagatgtggctgttaagctactttcacaggagggatctgagaacgcttggtttggcaatctgctcagctgtgcccattgactgggtcccgcagggacgaaccacatggagcatccacgcgagtggagcgtggatgaccacagaggacatgctggaagtgcgactcggaccgatg

SEQ ID NO: 6720 - DNA, 203 bp, Homo sapiens
ggcgcgccagtcctgagccccaacgacgaactgtggcagcacaccatttggtgacgggaagctggtcgctcccgacgcaggccgtcgtaagaactttgtgagaccaaagcctcccagagagggccgaactgggaggttatgaaggcccctggctttggccaggaggggggagagggaaaattggcattcgactcggaccgatg

SEQ ID NO: 6721 - DNA, 203 bp, Homo sapiens
ggcgcgccagtcctcgtaagaactttgtgagaccaaagcctcccagagagggccgaactgggaggttatgaaggcccctggctttggccaggaggggggagagggaaaattggcattccctctcaggagatttcctccccctacaactaaatttccccctgccatgcagggggggcggttcttgttctcgactcggaccgatg

SEQ ID NO: 6722 - DNA, 203 bp, Homo sapiens
ggcgcgccagtcctacacgaaaacacatgctcaaactaaagactgttttttcttgatgttgaaagctattgctatggctaaagaacatatcttcattgaagatgggtccttttactccatagctattgctcttcgcttaataaacgcatcattggcaacgattttaaacaaacccgacatgctcaaatcgactcggaccgatg

SEQ ID NO: 6723 - DNA, 203 bp, Homo sapiens
ggcgcgccagtcctttacgaaattttctgcattcgacggacgaacgattgaaacggacatgacatacgcacaagtaactgaggaatgttctatgaagatggcttctcgctttaatcaacatatggacttcaccaattatttggacgcatacaggaaccccacatatgaacctgaagatattgtggagccgactcggaccgatg

SEQ ID NO: 6724 - DNA, 203 bp, Homo sapiens
ggcgcgccagtcctaccaagtcgcagattgtgattgtaatacatgtgattgctgtaacgacccggaactattggataggctttctacagtggccagaattcatggcacgaattgcgtgtgtctgttgactcgtttctatcaaggatttaaaacagccgatctttatgatatgactaagcaaattagtacgactcggaccgatg

SEQ ID NO: 6725 - DNA, 203 bp, Homo sapiens
ggcgcgccagtcctccccggtatacgataaccgtgtaacaattaagaagaacacaatcttagctgcacagaatctattacccgcttttgccaaaattgaaccaatcgagaagactatggacatacaaacagtacccgcatgtaaaggatgtgataactgctctcctatcgatgctcaacgatctttgccgactcggaccgatg

SEQ ID NO: 6726 - DNA, 203 bp, Homo sapiens
ggcgcgccagtcctctgaacaagacaaaggttcgattgtcatcgctagagacgtagtttaccgcaatcttttcagattcacggtggtgttgaacgaaaacggaacggaaaaacgacgcggatttggacaaatattcatgttaggaggtcgattaggtatgataccgaaacacttcctttacgtgatggcgactcggaccgatg

SEQ ID NO: 6727 - DNA, 203 bp, Homo sapiens
ggcgcgccagtcctggttggacataatggatggaacgccgtatgctacaatgaactcgttttttgagcatacttcgtctattttttatggtgatgacttcataatgaatatacgaccagaggttattgatgtttacaatcaagaaactctcacacccgttcttaagaagaatttggaaatgacaatgacgactcggaccgatg

SEQ ID NO: 6728 - DNA, 203 bp, Homo sapiens
ggcgcgccagtcctgctgatgtagaattaaaattacaagtcaacgctcaaccattccaagctgggcgtttattattagtttatattccaggttataaatatataggcgaggatcgacagaaatattatgacgatcgcactaatgttgacgatgctagcttggttccgttgactggttcccctcgtgtccgactcggaccgatg

SEQ ID NO: 6729 - DNA, 203 bp, Homo sapiens
ggcgcgccagtcctgatcctaatgcctcttacagttctgtagttgacttgcgttctgacacagatgtaacgttcaacgttccattcgtttcagttcagccatggaaattatctagcgcagatgtcacatcacctttgaaggattatcagcactctgttggtaggttgtacgtactcattcttaatgaacgactcggaccgatg

SEQ ID NO: 6730 - DNA, 203 bp, Homo sapiens
ggcgcgccagtcctttacgtgccacttccacagtgtctgatactatctcatgtcttgttgaagtttctggagcatcagattttgaattatctatgccacgacaaccgaagatttacccaacgttaagggccgccaaatcaacaactctgaatagagttatacgtggtattgcacaggtcaacgtagctcgactcggaccgatg

SEQ ID NO: 6731 - DNA, 203 bp, Homo sapiens
ggcgcgccagtcctgaatctacaccggtatccccagaaatcatccaaaagacaggtgaagtaggagaatctagtatgagacaaccgcaagggacatctttcactagctctgcactaactgtaggagaaaaagtaacatcgttacgacaaattttaaagcgatttcatttaatctattctaatttaactcgactcggaccgatg

SEQ ID NO: 6732 - DNA, 203 bp, Homo sapiens
ggcgcgccagtcctgcggcgcgtattcgattgatcccagagaatggcgctacagaagctaatgctggtccagttcaagaagacaatactgtcatcgatgagactagaacagctgctgatgtatatatgccacgaaatcttgaaggaactttcgaatttcaggtgcctcattactcgaggtatcctctccgactcggaccgatg

SEQ ID NO: 6733 - DNA, 203 bp, Homo sapiens
ggcgcgccagtcctaacctgcccctctaacgccagacgagcggcataaaactcgaacttctggcacgttccaccaccccttctcctatcccaacccccattgcgctctcaaggtcgcgcttttccgagactagctcggattcaaaaagttcctggcaccctttaccccttcaggcccttaaggtaggacgactcggaccgatg

SEQ ID NO: 6734 - DNA, 203 bp, Homo sapiens
ggcgcgccagtcctactgaccttgtgctgtgatctcggtgcggaagtgctactgcgtagtgattgtaagatccttttgtggttctgccctggcaaggctacagagtgctgtgatccgctgcggatgccatcctggtaacaggacccccagtgtgcgcaacagtatgttcacggtcttccgtgttcacccgactcggaccgatg

SEQ ID NO: 6735 - DNA, 203 bp, Homo sapiens
ggcgcgccagtcctacattcggaacactgctttcgtgaaacagtgtgtgtccaatccctgtgatcagtatcaaccacaccacctaggaatgctaggaaggtaccccggttcgccgggatctgatcctaggctaattgtctacggtggtgctcctttttattttccacttcaactcactggttacaactcgactcggaccgatg

SEQ ID NO: 6736 - DNA, 203 bp, Homo sapiens
ggcgcgccagtcctgcgcagattccgtgtggagacacgtgagaaaaccctctattcttacgtggaccccgcggttgacgcctacttaaagcgcgaacgaaggtttcccttctcccttcccaaaccctcccatttctacgactgcctcttttgcaaccatccctctgaagacgatgaggattcactcctcgactcggaccgatg

SEQ ID NO: 6737 - DNA, 203 bp, Homo sapiens
ggcgcgccagtcctcaccctcgacggagagtatggcgatccctgtccacttcactctggtgttcttgaccccaaacccagataccaaaagccccctgaggacattcttgaggattctaactggtgtgacgtccttaacgaggatgttacttacagcactgattctctccagaatgccttcgaccaactcgactcggaccgatg

SEQ ID NO: 6738 - DNA, 203 bp, Homo sapiens
ggcgcgccagtcctggctcttgctctgctccccggttctgctcaggtgaaggactcttcccacatctccaaactctacttcaagctcttctctctttcccaattccctggtgtccctaccacacctctttctctccccaagcccactggcaacatcatctcccaaggccaaagtcagaccaacatttacgactcggaccgatg

SEQ ID NO: 6739 - DNA, 203 bp, Homo sapiens
ggcgcgccagtcctttctacccagcacggtaacgcgatgatcaccaccggttccaccgccccagtggtcgtcgcatacccacctaccccctccgtgccccttcccaaccccgactgcccttccgaacctggtccgtcaggtgaccgcacatggctcctggacactttcgagtggtcccaggaaaaccccgactcggaccgatg

SEQ ID NO: 6740 - DNA, 203 bp, Homo sapiens
ggcgcgccagtcctcatgtggtggtgcctggctggtcagaatggaatgcagtacaacaccctagccaaccccacctaccccttttccgcctccaccaactggggcacccagaatggggttgcggcaactgcttacccgctacctgcttcttttgtgcaggcgtatccagactgcccctggaccgccatcgactcggaccgatg

SEQ ID NO: 6741 - DNA, 203 bp, Homo sapiens
ggcgcgccagtcctgcacgatacccatgcctacttcaactgtggctggcgcatgcaggtggtggtgaacggtactcagttccacgctggtgcccttctcatatacgccgtcccggaacgccccctgcttccgaacggtgttgaatatgagcacaccacctttgtctacccctacaccatcctcaacctcgactcggaccgatg

SEQ ID NO: 6742 - DNA, 203 bp, Homo sapiens
ggcgcgccagtcctctaccagtctaacaccgcaacattggaggtcccctacgtcggttgcacacccaataccaccacctgtgtgcactcgccgtggactttctacattgcgatcctcacccccttggctgtagcttcctcctccaaccagaccctttctgtttcagtttacataactcctgttaattccgactcggaccgatg

SEQ ID NO: 6743 - DNA, 203 bp, Homo sapiens
ggcgcgccagtcctcttcacagggtcttcccagcattacggccgcctagttgtatgctactcaccgccaagcggcgctcctcccgctaccatcacggaagcgatgcgcggcacctacactgtgtgggacatcaattcttcctccactcttgacttcaccattcctttcatctcccaatcctactggaacgactcggaccgatg

SEQ ID NO: 6744 - DNA, 203 bp, Homo sapiens
ggcgcgccagtcctcgcgcaagtcaccttccactattttccccccggcgcaacaccctatgacgccacctctcccaatgcttccactgacctggctaactgtttcaccgtcgatgctcagatcccaccgacatcgatggacacagtctgcctgtccttcccctacctttcagttctttctgctattcccgactcggaccgatg

SEQ ID NO: 6745 - DNA, 203 bp, Homo sapiens
ggcgcgccagtcctcacttcctactttggattctctaacttccagggcggtagcgatgtgctcaacaccacgcttggaactattgtgatctatgttgggtggcagggcgatgcccctacgggcaccgctcttactatctatcagaagatcgcttttggcaacttccgtggtttcgttcctcgcaaccccgactcggaccgatg

SEQ ID NO: 6746 - DNA, 203 bp, Homo sapiens
ggcgcgccagtcctgcccaaacttactgcctactcccaacccaacatggtaacgaagacgaacgccatcgtcaagttgccagtttaccggccaatggcgaccaccaaagccatggtgcgccgtcaatgtgccggggagtccctcttccaaccctgtctctgctctcgcgtttacattgttcgcgcacacgactcggaccgatg

SEQ ID NO: 6747 - DNA, 203 bp, Homo sapiens
ggcgcgccagtcctgcgcatgacctacacccactgggccctgcgttgtgtcgacagcgatggaacacgccagatttccctttctcgcttcaagttgtctgctgttgtggcatacgaggatccggaaggagaggtctaccgagaggtagaacctttccactggtccttggccgtcgcgatggtgggcagcgactcggaccgatg

SEQ ID NO: 6748 - DNA, 203 bp, Homo sapiens
ggcgcgccagtcctcccttgggactattctgcttccaacaactgcacccactttgtctctaacatcaccggtgttgaacttcccaacactggcttctcccttgctctcggaatcggggcactggcgatcggggctggtgttatggccgttcaaactgccaaaggccgtatcacccgccaggggttgctcgactcggaccgatg

SEQ ID NO: 6749 - DNA, 203 bp, Homo sapiens
ggcgcgccagtccttgcggatctggcaccacagcttcgcacctatttcactgagagaaacaccactctgggcgctctcttctattggctggcaaccaagcttggtttgttagtcactccagaggaggcggaagttgccgccatcgagcctcaaggcgtgcgggacttaaaggaaggtgtccaggctgtcgactcggaccgatg

SEQ ID NO: 6750 - DNA, 203 bp, Homo sapiens
ggcgcgccagtcctcctgtatgggccacctggcactgggaaatccttgcttggctccctccttgcctctgtcctcgctcagaagctctctggtgatcccaacgatgtgtactcccccacatcagcttcctgtgaatacttcgatgggtacacaggacaagtcgtccacttcattgacgacttgggacacgactcggaccgatg

SEQ ID NO: 6751 - DNA, 203 bp, Homo sapiens
ggcgcgccagtccttgaatttaacgatttcgaccagctcgttgacgcgatcgttgctaggttggatcgggcctctggtgttagctcccgccttgctgctctcatcaagcggcagggtgcccactcagagcgcaccttcgagaccgctccttctgagatcgacgcggacgaggttctcgaaatcctctccgactcggaccgatg

SEQ ID NO: 6752 - DNA, 203 bp, Homo sapiens
ggcgcgccagtcctgaccaagaaagaggacacaccggatgaaccgcaagcggcttattcgggcatgcctcaacttggtaagaaagacgccaaggcaaagggcccaaaacccgcccccaccaggggcgtcgtgcgacaagccggcccctcccctgctcttcccaagattgccgacaacgtcttgccaatcgactcggaccgatg

SEQ ID NO: 6753 - DNA, 203 bp, Homo sapiens
ggcgcgccagtcctgatctggacccctacctcccgccagtatcgtgacctccgtcgctttctgggctcccacccctaccctactggccacctcatctctgctttccaaggcgttccgatgttcatacggttctccaagaatcatatggtcactctggacgtcgaatctgttgtccacgaacccgtcgccgactcggaccgatg

SEQ ID NO: 6754 - DNA, 203 bp, Homo sapiens
ggcgcgccagtcctgtatgacttggactacaagtgttttgatgccaccctcccttcctgcgcattcagaattgttgaagattacctcgtgaaattgactggcgacgagcgcgtccgcgcgtacgtcgaaaccatcaggcattccaagcatgtctatggtagtcagacttacgagatgatcggcggcaacgactcggaccgatg

SEQ ID NO: 6755 - DNA, 203 bp, Homo sapiens
ggcgcgccagtcctgctcaatctctgtgcagcttgacctcagaactctggcctcccactgttcgtcctggtagaatagacaagcttttcactatccctaagaccactctctccgtggcattttcctctcagtgtcctgctccctcacgggactgcacccaggaactgtgagcttccccccctgtccttcgactcggaccgatg

SEQ ID NO: 6756 - DNA, 203 bp, Homo sapiens
ggcgcgccagtcctcctcagaactctggcctcccactgttcgtcctggtagaatagacaagcttttcactatccctaagaccactctctccgtggcattttcctctcagtgtcctgctccctcacgggactgcacccaggaactgtgagcttccccccctgtccttgaaatttctattcttttcttgccgactcggaccgatg

SEQ ID NO: 6757 - DNA, 203 bp, Homo sapiens
ggcgcgccagtcctgtgatagggtggctcaattgaccttaggaaacagcactatcactactcaagaggcagcgaacatcacagttgcctatggtgaatggccatcgtacttaagtgatttggatgctaccgctgtagacaagactaccaaaccaggcgtttcatgtgatagattctacacattacctgcgactcggaccgatg

SEQ ID NO: 6758 - DNA, 203 bp, Homo sapiens
ggcgcgccagtcctgaaagaaatgggaggcaactactaaaggatgggagtggaaacttccagacgcactgacagagcttggcgtttttggacagaattgtcagttccatttcttatataggtgtgggtggtctatacacgtgcaatgtaatgccacgaagtttcatcagggcacattactagtggtagcgactcggaccgatg

SEQ ID NO: 6759 - DNA, 203 bp, Homo sapiens
ggcgcgccagtcctgagcaatagcccaaggtattcctactacaaacacgccaggttcctaccagttcctcactactgatgaagatagtagtgcatgtatacttcctgatttcacaccaacccaagaaatccacattccaggagaggtcaagaatctacaggcactgtgtcaagttgagtccttactggcgactcggaccgatg

SEQ ID NO: 6760 - DNA, 203 bp, Homo sapiens
ggcgcgccagtcctcacttgagataactttcatgtttactgggtcattcatgacaacggggaagctgctgttagcctatacccctccaggtggtagtgcaccagctagtagagaagatgccatgcttggcactcatgtaatatgggattttggattacagagctccataaccctagttgtcccttggacgactcggaccgatg

SEQ ID NO: 6761 - DNA, 203 bp, Homo sapiens
ggcgcgccagtcctatgctagtgatgagggcatgatggaaactagacatgtcgtcaatacaaacacagtatcagaaacatctatagagagcttctatggtcgttgtggtctcgtatccatcaaagaaatagccgataacaagcaggttgagaaatggttggttaattttaatgaatttgtacagctaacgactcggaccgatg

SEQ ID NO: 6762 - DNA, 203 bp, Homo sapiens
ggcgcgccagtcctctaacccatcagcaatctttagtgccaacactgttcctgctagattcagcgtcccgtttgtgggaacagcaaatgcgtacacgattatgtacgacggatacaatgtgtttggatcaaacagaccatcagctgattatggcatgatcaacagcagtcacatgggtagcatggcctcgactcggaccgatg

SEQ ID NO: 6763 - DNA, 203 bp, Homo sapiens
ggcgcgccagtccttcaggtgccagcatggagtgatcggtgttgtgactgctgggggccagggagtggttggatttgctgatgtgcgcgacctcttctgggttgagcatgaagcaatggaacaaggccttactgattacattcagcaacttggaaacagttttggtcagggttttacagcagaaattacgactcggaccgatg

SEQ ID NO: 6764 - DNA, 203 bp, Homo sapiens
ggcgcgccagtcctccaattatgccagtcaactttcagagatgttaattggcgctgacggtatggtggagaggtgcctgcaaacctttgtgaaagtgatctcagcggttgtaattgccaccaggtctcaaggtgatgttcctactatacttgcaacccttgctctcatcggatgcgatggtagtccctcgactcggaccgatg

SEQ ID NO: 6765 - DNA, 203 bp, Homo sapiens
ggcgcgccagtcctaagcgagagaaaggcaagagtttaccaccaatttaaagactttaccattactggaagcgcaggtcgcaactttggaacactcctgcccaaccactgaacaacaggagaccatctttggaaacattcagtacctagctcaccactgcaggagatatgccccactttatgcagctgcgactcggaccgatg

SEQ ID NO: 6766 - DNA, 203 bp, Homo sapiens
ggcgcgccagtcctatgcgattcctccagacagtgaccattttgacggataccagcagcaggccgtggtagttatggatgatctcaaccagaacccggatgggaaagatatggttgctttttgtcaaatggtctccaccgtgccttaccatgtacctatggctgccattgaagagaagggaatgctctcgactcggaccgatg

SEQ ID NO: 6767 - DNA, 203 bp, Homo sapiens
ggcgcgccagtccttcactaagccacaaggcaagattgattgggttgaaccctctaagaaacatgggtttccagtgattaatgcaccatccaaaaccaaacttgagcccagtgttttctttgatgtgtttgagggagtcaaagaaccagctgctcttcatccaaaggaccccaggcttgaggttaactcgactcggaccgatg

SEQ ID NO: 6768 - DNA, 203 bp, Homo sapiens
ggcgcgccagtccttggaagaagcactcttttccaaatacactggtaacgtagacattgagatgccagaggaaatgaaagaggcggtggatcattatgctaatcagcttttggcactagacataccaactgagccacttagcatggaggaagccatttatggcacggaaggccttgaagctctggattcgactcggaccgatg

SEQ ID NO: 6769 - DNA, 203 bp, Homo sapiens
ggcgcgccagtccttacgaggagttttgccgcaagatcagatcagtaccagttggcagagctcttcacttaccatcatactcttcactgctgcgagagtggtatgagaagttttaaattacagttcaattgattatccggattggcctaaacttcaattggatacaatacacccaccggatggggtgtcgactcggaccgatg

SEQ ID NO: 6770 - DNA, 203 bp, Homo sapiens
ggcgcgccagtcctctcacactcatttcccccctcgcctgtcacaggcaacccccaccccttctcttacgggagttagggccaaggatctgttgcataggcgttgtatcccctaaccttttacctacccatcccaataggactggtatttcggttttgattgagtaatggatactgattctatacctgcgactcggaccgatg

SEQ ID NO: 6771 - DNA, 203 bp, Homo sapiens
ggcgcgccagtcctttacccattcaggggaaaaatggagtttctttcatggatctgacttgatatgaccaagagtcaacactttgcgtgttggccgtatggaatgctttaaggtttattctttggattatgacttcagggttggccgcccaggataaaaggcaattgtggtaagtgatgttagtcattcgactcggaccgatg

SEQ ID NO: 6772 - DNA, 203 bp, Homo sapiens
ggcgcgccagtcctagtccttgacgaatgcgtcccgtctgtcccgacggtgaggcgtatggcgcatgctcatggcattacccaatggtgtatctgtgaggggggggctcctcacacttagtctagtgctacctgacagggccgcggctggtcgtttgtgtatggtataaccagtagtaatcccccatgcgactcggaccgatg

SEQ ID NO: 6773 - DNA, 203 bp, Homo sapiens
ggcgcgccagtcctgattgctttaacttcccctcctcccttaccaagacattctctaagatggcaatctatgaggatgactcctcggagtcaattacatgctgtaactggattccacggaatcgtcgtaacaaagtaagaaaacaaaaacccaggagtaaggcctccagagtcgagatgtcaccagggcgactcggaccgatg

SEQ ID NO: 6774 - DNA, 203 bp, Homo sapiens
ggcgcgccagtcctcctcttgtcaccttggccgatgatggctatctctatgtgcataaacataaaggtgagactaaatttgttaggagggatgaaattctcacaaaatatggcagatgtattgttgagatggaagaagtttttcaatgtggacaagtccaatcaaatcaaacgggaaacaaaccatcgcgactcggaccgatg

SEQ ID NO: 6775 - DNA, 203 bp, Homo sapiens
ggcgcgccagtccttacacatttgattcattaaattggcaaaatacacagtatggagagtggacatgccccttgccaggcgcccttatggacactggggtgtttggacagaacttgagattccactatttatatagatctggtttttgtgtacatgtacaggtgaatgcttcttccttccatcagggtcgactcggaccgatg

SEQ ID NO: 6776 - DNA, 203 bp, Homo sapiens
ggcgcgccagtccttgtttattggttgccatggtgcccgaacatcagacaccaaaacagcaaaacaatgacttccaatactatgagactaaggaattttgtggaactgaatatccaacagaacagttgaccctcttcccacatcaattcttaaacctgagaacaaataattctgttacaattgtttaccgactcggaccgatg

SEQ ID NO: 6777 - DNA, 203 bp, Homo sapiens
ggcgcgccagtcctccttacacaaattgcaccccttctggttttggattgagtcataattttgttactttagtaattaggattgttgttcctctgtcctattcaacaggtgcttccactcaaatccctattactgtaagtgttgcccccatgtgttcttcatttgctggtttgagatctgcagttaaacgactcggaccgatg

SEQ ID NO: 6778 - DNA, 203 bp, Homo sapiens
ggcgcgccagtcctaatgtaaatatttctaagagtgctactgtacagggagaatcagactcaattccatctgctctaaatgctcacattgaacaagcggtcacaagtgcattaaacacccggccacaacacagccatgacaatgggcttgagattatacagggagatgcacccgctctaactgctgcacgactcggaccgatg

SEQ ID NO: 6779 - DNA, 203 bp, Homo sapiens
ggcgcgccagtcctaaaggccccttcactgcttggtggtggaaagatgatataattataacctcatatcatgcttgcaatgattggtatgcatatcttgaaaggaaaaacccagtttttaggtatagaattagtatgtcaactaagagatggtggaagaacccttaccttgttgaggccgttggcgtgcgactcggaccgatg

SEQ ID NO: 6780 - DNA, 203 bp, Homo sapiens
ggcgcgccagtcctactgaatatagattcccccaatactgtgaattgctaaactttagagatcaccaacagagagacctatggagttgtgtgggtgatgctgagccaggtttttgtggtagtatgctcttttctgaaggcaaagtcatagggatgctcactgccaaatctgaatgtacatatgctgatcgactcggaccgatg

SEQ ID NO: 6781 - DNA, 203 bp, Homo sapiens
ggcgcgccagtcctggagtggagggctttctcaaggacaaattatttaactctttgttttccattcttgttaaggccataggatctcttgtgatctacataaatgctaaagatgaatgtaagctttctacccttttagctcttggtagcatgttaggtgtggatttcatgtcaaaagaccccttcacacgactcggaccgatg

SEQ ID NO: 6782 - DNA, 203 bp, Homo sapiens
ggcgcgccagtcctgatctggaatttgccaaatctcttatgaaatcttctctgttccctgtttgtacatccactggttcctatactgctctaggactgtttgaccaatggcttgttcttcccgctcactcaaaccccaaggattctattgttttcaaaggtgagagtgttaaaatagtcgactctatgcgactcggaccgatg

SEQ ID NO: 6783 - DNA, 203 bp, Homo sapiens
ggcgcgccagtcctggtttggatctgaacacatctgctgggtacccctacaacacaatggggataaggaagagagacttaatcccacacagaggtgaaccattgacacaattgcagaaagctctcgatttacatggttatgatcttcccttctctacttatctaaaggatgaacttagacccaaggcacgactcggaccgatg

SEQ ID NO: 6784 - DNA, 203 bp, Homo sapiens
ggcgcgccagtcctgttgttcatggagggatgccatcaggatgttcagggacctccatttttaattctatcattaataatttagttgttaggactttagttcttaagtgctataaaggaatcaacttagatttactaagaatccttgcttatggagatgacttacttgtctcatacccatttccattgcgactcggaccgatg

SEQ ID NO: 6785 - DNA, 203 bp, Homo sapiens
ggcgcgccagtcctgaccctgcggtgcttgctgatgcgggcaaggagttaggcctcacaatgaccccagctgataaatctgattcttttagtggttgtagtaagttaactgaagttactttcttgaagagatcttttgtctttgatgaacaattcccttttctttgccacccagtgttccctatgtctcgactcggaccgatg

SEQ ID NO: 6786 - DNA, 203 bp, Homo sapiens
ggcgcgccagtcctgaaattcatgagtccattagatggactaggagtgctgcaacaacacaggaacatgtgacatcgttgtgcttattggcttggcataacggaaaggaagtttatgaagaattttgtgaaaagattcgcagcactccagttgggcgagctttatctttgccatcttttgaggtgcttcgactcggaccgatg

SEQ ID NO: 6787 - DNA, 203 bp, Homo sapiens
ggcgcgccagtcctcaccaagtgaattcttttcacttgatgacttgtgtcgccaacaaattttaaagatggtttatattgaccaatacgcttttcacatgttacatgaagacataaattgtatagggtttactctatcaatttatgatgaagataaacgaatgaaggacataacttattgggatctgacgactcggaccgatg

SEQ ID NO: 6788 - DNA, 203 bp, Homo sapiens
ggcgcgccagtcctattgtgaatatcatgaaaatttatatgatgcactaatgtcggccgaatttgaacaagtttggtttacattattgcttaaatatcttgattttgtaccagtaccaatgaattggagaggaatgccagaatttcctaccatttatgtatcaaaacatttttggtatgaattatatccgactcggaccgatg

SEQ ID NO: 6789 - DNA, 203 bp, Homo sapiens
ggcgcgccagtcctcttataaaaacaggactccgatagttattgaggcacaaacatcaggagataatatgactcttaaacaaccacgaccagttgttatagaagctcagacatctgctgattgtgttactttagctaaaaacacacaacgaatgattgaagcatttgcaagttctgatactgtaacaccgactcggaccgatg

SEQ ID NO: 6790 - DNA, 203 bp, Homo sapiens
ggcgcgccagtcctgtgataaaacttatacgctaaatgatgttaagaaaggacaatatatattgcgacaaggattagaatatacgatgccgacaattgatggtgattgtggagccccactaatcatcaatgaaacacaggttactagaaagatagctggtatacatgttgctggtgcagcatgtggtccgactcggaccgatg

SEQ ID NO: 6791 - DNA, 203 bp, Homo sapiens
ggcgcgccagtcctgagcttatgcagaatctataacccaaaaagatttggagcgtacatttagtaaaatagatgttacgatgcaaatccaattggatttagattcttcattagatttttctagaaccgaacccaaaattcctgctggagtcgaatttggaccggaagctctcactttttgtgatcttccgactcggaccgatg

SEQ ID NO: 6792 - DNA, 203 bp, Homo sapiens
ggcgcgccagtcctggagtagctccccaggatatccttggataaaggatagagtgaaaggaactaaaggaaaacaaggctggtttggtactgatggagaatttattctcaacgaagatgtcgaattagccgtacaacgacgactacaagcagctcgtgaaggaaaacgattacctgtgatgtgggtcgcgactcggaccgatg

SEQ ID NO: 6793 - DNA, 203 bp, Homo sapiens
ggcgcgccagtcctcgatgagagattttagtaaacatgtttccctcgtctcttatggagatgataatgtaattaacttcagtgatgaagttagtgcatggtataacatgtctactattgcagaggctttttcaacacttggattcacttatacagatgagctcaagggagttagaggcgaggtaccaacgactcggaccgatg

SEQ ID NO: 6794 - DNA, 203 bp, Homo sapiens
ggcgcgccagtcctttcgaaataccatacctgctgataaccaagaaaacgattctaccaatgtacataacacgaaactcgcgtcgacctcagcggagaatgccattgagaaggaacaaatcaccacctttcatgatgtggaaactccaaataggatcgatacccccatggctcaggatacttcatcggcgactcggaccgatg

SEQ ID NO: 6795 - DNA, 203 bp, Homo sapiens
ggcgcgccagtcctctaggagcatggatgatacgcacagtattattcagtttctacaacgccccgttctcattgacaacattgagattgttgcaggaacaactgccgataacaacacagcactcagtagatatgtgctagatagaacaaacccgcaaaaatacattaaacaatggacattaccatcaacgactcggaccgatg

SEQ ID NO: 6796 - DNA, 203 bp, Homo sapiens
ggcgcgccagtcctcccgtgcaggtgttacaggttatccgggagtcgaactagatttccaattagacaattcagttgagatgactattccatatgcatcttttcaagaagcatatgatttagttagtgggaatgaagattttgtgcagttgtacctttttacaattgcaccggttttgggaccttcagcgactcggaccgatg

SEQ ID NO: 6797 - DNA, 203 bp, Homo sapiens
ggcgcgccagtcctctgaatcagcgaattcaaaagtagacctttcagtctatatgtggttagataacatatctctcgttatccccacatatagattgaatccaaatcttccaaccggacaaactctaacccgcatagttcagaattccgattctgataaactcaaagaagcacttaagattgctaagtcgactcggaccgatg

SEQ ID NO: 6798 - DNA, 203 bp, Homo sapiens
ggcgcgccagtcctacccgataagtaacggagatgattggggcggtgtaataccagtgggaatgccttgctactctaagactattagagcagttaaaggcgccacttcgacgtcaaaaaccgaagtgatggacccagcaccgtgtgaatatgttgcaaatcttttctcatattggcgtgcaactatgtcgactcggaccgatg

SEQ ID NO: 6799 - DNA, 203 bp, Homo sapiens
ggcgcgccagtcctgaactcaaactcagcgaccaagaaggaaggttgatccagaacagtataacaatagagagaatggttctctccgcatttgatgaaaggaggaacaggtacctagaggaacatcccagtgcggggaaggacccgaagaagaccggaggtccaatctaccgaaggagagacgggaaacgactcggaccgatg

SEQ ID NO: 6800 - DNA, 203 bp, Homo sapiens
ggcgcgccagtccttgggtgagagagctgattctgtatgacaaagaggagataaggagaatttggcgtcaagcgaacaatggagaagacgcaactgctggtctcactcatatgatgatctggcattccaacctaaatgatgccacataccagagaacaagagccctcgtgcggactggaatggacccccgactcggaccgatg

SEQ ID NO: 6801 - DNA, 203 bp, Homo sapiens
ggcgcgccagtcctgagagaatgtgcaacatcctcaaagggaaatttcaaacagcagcacaaagagcaatgatggatcaggtgcgagaaagcagaaatcctgggaatgctgaaattgaagatctcatctttctggcacggtctgcactcatcctgagaggatccgtagcccataagtcctgcttgcctcgactcggaccgatg

SEQ ID NO: 6802 - DNA, 203 bp, Homo sapiens
ggcgcgccagtcctgcttgtgtgtacgggctcgctgtggccagtggatatgattttgagagggaagggtactctctggttgggatagatcctttccgtctgcttcagaacagtcaggtcttcagtcttattagaccaaatgagaatccagcacataaaagtcaattggtatggatggcatgccattctcgactcggaccgatg

SEQ ID NO: 6803 - DNA, 203 bp, Homo sapiens
ggcgcgccagtcctggaaacaccaatcaacagagagcatctgcaggacaaatcagtgtacagcccactttctcagtacagagaaatcttcccttcgaaagaccgaccattatggctgcgtttaaggggaataccgagggcagaacatctgacatgaggactgaaatcataaggatgatggaaagtgcccgactcggaccgatg

SEQ ID NO: 6804 - DNA, 203 bp, Homo sapiens
ggcgcgccagtcctttggtctggacatcagaactgccactcgtgaaggaaagcatatagtggagcggattctggaggaagaatctgacgaggcacttaaaatgactatcgcttcagtgcctgcttcacgctacctaactgaaatgactcttgaggaaatgtcaagggattggttaatgctcattcccacgactcggaccgatg

SEQ ID NO: 6805 - DNA, 203 bp, Homo sapiens
ggcgcgccagtcctaaatgacattccatggagcaaaggaagttgcactcagttactcaactggtgcgcttgccagttgcatgggtctcatatacaaccggatgggaacagtgaccacagaagtggctcttggcctagtatgtgccacttgtgaacagattgctgatgcccaacatcggtcccacaggccgactcggaccgatg

SEQ ID NO: 6806 - DNA, 203 bp, Homo sapiens
ggcgcgccagtcctagatggcgactaccaccaacccactaatcaggcatgagaacagaatggtactagccagcactacggctaaggccatggagcagatggctggatcaagtgagcaggcagcagaagccatggaagtcgcaagtcaggctaggcaaatggtgcaggctatgaggacaattgggactccgactcggaccgatg

SEQ ID NO: 6807 - DNA, 203 bp, Homo sapiens
ggcgcgccagtcctagaattgctccacacagagcataatggaatgctgtgtgcaacaagcctgggacatcccctcattctagacacatgcactattgaaggactagtctatggcaacccttcttgtgacctgctgttgggaggaagagaatggtcctacatcgtcgaaagatcatcagctgtaaatggcgactcggaccgatg

SEQ ID NO: 6808 - DNA, 203 bp, Homo sapiens
ggcgcgccagtcctaggactatttggagccatagctggattcatagaaggaggttggccaggactagtcgctggctggtatggtttccagcattcaaatgatcaaggggttggtatggctgcagatagggattcaactcaaaaggcaattgataaaataacatccaaggtgaataatatagtcgacaacgactcggaccgatg

SEQ ID NO: 6809 - DNA, 203 bp, Homo sapiens
ggcgcgccagtcctgcatggtccagctcaagctgccatgatgggaaggcatggttacatgtttgtgtcactggggatgatagaaatgcgactgctagcatcatttatgatgggatgcttaccgacagtattggttcatggtctaagaacatcctcagaactcaggagtcagaatgcgtttgcatcaatcgactcggaccgatg

SEQ ID NO: 6810 - DNA, 203 bp, Homo sapiens
ggcgcgccagtcctacaagcagcgtatatatagaagtattgcatttgactcaaggaacttgctgggagcagatgtacacaccaggaggggaggtaagaaatgatgatgttgaccaaagtttaatcattgctgctaggaacattgtcaggagagcaacagtatcagcagacccattggcttcactcctgcgactcggaccgatg

SEQ ID NO: 6811 - DNA, 203 bp, Homo sapiens
ggcgcgccagtcctgcaatcttacgaaaggggagaaagctaatgtattgatagggcaaggagacgtagtgttggtaatgaaacggaaacgggactctagcatacttactgacagccagacagcgaccaaaagaattcggatggccatcaattagtgtcgaattgtttaaaaacgaccttgtttctactcgactcggaccgatg

SEQ ID NO: 6812 - DNA, 203 bp, Homo sapiens
ggcgcgccagtcctaaacgatggaagttgtccagcaaacgagagtggataagctgacccaaggtcgccagacttatgactggacattgaatagaaaccagccggctgcaactgctttggccaacaccatagaagtattcagatcgaacggtctaacagccaatgagtcaggaaggttaatagatttcccgactcggaccgatg

SEQ ID NO: 6813 - DNA, 203 bp, Homo sapiens
ggcgcgccagtcctcaaatgttgtgagaaagatgatgactaactcacaagacacagagctctcctttacagttaccggagacaacaccaaatggaatgagaatcagaatcctcgaatatttctagcaatgataacatacatcacaaggaaccaacctgaatggtttagaaatgtcttgagcattgccccgactcggaccgatg

SEQ ID NO: 6814 - DNA, 203 bp, Homo sapiens
ggcgcgccagtcctagggaatacaagcaggagtggatagattctataggacttgcaagctagttggaatcaacatgagcaaaaagaagtcttacataaatcggacaggaacatttgagttcacaagctttttctaccgctatgggtttgtagccaacttcagcatggagctgcccagctttggagtttcgactcggaccgatg

SEQ ID NO: 6815 - DNA, 203 bp, Homo sapiens
ggcgcgccagtcctcatttgaattgaagaagctgtgggagcagacccgctcaaaggcaggactgttggtttcagatggagggccgaatttatacaacatccggaatcttcacattccagaagtttgcttgaagtgggagttgatggatgaagattaccagggaagactgtgtaaccctctgaacccgtcgactcggaccgatg

SEQ ID NO: 6816 - DNA, 203 bp, Homo sapiens
ggcgcgccagtcctttgtcagtcataaggaagttgaatccgtcaacaatgctgtggtaatgccagcccatggtccggccaagagcatggaatatgatgccgttgcaactacacattcatggattcccaagagaaatcgctccattctcaacactagccaaaggggaattcttgaggatgaacaaatgtcgactcggaccgatg

SEQ ID NO: 6817 - DNA, 203 bp, Homo sapiens
ggcgcgccagtcctaccagaagtgctgcactctattcgagaaattcttccctagcagttcatatcggaggccagttggaatttccagcatgatggaggccatggtgtctagggcccgaattgatgcacggattgacttcgagtctggaaggattaagaaagaagaatttgctgagatcttgaagatctcgactcggaccgatg

SEQ ID NO: 6818 - DNA, 203 bp, Homo sapiens
ggcgcgccagtccttcagatcgatagcaagctggatccagagtgagttcaacaaggcatgtgaattgaccgattcgagctggatagaactcgatgagataggggaagatgttgccccaattgagcacattgcaagcatgagaaggaactacttcacagcggaagtgtctcattgcagggccactgagtcgactcggaccgatg

SEQ ID NO: 6819 - DNA, 203 bp, Homo sapiens
ggcgcgccagtcctagatgaaatgggggatggaaatgagacgctgccttcttcaatctcttcaacagattgagagcatgatcgaggctgagtcttctatcaaagagaaagacatgaccaaagaattctttgaaaacagatcggagacatggccaattggagagtcacctaagggagtggaggaaggctcgactcggaccgatg

SEQ ID NO: 6820 - DNA, 203 bp, Homo sapiens
ggcgcgccagtccttgcgcttcttgcgtgaccggttagtactcttaacactctccgcctacttggtcgtcagcgctgtcttgggcacatctgttggggttagttcgacgctctacggtatcccccgcgtgacgaactacggtgttggggccgcttcgtgcgagccgatcgcctggtgtgtttcggctgcgactcggaccgatg

SEQ ID NO: 6821 - DNA, 203 bp, Homo sapiens
ggcgcgccagtcctcactagcgagtgttagtagtagtactgttgcttcgtagcggagcatgacggccgtgggaatccctccttggcaacaaggacccacggggccgaaagccacgtcctgaaggacccgtcatgtgtgcaaccccagcacggcagctttattatgaaacccactttaaggtgacactgcgactcggaccgatg

SEQ ID NO: 6822 - DNA, 203 bp, Homo sapiens
ggcgcgccagtcctgaatcggtaccgccttgcgaccaagcgaagtgtgtatggtggacggcacggacatgtgcctggctgacttccacgctggcattttcctgaaaggacaggaacacgctgtgtttgcctgtgtcacctccaacgggtggtacgcgattgacgacgaggacttttacccctggacgccgactcggaccgatg

SEQ ID NO: 6823 - DNA, 203 bp, Homo sapiens
ggcgcgccagtcctcggacccgtccgatgtcctggtatatgttccgtacgatcaagaaccactcaacggagaatggaaagcaaaggttcagaaacgactcaagggagccgggcaatccagcccggcaaccgggtcgcagaaccagtcaggcaacactggaagcatcattaacaactactacatgcagccgactcggaccgatg

SEQ ID NO: 6824 - DNA, 203 bp, Homo sapiens
ggcgcgccagtcctaataccagaattccatggacacacaacttggtgacaacgctattagcggaggctccaacgaaggttccacggacaccacttccacacacacaaacaacacccaaaacaacgattggttctcgcgcctagccagttcggccttcaccggactgtttggcgctcttttggccgacacgactcggaccgatg

SEQ ID NO: 6825 - DNA, 203 bp, Homo sapiens
ggcgcgccagtcctggtttttcaagaaacacctgtttgattggacaccaaatctatcgtttggacactgtcactacctggaactcccctccgaacacaaaggcgtgttcggcagcctcatggactcctacgcctacatgaggaacgggtgggacattgaggtgaccgctgttggaaaccagttcaatgcgactcggaccgatg

SEQ ID NO: 6826 - DNA, 203 bp, Homo sapiens
ggcgcgccagtcctgtggttgcctcctcgtcgcactcgtcccggagctgaaagaacttgacacgcggcagaagtaccagttgaccctcttcccacaccagttcatcaacccacgcaccaacatgacggctcacatcaacgtgccgttcgtgggtgtcaacaggtacgaccaatacaagctccacaagccgactcggaccgatg

SEQ ID NO: 6827 - DNA, 203 bp, Homo sapiens
ggcgcgccagtcctccacagaacccgagcgggccgcgcactgtatacattctgagtgggacactggtcttaattctaagttcaccttttccattccttacctctctgctgctgactacgcttacactgcttctgacgtggccgagaccacgagtgtgcagggatgggtgtgcatttatcagattacgccgactcggaccgatg

SEQ ID NO: 6828 - DNA, 203 bp, Homo sapiens
ggcgcgccagtcctttgctgttcttgcacagcgggtaagcaacaggctgcccacctccttcaactacggtgctgtgaaggctgacaccatcacggagctgttgatccgcatgaagcgtgcggagacatactgccccaggcctttgctagctcttgacaccacccacgaccgccgtaagcaggagatcacgactcggaccgatg

SEQ ID NO: 6829 - DNA, 203 bp, Homo sapiens
ggcgcgccagtcctctgataccggccttgagattctggacagcacgtttgtcgtgaagaagatctccgactcgctctccagtctctttcacgtcccggcccccgtcttcagtttcggagccccgattctgttggctgggttggtcaaggtcgcctccagtttcttccggtcaacacccgaagacctcgcgactcggaccgatg

SEQ ID NO: 6830 - DNA, 203 bp, Homo sapiens
ggcgcgccagtcctagcaacgggacctcaacgacccaagcaagtacaaggaggctaaggagtggctcgacaacgcgcgccaagcgtgtttgaagagcgggaacgtccacattgccaacctgtgcaaagtggtcgccccggctcccagcaagtcgggacccgatcccgtggtcgtttgtctccgtggcacgactcggaccgatg

SEQ ID NO: 6831 - DNA, 203 bp, Homo sapiens
ggcgcgccagtcctagccccaaccacctctacagaatgtctaccaacttgttcaggaggtgattgaccgggttgagctccacgagaaagtgtcgaaccacccgatcttcaaacaaatctcaattccttcccaaaagtccgtgttgtactttctcatcgagaagggacagcacgaagcagcaattgaatcgactcggaccgatg

SEQ ID NO: 6832 - DNA, 203 bp, Homo sapiens
ggcgcgccagtcctagcccaccaaacccgcggaagagcaaccacaagctgaaggaccctacgccgggccgctcgagcgtcagaaacctctgaaagtgaaagctaagctgccacagcaggagggaccctacgctggcccgatggagagacagaaaccactgaaagtgaaagtgaaagccccggtcgcgacgactcggaccgatg

SEQ ID NO: 6833 - DNA, 203 bp, Homo sapiens
ggcgcgccagtcctaggaaggaccttacgagggaccggtgaagaagcctgtcgctttgaaagtgaaagctaagaacctgattgtcactgagagtggtgccccaccgaccgacttgcaaaagatggttagtggcaacacaaagcctgttgagctcatcctcgacgggaagacagtagccatctgctgtgcgactcggaccgatg

SEQ ID NO: 6834 - DNA, 203 bp, Homo sapiens
ggcgcgccagtcctctactggagtgtttggcaccgcctacctcgtgcctcgtcatcttttcgctgagaagtatgacaagatcatgttggacggcagagccatgacagacagtgattacagagtgtttgagtttgagattaaagtaaaaggacaggacatgctctcagacgccgcgctcatggtgctgccgactcggaccgatg

SEQ ID NO: 6835 - DNA, 203 bp, Homo sapiens
ggcgcgccagtcctctggcctctttgcctacagagccgccaccaaggctggctactgtggaggagctgttctcgccaaggacggcgccgacacattcatcgttggcacacactccgcaggtggcaatggagttggatactgctcttgtgtttccaggtccgtgctccagaggatgaaggcacacattgcgactcggaccgatg

SEQ ID NO: 6836 - DNA, 203 bp, Homo sapiens
ggcgcgccagtcctaccctgaaccacaacacgaggggttgatcgttgacaccagagatgtggaagagcgtgtgcacgtcatgcgcaaaaccaagctagcacccaccgtggcacacggtgtgttcaaccctgagtttgggcccgccgccctgtccaacaaggacccgcgcctgaacgaaggagttgtcccgactcggaccgatg

SEQ ID NO: 6837 - DNA, 203 bp, Homo sapiens
ggcgcgccagtcctccatggagccagacaccgcgcctggccttccctgggctctccaggggaagcgccgcggcgcgctgatcgacttcgagaacggcacggtcggacccgaagttgaggctgccttgaagctcatggagaaaagagaatacaagtttgcttgccagaccttcctgaaggacgaggttccgactcggaccgatg

SEQ ID NO: 6838 - DNA, 203 bp, Homo sapiens
ggcgcgccagtcctcctacgagaacaaacgcatcactgttgaaggcgggatgccgtctggctgttccgcaactagcatcatcaacacaattctgaacaacatctacgtgctctacgcgctgcgtagacactatgagggagttgagctggacacttacaccatgatttcctacggggatgacatcgtggcgactcggaccgatg

SEQ ID NO: 6839 - DNA, 203 bp, Homo sapiens
ggcgcgccagtccttcgcaagtgattacgatctggactttgaggctcttaagccccacttcaaatctcttggccaaaccatcactccagctgacaaaagcgacaaaggttttgttcttggtcactccattgccgatgtcactttcctcaaaagacacttccacatggattatggaactgggttttacacgactcggaccgatg

SEQ ID NO: 6840 - DNA, 203 bp, Homo sapiens
ggcgcgccagtcctaacctgtgatggcttcgaagaccctcgaggccatcctctcctttgcacgccgtgggaccatacaggagaagttgatctccgtggcaggactcgcagtccactctggacctgacgagtaccggcgtctctttgagcccttccagggtctctttgagattccaagctacagatcaccgactcggaccgatg

SEQ ID NO: 6841 - DNA, 203 bp, Homo sapiens
ggcgcgccagtcctactctgacagagaatgaaaatcccgaagacattgactgctggtgctatggagtgcccaacgtgtatgtcacatacggacgttgcaaacatgatggacaaccgcgaaggaacagacgatccgtggctttgacaaaccatgttgaagaaacattgaacacccgtggagagaggtggcgactcggaccgatg

SEQ ID NO: 6842 - DNA, 203 bp, Homo sapiens
ggcgcgccagtccttacaaggcaaccctctcagaacataagacagccaaccattgcccaacggcaggagaagcctttttagatgaagagagtgatgaccaacatatttgcaaacgtgggttctctgaccgaggctggggaaatggatgtgggttatttggaaaaggaagtattgtcgcctgctcaaaacgactcggaccgatg

SEQ ID NO: 6843 - DNA, 203 bp, Homo sapiens
ggcgcgccagtcctgatgagccacacgctacaacagtcaccgtcacgagcatggggaaccaagaaggatccctgaaggcatccatggttggggctacaaaaatctcttattctgaaaacaaatatcacatcaaaggaggacatgcagtttgccaaatacaactacagggactaaccatgaaaggaagccgactcggaccgatg

SEQ ID NO: 6844 - DNA, 203 bp, Homo sapiens
ggcgcgccagtccttacccaacatcgccgcgtgaaattgctgccgtcattgcacaaacattctcaaatggcgcatgtgggctcaactctgtggatgagttagaacaccaaatgtggaaaggaattgaagatgaaattaaccacgttctaagtgagaatggtctggatctgtctgtagtcgtgcaggaccgactcggaccgatg

SEQ ID NO: 6845 - DNA, 203 bp, Homo sapiens
ggcgcgccagtcctggaacttggcaaattaccagattggaattacaatcatacagggaatgtctttggcctccaatgcacacagcaggaatcacttctgtgatggaaagtgatttgttcatgccccgagagctgggaggacctgtcaccttacataaccatatcccaggttacgcgacacaggtttatcgactcggaccgatg

SEQ ID NO: 6846 - DNA, 203 bp, Homo sapiens
ggcgcgccagtcctccatggtcacacgtcctgatgggcacaggtctgttaatagtgtcaactgtgcacccagctggattggttctggccgctttcgcattctggtattatcagtacaccaagcaacgcagcaatattctatgggaactaccagaagtcgccgagcggacaccaatgttgactgaaggacgactcggaccgatg

SEQ ID NO: 6847 - DNA, 203 bp, Homo sapiens
ggcgcgccagtcctgacctgcatccaggatctgggaaaacccgacaagtactgcccgctcttcttaggaaatgtgtggaaaaaaggcttagaacactcgtcctggctccaacaaaagtagtgttgagtgaaatgcatgaagcagttaaagacttaccagttaggttccacacgagcgccgcgctggaacgactcggaccgatg

SEQ ID NO: 6848 - DNA, 203 bp, Homo sapiens
ggcgcgccagtcctttggcagcagttgtgttaatgacagcaacacctcctggaacaagtgatccattcccggagtctaatgggacaatagaagacacacaggtgactattccagatgaaccttggaaaagaggcaacgaatggatacttgatgatccccggccaactgcgtggttcctgccttccatccgactcggaccgatg

SEQ ID NO: 6849 - DNA, 203 bp, Homo sapiens
ggcgcgccagtcctggagatttggtgtgctggaaagaagcgttgatgatcctggataacatggaaatccctggaggattcacgatgagcctctttggtagtgaggctaggaaagtcgagcacgttccaggggaataccgtttaaaaccagaagcaaggaaacggttcaggcaactgatgaggaagtatcgactcggaccgatg

SEQ ID NO: 6850 - DNA, 203 bp, Homo sapiens
ggcgcgccagtcctagaatgtttgctgacggacagacccaaaaagcgttcatagagtacgcaacaacaacacgatcaataacagccgtgatcgaaaaggtggctatggtgccagaggccttaaaagacaaggtgcaggatgctttcgacacctactacactttgtacaaggcagaagaaaaatcacgccgactcggaccgatg

SEQ ID NO: 6851 - DNA, 203 bp, Homo sapiens
ggcgcgccagtcctagttaccaaatcgctcttgaacagatacctgatgccctaataacgacattgtgcttgggagccttggctgcagccacaggaggaatccttctctatttgttgctgccaaaaggaatgtctcgcatgacactggctttcttcactatgttggtaacgggggctggtttatggatgcgactcggaccgatg

SEQ ID NO: 6852 - DNA, 203 bp, Homo sapiens
ggcgcgccagtcctgtcaactatggagccatatcattacagggaatatcccagggagcggctgccctttttcagatggacaaggggtatcctttcatgcggttgagaattccgctggttctgctgttggcaggggccatcaacaacctcactgccatcacagcaggactagggttcctatgtgctatgcgactcggaccgatg

SEQ ID NO: 6853 - DNA, 203 bp, Homo sapiens
ggcgcgccagtcctgctgcagtaggaatggctcatgccttatggaatgcccaggcaaatcgcagaggtggcacaggatccggaatgaccccaggggaggcttggaagaaacagctgaataagcttgggaaaacacaatttgagcagtacaagagatcatgcatacttgaagtggacaggacacatgcccgactcggaccgatg

SEQ ID NO: 6854 - DNA, 203 bp, Homo sapiens
ggcgcgccagtcctgtaatggccttcaccctgggtgtgcaagggcatgaaaagccaataatgagaacaactctagggtggaatctcataagattcaaggacaagacagatgtgttcaacatggaagtaatccctggggacacactgttatgtgacattggagaaagttcaccgagcattgcagtggaacgactcggaccgatg

SEQ ID NO: 6855 - DNA, 203 bp, Homo sapiens
ggcgcgccagtcctattgatgaggacaagataagacgacgggtggaccttctaagagaagagtacaagaagacctggttccatgatttaaaccatccatacaggacgtggcattacattggctcttacttgacaagaggaggaggaacagcggcatccatgaccaatggcatagtcaaactcatgtcacgactcggaccgatg

SEQ ID NO: 6856 - DNA, 203 bp, Homo sapiens
ggcgcgccagtcctcaaccatgggacgcagtggctggggtggcatgcatggccatgactgacacaacaccatttggacagcagagagtgtttaaagagaaagtggataccaaaccgccagaacccaacaagacagtgcgtcatgtgatggccatgactaatagctggatcatgaaatacttggccaggcgactcggaccgatg

SEQ ID NO: 6857 - DNA, 203 bp, Homo sapiens
ggcgcgccagtcctgaatgtagaacatgtgtgtacaacatgatggggaaacgagagaagaaaccatctgaatttgggaaagccaaagggagccgagccatatggtatatgtggctcggagctcggtttcttgagtttgaggcactgggtttcttaaatgaagatcactgggtctcccggaagaactctcgactcggaccgatg

SEQ ID NO: 6858 - DNA, 203 bp, Homo sapiens
ggcgcgccagtcctctgatcgggagggctaggatttcccctggaaatggctggttggttagagagactgccccattaagcaaggcctatgctaacatgtggaaactgttttactttcaccgtagagatctaaggctgatggctaatgcaatcaactcagctgtccccattgactgggtcccaacgggacgactcggaccgatg

SEQ ID NO: 6859 - DNA, 203 bp, Homo sapiens
ggcgcgccagtcctatgattggcacatcaaagagaagcagttgggctgaagctcttcctcacactgtacaaaaggtgagaggcattgtggggacacaagagaggtaccgtgattaccttgaaactcaaaacaggttcaggaccatagtccaacatcttgttggagatatcctgtgagagcaataaaaacgactcggaccgatg

SEQ ID NO: 6860 - DNA, 203 bp, Homo sapiens
ggcgcgccagtcctattttaaagacaaaagtgtcaggccaagattgagaaaatcttgccacagcttggcagactgtgcagcctgcagccctagagggagactgaccaactccctttagtagaaaaggtcagggaagaacttgaggatgggtgtggcctcaagatctcttctcaaaaaacggactgaaccgactcggaccgatg

SEQ ID NO: 6861 - DNA, 203 bp, Homo sapiens
ggcgcgccagtcctaccacacctagatgaagatagtaggggagcctccgccaatggtggctttacatattgagctactgcattggtcgatggggactagcggttagaggagaccctctcctacgcatggattttgcaatatgttgacatcagggaaagaccgggtgtttgtcggttccggagagctcccgactcggaccgatg

SEQ ID NO: 6862 - DNA, 203 bp, Homo sapiens
ggcgcgccagtcctggtcgatggggactagcggttagaggagaccctctcctacgcatggattttgcaatatgttgacatcagggaaagaccgggtgtttgtcggttccggagagctccggaggccagggcgccgtttgcccgtagtttataactggccttcggggatcgaaggagttgccaaacactcgactcggaccgatg

SEQ ID NO: 6863 - DNA, 203 bp, Homo sapiens
ggcgcgccagtcctgtcaaggttgagccacatacaggaaactatgtcgcggccaatgaaacccacagtgggaggaaaaccgcattgttcacagtctcttcggaaaaaacaattctaaccatgggcgaatacggagacgtgtcgctgatgtgcagagtcgctagtggcgtcgatctggcacaaaccgttcgactcggaccgatg

SEQ ID NO: 6864 - DNA, 203 bp, Homo sapiens
ggcgcgccagtcctgttcttgagctcgacaagacagcagaacacctccccacggcatggcaggttcacagagattggtttaacgatctagctctgccttggaaacatgagggaatggtgggttggaacaatgctgaacgcctggttgagtttggagttcctcatgccgtgaagatggatgtttacaaccgactcggaccgatg

SEQ ID NO: 6865 - DNA, 203 bp, Homo sapiens
ggcgcgccagtcctgagatgcagctccccccaggagacaacatcatctatgttggggaactaaaacaccagtggttccagaaggggagtagcattggtagagttttccagaaaacaaggaaaggcatagagaggctgacagtgctgggggaacatgcgtgggacttcggttccactggcggatttttgcgactcggaccgatg

SEQ ID NO: 6866 - DNA, 203 bp, Homo sapiens
ggcgcgccagtcctaccatgacgcttggagtgggggctgacgttggatgtgctgtggacactgaaagaatggaacttcgctgtggtgaaggtttggtcgtgtggagagaggtgtcagaatggtatgataactatgctttttaccctgaaacaccggcggcccttgcttcggctttgaaggagatggttcgactcggaccgatg

SEQ ID NO: 6867 - DNA, 203 bp, Homo sapiens
ggcgcgccagtcctgatcaaggtggcctggtgcgctcgatggtggtggctgacaatggagagctgctcagcgaaggaggaatccctggaattgtggcagtgttcgtggtccttgaatacatcattcgcaaaaggccgagtgcaggactgacggttgtgtggggaggagtcgtggtcttggcgctgcttcgactcggaccgatg

SEQ ID NO: 6868 - DNA, 203 bp, Homo sapiens
ggcgcgccagtcctgtcactggcatggtaacgctgcagagcatgctgcgttatgttattgctgtgggggtgacatttcacctcgagctagggccagaaatcgtggctttgatgctgctccaggcagtgttcgagctaagggtcggactcctcggtgcgtttgtgctgcgcagaagtctaacaacccgccgactcggaccgatg

SEQ ID NO: 6869 - DNA, 203 bp, Homo sapiens
ggcgcgccagtcctgaggtggtgaccatctattttctcctcttggtcctggaacttggtctgccgagcgcaaacctggaggccttgtgggggtgggcagacgcattagccatgggagcaatgatattcagagcttgcacggctgagggaaaaaccggactgggactcctgttggtggctctcatgacccgactcggaccgatg

SEQ ID NO: 6870 - DNA, 203 bp, Homo sapiens
ggcgcgccagtccttggggacaccgccaggtcggagttggctttggttctaagggcgtcctccacacaatgtggcacgtgactaggggagctgccatattcattgacaatgcagtggctggaccctattgggcagatgtgaaggaggatgttgtgtgctacgggggagcctggagcctggaggagaaacgactcggaccgatg

SEQ ID NO: 6871 - DNA, 203 bp, Homo sapiens
ggcgcgccagtccttggaaaggagaaaaggttcaagttcatgcctttcctccaggaagagctcatgaagtgcatcagtgccaacctggagaattggttctggatactggaaggaggattggtgcaatacccattgatctggcgaaagggacatccggcagccccatactcaacgcccagggggcggtgcgactcggaccgatg

SEQ ID NO: 6872 - DNA, 203 bp, Homo sapiens
ggcgcgccagtcctagacaaaaagggaagagtgtgatttgcctaaacagcaagacctttgaaaaagactattccagagttagagatgagaaaccagattttgtggtgacaacagacatttcagaaatgggggcaaatcttgatgtgagtcgcgtcatagatgggcgaacgaacattaagccagaggagcgactcggaccgatg

SEQ ID NO: 6873 - DNA, 203 bp, Homo sapiens
ggcgcgccagtcctgtggcatatgcttcgggacggcggagtcttggggacatgctgacaggaatgtcaggggttcctgagctcctgcgccacagatgcatgagtgccatggatgtcttttacacactgctttatgaggagcctggcagcagagcaatgaagatggcagagagagatgctccagaagcccgactcggaccgatg

SEQ ID NO: 6874 - DNA, 203 bp, Homo sapiens
ggcgcgccagtcctcttgtgttctacaccttgttgacagtgctgcagcctgaagctggcaagcagaggagcagcgacgacaacaagctggcttacttcctcctgacactctgcagcctagctggcctggtggctgccaacgagatgggattcctggaaaagaccaaggcagatttatctgctgtgctacgactcggaccgatg

SEQ ID NO: 6875 - DNA, 203 bp, Homo sapiens
ggcgcgccagtcctcaggccatgcgagatcttggggggggaactcctttctttggagtggctggacacgtcctgactctcggagtggtatccctagtgggagcgacaccaacctccttggtggtgggcgtaggactagcagcttttcacctggccatcgtggtgtccggcctggaggctgagctgacccgactcggaccgatg

SEQ ID NO: 6876 - DNA, 203 bp, Homo sapiens
ggcgcgccagtcctcagagagcccacaaagttttcttctcggcaatggtacgcaatcccatggtggacggagatgtcatcaacccatttggagatggggaagtgaaacctgccctgtatgaaaggaagatgagcttgatactggcgatgatcctgtgtttcatgtctgtggttttgaaccgaacggtgcgactcggaccgatg

SEQ ID NO: 6877 - DNA, 203 bp, Homo sapiens
ggcgcgccagtcctcccgcagttacggaggcatcggctgtaggactggcagcagcagggcagcttatcaggcctgaggctgacacgctctggaccatgccggtggcttgtgggctgagtggtgtggtcaggggaagcctatgggggtttctgcctcttgggcacaggctatggctgagaacttccggacgactcggaccgatg

SEQ ID NO: 6878 - DNA, 203 bp, Homo sapiens
ggcgcgccagtcctagaatggtgacaagcctgggttggaatttaatcaagtttagggctggaatgaatgtgtttaccatgcaaccacatcgcgctgatactgtgatgtgcgatattggagagagtagcccggacgccgccattgaaggtgagagaacccgcaaagtgatactgctcatggagcagtggcgactcggaccgatg

SEQ ID NO: 6879 - DNA, 203 bp, Homo sapiens
ggcgcgccagtcctcaatacagtgatacctggcatgtggatagggaacacccataccgaacgtggcagtactggggtagctatcgcacagcgcccactggctctgcagcttcactgattaatggagttgtgaagctcctcagctggccgtggaatgcacgggaagatgtggtgcggatggcaatgacacgactcggaccgatg

SEQ ID NO: 6880 - DNA, 203 bp, Homo sapiens
ggcgcgccagtcctttgaagaagctgtcgctgttggagggaggtcttttctatgcggacgacacagccggatgggacaccagggtcaccaatgcggatctggaagatgaagagcagatcctgcgttacatggaaggtgaacacaaacagctggcagccactgttatgcaaaaggcatatcatgccaagcgactcggaccgatg

SEQ ID NO: 6881 - DNA, 203 bp, Homo sapiens
ggcgcgccagtccttcacacaaccccaggctgctacgagtggagaggtggctgcgtgaccacggagaagaacgccttggaagaatgctgatcagtggagatgattgtgtggtgagacccatagatgacaggtttagcaaggccctctacttcttgaatgatatggccaagactagaaaggacatcggccgactcggaccgatg

SEQ ID NO: 6882 - DNA, 203 bp, Homo sapiens
ggcgcgccagtcctgaatgggagcattcagctggcttctcaagctgggaggaggttcccttctgctcgcaccatttccatgagttggtgatgaaggacggacgcaccctggtcgtgccatgccgagatcaggacgaactggtggggagggcacgcgtctcaccggggtgtggttggagtgtccgcgagcgactcggaccgatg

SEQ ID NO: 6883 - DNA, 203 bp, Homo sapiens
ggcgcgccagtcctgctggccggtggtagaaaaccccccaacagggtgccaaacggcaacacgccagtgagagtggcgacgggaacatggtcgctcccgacgtagggcactctatccaattttgtgagaccccccgcaccatggaaggccaaacatggtgcatgaagggaaaggcccccggaagcttgcgactcggaccgatg

SEQ ID NO: 6884 - DNA, 203 bp, Homo sapiens
ggcgcgccagtcctggaaaacgagtcaaacaagtggccccaccaccaactaggggtcacatggagagaggactctctctcttaaccaagaacgacaatgtgtcgcgacaggcaaaacggcaacgaaaccctcggcaacagctttctggaatctttggcggtggtgttggcgcctggctgcgtgtgctacgactcggaccgatg

SEQ ID NO: 6885 - DNA, 203 bp, Homo sapiens
ggcgcgccagtcctcacatggacatcggaacggcaatcttatggcttgccctggcaacggcatctctcggacagcgtatgtttaagcaactgaactctcttcgtaagcgcgtgaagcgcctcgaaaaacaacgtagtggaccgaaccttgtcatgatcattgggctcttggctcttggcttatgctatcgactcggaccgatg

SEQ ID NO: 6886 - DNA, 203 bp, Homo sapiens
ggcgcgccagtcctgattgtggatcaagcgttgaagggtttcatctacggtatcaccgttgtgtgccccaagtgcgacgtcgacgagctccccaaccacaagtctcaaaccaagttggcttgttggaggaagtggagatgattggcttcaggttctttcgtgaaaatgttcccgtcatcgtggtgtgccgactcggaccgatg

SEQ ID NO: 6887 - DNA, 203 bp, Homo sapiens
ggcgcgccagtcctatcgtgagggatgtcccgacccaattccaatttggcgacgttggcaccatcacgctcacgtgtggtgtcacaacagaccgcatagctggacactactatcacattcgtgagggagtcaaagctggattggtacttcgtgaggccgtggattcttggcctggcatgatcaaaatgcgactcggaccgatg

SEQ ID NO: 6888 - DNA, 203 bp, Homo sapiens
ggcgcgccagtcctggtgggttcacttccggcatggacaaaattgtcagatggggaattacaactgctaatgaaataaagatcgatggtctcatcaaccctcaaattgattggcaaacttcggtgcttagggacatacgatccatttctttcacgtgcgaaatgatctttgacaacatctcgttcagccgactcggaccgatg

SEQ ID NO: 6889 - DNA, 203 bp, Homo sapiens
ggcgcgccagtcctgaggatctgctgggaaacttgcggttctcatggtcttggttcccgagtagctggctggtcatggctttcataggtttggcgctattccttgttttcggaagagttggatcttttgttgtttttgtggtgatcatagctgtgtacgtgcggtcggtttctgctgacgtcggatgccgactcggaccgatg

SEQ ID NO: 6890 - DNA, 203 bp, Homo sapiens
ggcgcgccagtcctgtcactcatggacggcttgagggggatatgggattgttgccaactctctttgggtcatttcctgagaaaccctctgacaaggttatccggattgtggcgtcaagacctgatatccggcgtctctgtggaaaagcggtttctttccagtttcagtacacagggtttcgacgggctcgactcggaccgatg

SEQ ID NO: 6891 - DNA, 203 bp, Homo sapiens
ggcgcgccagtcctggaactatgcctgagataccaaaacctaagccaaaaatcgtggaggagccaataggagatgaatatgaccctgaagttgatgacatcctacacaactacggaaaagctcatgcctgttcggattttcgctcgtcgaactcacggacaggagttgggttcgacaggtccattctgcgactcggaccgatg

SEQ ID NO: 6892 - DNA, 203 bp, Homo sapiens
ggcgcgccagtcctaatctcctgtgtctcgcggtgtctcttcagttgatcggagcgaaaacacgggtttctacactgacgcgcctggttctcaccatcctagccatgctcatatttggaatgcccaacatattttcatctgtggggctttctgcttgggtcttgttggcagcatcatcatctttgcggcgactcggaccgatg

SEQ ID NO: 6893 - DNA, 203 bp, Homo sapiens
ggcgcgccagtcctctttatggcttgctagaactgtcagcggcagcgattctaatcggggcctacaacggaatatctcagacactcccaccggaagtcttggtattttgcctcgtgatgggttggaagacgtccctggccattctcaccgttgtgtctctgatgttcagtttgcacgcatgctacaggcgactcggaccgatg

SEQ ID NO: 6894 - DNA, 203 bp, Homo sapiens
ggcgcgccagtcctattgtcgtcctggtcggatgtgcgttaacctctgtatccttctttcttggagccttgtacgtagttgtagcttccagcacaaatctaccacttcatgtggtgcgctacatccgcataagactttcggagcagaacagatctgacgatcttcttggcattggagtgtccggcggtcgactcggaccgatg

SEQ ID NO: 6895 - DNA, 203 bp, Homo sapiens
ggcgcgccagtcctgttagtgatgactttggaaaaggatcatccggctcaccattcttcattaatggtgaccccgttgggttctatggtttcgggttttatgtggatggtatctaccgttcgatcgtggccggtggaaagcccactgatgtcaatgaacctatcggtgacgatgccaccaggcgtttccgactcggaccgatg

SEQ ID NO: 6896 - DNA, 203 bp, Homo sapiens
ggcgcgccagtcctatcacatggcatcccggaaaaggcaagacgcgccgggtcattgtcgaggaaaccaaacagaattacgcggccaacctgcgaaccatcatcctgaccccaacccgagtcgtcatggctgaggtgattgaagcattgaaaaactacgacatcaagtgtgacaaaaatttgtcgtaccgactcggaccgatg

SEQ ID NO: 6897 - DNA, 203 bp, Homo sapiens
ggcgcgccagtcctcaggccaatgcattggcagctgcgatccccggtgcggtcccactgcatcgtgcaaatttctctgccaactatgcccaggccagtagtgaagagacaaccttggtcgtgtcgacggatatctcggagatgggagccaaccttggagtcgacctcgtcattgatactcggaaagcgcgactcggaccgatg

SEQ ID NO: 6898 - DNA, 203 bp, Homo sapiens
ggcgcgccagtcctgtggtcgtgtggatcctggggtttctggtagcaatgctcaagcccacgaagatgtcttatgagtcgatgccgtctggggaccctttcaatggtggcatggtactcacagcccctagcgtcctccactacatgggagttcctctcggattctgtgtcatcatctttcttgctatgcgactcggaccgatg

SEQ ID NO: 6899 - DNA, 203 bp, Homo sapiens
ggcgcgccagtcctgaaccacaggaaactcaaagtcaagcatctactatctcggggtcattcttcacttctcgcgttaggggggagagggccacgatgttggactcgctgcaggtcttcttcttcgtaactgtgctaatgaatgaattcatcatctgggtgcaggagaactggatcgcacagatgtaccgactcggaccgatg

SEQ ID NO: 6900 - DNA, 203 bp, Homo sapiens
ggcgcgccagtcctgtgatgaaacaccccgaaatggtgagcactgtgggcggattcagacttgacagaattccgttcagagccgtgcttccatctggtttcgccatagtcaccacatccagcttgtccagctcactcgtcggtcttgcagcgtcaagcttgttcctaaccatcgcgtattatcagaaccgactcggaccgatg

SEQ ID NO: 6901 - DNA, 203 bp, Homo sapiens
ggcgcgccagtcctctggctgcccttgttgcacgattttctcggcacttggatagtatcgtcctgccccctcccgatttactcaagggaacccgagccgacccaactgccagcgtagcttctatggatgtgagtgatatggaggatcgtgtcaaacgaataaaacatgaaaaccagaccacctggtttcgactcggaccgatg

SEQ ID NO: 6902 - DNA, 203 bp, Homo sapiens
ggcgcgccagtcctgtcgatccagaacatccgtacaaaagcttcaagtactttggatcatttgtgactgatgatgttaaggttggtgggcaggcaattaacccgctcgtaagaaaaatcatgtggccttgggaagcgataacttcggttgttggattcctcatgaccgacgtctccacatactcgcaacgactcggaccgatg

SEQ ID NO: 6903 - DNA, 203 bp, Homo sapiens
ggcgcgccagtcctataggatcatggagcaagaatgtaccgtggagagatgtccaggatgccgttcaagatcaagccttctggaacctcgtcggacaagagcgacgccttcatctccaagggaaatgcgagatgtgtctttacaacactatgggaaagaaggagaagaaaccgagcctggctggtgagcgactcggaccgatg

SEQ ID NO: 6904 - DNA, 203 bp, Homo sapiens
ggcgcgccagtcctgccaagggatctcgaaccatctggtacatgtggctaggaagccgtttcctcgaatttgaggctcttggtttccttaacgctgaccactgggtgagccgggaaaacttccccggtggtgttggaggtctaggagtgaactacttcggatattacctaaaagacatcgctggtcgacgactcggaccgatg

SEQ ID NO: 6905 - DNA, 203 bp, Homo sapiens
ggcgcgccagtcctggtaaatatctctttgctgacgacatagctggatgggacacaaaaatcagctctgaggaccttgaagatgaggagaccttgttaaccgagctcacagccaatccataccataaagctctaattagagccaccatgaagctcgcttaccagaacatcgttgccatgttcccacgacgactcggaccgatg

SEQ ID NO: 6906 - DNA, 203 bp, Homo sapiens
ggcgcgccagtcctacccattcaaagtatggtagtgggacggtcatggatgtggtgggacggcgagatcaacgaggctctgggcaagtagtgacatatgccttgaacactgtgaccaatggcaaagtacaagtcgctagggtattggagagcgaaggattgctcaacgctgacatcaatgtgattgaccgactcggaccgatg

SEQ ID NO: 6907 - DNA, 203 bp, Homo sapiens
ggcgcgccagtcctaagtggcttaccaagaacatggaaaacgtcctgagtaacatggttatagcaggggatgatgtagtcgtctctactgacaacagagagttctcatcctctctcgagtaccttgagctgacgggaaagacgcggaagaacattccccaaggtgcaccctcccgaatggagtgcaatcgactcggaccgatg

SEQ ID NO: 6908 - DNA, 203 bp, Homo sapiens
ggcgcgccagtcctatgtgggccttgtacttctttcaccgacgtgatcttcgcttaggatttgtagccattacctcttctgtccccacaaactggtttcccattggacgcacctcttggtcaattcaccaacatcatgagtggatgacaacatgcgacatgctacgtgtgtggaatgacgtgtggatccgactcggaccgatg

SEQ ID NO: 6909 - DNA, 203 bp, Homo sapiens
ggcgcgccagtcctcacgacaacccatggatgaccatgaaggagcccatcaatgcctgggaagatatcccctatcttcataaaaaacaagacattgaatgtggcagtcttattggttccaaggaaagagccacctgggctcgcgacatggagaacagcgttctgagtgtccgcaagatcctggactcccgactcggaccgatg

SEQ ID NO: 6910 - DNA, 203 bp, Homo sapiens
ggcgcgccagtccttggagtttgcatctgtctctatcccaagccctcagtggtttaagacagggggtatttggaactgatttccataacccctcatgcgcgacttttagagcagggcacgaaagtgtcgggcatgacgcacccgctcccccgagtcccctgaaaatagggtgggcaatgcactcctgacgactcggaccgatg

SEQ ID NO: 6911 - DNA, 203 bp, Homo sapiens
ggcgcgccagtcctggcacgaaagtgtcgggcctgacgcacccgctcccccgagtcccctggaaacagggtgggcctcgaaaaatccaccgtaggaaggagcccaatcctacaagaaccctctggtcataggcacctgacctgggataagagtggcgccttatctcatatttagctagctggtggactcgactcggaccgatg

SEQ ID NO: 6912 - DNA, 203 bp, Homo sapiens
ggcgcgccagtcctgattgtgagcgatttgcgtgcgtgcatcccgcttcactgatctcttgttagatctttttgtaatctaaactttataaaaacatccactccctgtaatctatgcttgtgggcgtagatttttcatagtggtgtttatattcatttctgctgttaacagctttcagccagggacgtcgactcggaccgatg

SEQ ID NO: 6913 - DNA, 203 bp, Homo sapiens
ggcgcgccagtcctctggaaacagacggaatttgtcctgaaaatcatgtgatggtggattgtcgccgacttcttaaacaagagtgttgtgtgcagtctagcctaatacgtgaaattgttatgaatgcaagtccatatgatttggaggtgctacttcaagatgctttgcagtcccgtgaagcagttttgcgactcggaccgatg

SEQ ID NO: 6914 - DNA, 203 bp, Homo sapiens
ggcgcgccagtcctgttacaacccccttaggtatgtctttagaggcatgctatgtgagaggttgtaatcctaaaggatggaccatgggtttgtttcggcgtagaagtgtgtgtaacactggtcgttgcactgttaataagcatgtggcctatcagttatatatgattgatcctgcaggtgtctgtcttcgactcggaccgatg

SEQ ID NO: 6915 - DNA, 203 bp, Homo sapiens
ggcgcgccagtcctggtgcaggtcaattcgtgggttgggtcatacccttagcctttatgcctgtgcaatcccggaaatttattgttccatgggttatgtacttgcgtaagcgtggcgaaaagggtgcttacaataaagatcatggacgtggcggttttggacatgtttatgattttaaagttgaagatcgactcggaccgatg

SEQ ID NO: 6916 - DNA, 203 bp, Homo sapiens
ggcgcgccagtcctctttctccatgtaaggagcttgaaggtgtaggtgctaaagttagtgcctttttacagaaattagaggataatcccctatttttatttgatgaggctggcgaggaagttcttgctcctaaattgtattgtgcctttacagctcctgaagatgatgactttcttgaggaaagtgatcgactcggaccgatg

SEQ ID NO: 6917 - DNA, 203 bp, Homo sapiens
ggcgcgccagtcctgttgaagaagatgatgtagaaggtgaggaaactgatttaactgtcacaagtgctggacagccttgtgttgctagtgaacaggaggagtcttctgaagtcttagaggacactttggatgatggtccaagtgtggagacatctgattcacaagttgaagaagatgtagaaatgtcgcgactcggaccgatg

SEQ ID NO: 6918 - DNA, 203 bp, Homo sapiens
ggcgcgccagtcctgattttgttgatcttgaatctgtgattcaggattatgaaaatgtttgttttgagttttatactacagagccagaatttgttaaagttttgggtctgtatgtgcctaaagcaactcgcaacaattgctggttgcgatcagttttggcagtgatgcagaaattgccctgtcaatttcgactcggaccgatg

SEQ ID NO: 6919 - DNA, 203 bp, Homo sapiens
ggcgcgccagtccttggaaatgcattaaatgtgatttagctcttaagcttaaaggcttggatgctatgttcttttatggtgatgttgtttcacatatatgcaagtgtggtgagtctatggtacttattgatgttgatgtgccatttacagcccactttgctcttaaagataagttgttttgtgcatttcgactcggaccgatg

SEQ ID NO: 6920 - DNA, 203 bp, Homo sapiens
ggcgcgccagtcctgtgtttatgaggttttatattattattgcctcttttattaagctctttagcttgtttaggcatgttgcctatggttgtagtaaatctggttgtttgttttgttacaagaggaatcgtagtctacgtgttaaatgtagtactatcgttggtggcatgatacgctattacgatgttcgactcggaccgatg

SEQ ID NO: 6921 - DNA, 203 bp, Homo sapiens
ggcgcgccagtcctatggctaatggtggcactggcttttgttcaaaacatcaatggaattgcattgattgtgattcttataaaccaggtaatacttttattactgttgaggccgctcttgatctatctaaggaattgaaacggcccattcagcctacagatgttgcttatcatacggttactgatgttcgactcggaccgatg

SEQ ID NO: 6922 - DNA, 203 bp, Homo sapiens
ggcgcgccagtccttgtaataacttggtgccaacatatttgaagagtgacaacattgtggcagctgatttaggtgttctgattcaaaattctgcaaagcatgtgcagggtaatgttgctaaaatagctggtgtttcctgtatatggtctgtggatgcttttaatcagtttagttctgatttccagcatcgactcggaccgatg

SEQ ID NO: 6923 - DNA, 203 bp, Homo sapiens
ggcgcgccagtcctaaattgaagaaagcatgttgtaaaactggtttgaaactgaagcttacttataataagcagatggctaatgtctctgttttaactacaccctttagtcttaaagggggtgcagtttttagttattttgtttatgtgtgttttgtgttgagtttggtctgttttattggactgtggcgactcggaccgatg

SEQ ID NO: 6924 - DNA, 203 bp, Homo sapiens
ggcgcgccagtccttttatccgttttccagaagtgttgcgagaagggcttgtacgtatcgtgcgtactcgttctatgtcgtattgcagagttggattatgtgaggaagctgatgagggtatatgctttaattttaatggttcttgggtgcttaataatgattattatagatcattgcctgggacctttcgactcggaccgatg

SEQ ID NO: 6925 - DNA, 203 bp, Homo sapiens
ggcgcgccagtcctgataagtgttctgtagaagattttaatgtgtgggctctgtccaatggatttagccaagttaaatctgaccttgttatagatgctttagcttctatgactggtgtgtctttggaaacactgttggctgctattaagcgtcttaagaatggtttccaaggacgtcagattatgggtcgactcggaccgatg

SEQ ID NO: 6926 - DNA, 203 bp, Homo sapiens
ggcgcgccagtcctagttgctcttttgaggatgaattgacacctagcgatgtttatcaacaactcgctggtatcaagttacaatcaaaacgcactagattgtttaaaggcactgtttgttggattatggcttctacatttttgtttagttgcataattacagcatttgtgaaatggactatgtttatgcgactcggaccgatg

SEQ ID NO: 6927 - DNA, 203 bp, Homo sapiens
ggcgcgccagtcctggtacaatttcttctacagttagattgcaagctggaactgctactgaatatgcttccaactcatctatattgtctttatgtgcgttttctgtagatcctaagaaaacgtatttagattttatacaacaaggaggaacacctattgccaattgtgttaaaatgttgtgtgaccatcgactcggaccgatg

SEQ ID NO: 6928 - DNA, 203 bp, Homo sapiens
ggcgcgccagtcctgtgtcttatgttttgacacatgatgtttgtcgagtttgtggattttggcgggatggaagttgttcatgtgttagcactgacactactgttcaatcaaaagatactaattttttaaacgggttcggggtacgagtgtagatgcccgtctcgtaccctgcgccagtggtttatctacgactcggaccgatg

SEQ ID NO: 6929 - DNA, 203 bp, Homo sapiens
ggcgcgccagtcctgctatgagcgtgtaaaagattgtaagtttgtggctgaacacgatttctttacatttgatgtagaaggtagtcgtgtgccacacattgtacgcaaggatttaacaaagtatactatgttggatctttgctatgcattgcgacattttgatcgcaatgattgcatgctgctttgtgcgactcggaccgatg

SEQ ID NO: 6930 - DNA, 203 bp, Homo sapiens
ggcgcgccagtcctctaatacatgttttgggcctcttgttaggcaaatttttgtggatggtgtgccttttgttgtttcaattggctaccattataaagaacttggtattgtgatgaatatggatgtggatacacatcgttatcgcttgtctttaaaagacttgcttttatatgctgctgatccagcttcgactcggaccgatg

SEQ ID NO: 6931 - DNA, 203 bp, Homo sapiens
ggcgcgccagtcctctgtacttatgggttgggattatcctaagtgtgatcgtgctatgccaaacctactacgtattgttagtagtttggtattagcccgaaaacatgagacatgttgttcgcaaagcgataggttttatcgacttgcgaatgaatgcgcacaagttttgagtgaaattgttatgtgtgcgactcggaccgatg

SEQ ID NO: 6932 - DNA, 203 bp, Homo sapiens
ggcgcgccagtcctaaaaagcatataaatttttgaatataaatgattgcactcgtattgttccggccaaggtcagggtggagtgctatgataagtttaaaattaatgacaccactcgtaagtatgtgtttactaccataaatgcattacctgagatggtgactgatattgttgttgtagatgaagttacgactcggaccgatg

SEQ ID NO: 6933 - DNA, 203 bp, Homo sapiens
ggcgcgccagtcctgtatgcttaccaattatgagctttctgttattaatgctcgtattcgcgctaagcattatgtttatattggtgatcctgctcaattgccagcaccacgtgtgttattgagcaagggtacacttgaacctaaatattttaacactgttactaagctcatgtgttgcttagggccagcgactcggaccgatg

SEQ ID NO: 6934 - DNA, 203 bp, Homo sapiens
ggcgcgccagtcctttacccttgatgggtattgtaagctttttataactaaagaagaagctgttaaacgcgtgcgtgcctgggttggctttgatgctgaaggtgctcatgccacgcgtgatagcattgggacaaatttcccacttcaattaggattttccacaggaattgattttgttgtggaagccacgactcggaccgatg

SEQ ID NO: 6935 - DNA, 203 bp, Homo sapiens
ggcgcgccagtcctctggtttgtttgctgatagagatggttacagctttaaaaaggctgtggcgaaagctcctcctggtgaacaatttaagcacctcatccctttgatgacgagaggtcatcgctgggatgttgttagacctagaatagtacaaatgtttgcagatcatttaattgatctgtctgattcgactcggaccgatg

SEQ ID NO: 6936 - DNA, 203 bp, Homo sapiens
ggcgcgccagtcctgtgttgtgctagttacatgggcagccaactttgagctcacttgtctccgctactttgcaaaagtagggcgtgagatttcttgtaatgtatgcactaaacgtgccacagtttacaattctagaactggttactatggttgttggcgccatagtgttacatgtgattacttgtatacgactcggaccgatg

SEQ ID NO: 6937 - DNA, 203 bp, Homo sapiens
ggcgcgccagtcctttgttaagtctgttaagactcttttgtattcttttgaggcacataaggactcttttaaagacggtttgtgtatgttttggaactgtaatgtggataagtatccaccgaatgcagttgtatgtagatttgacactagagtgttgaataatttaaatcttcctggctgtaatggagcgactcggaccgatg

SEQ ID NO: 6938 - DNA, 203 bp, Homo sapiens
ggcgcgccagtcctaagattttcagtttatgctttggtgtaacgatgagaaagttatgactttctatcctcgtttgcaagctgcatctgactggaagcctggttattctatgcctgtattatataagtatttgaattctccaatggaaagagttagtctctggaattatgggaagccagttactttgccgactcggaccgatg

SEQ ID NO: 6939 - DNA, 203 bp, Homo sapiens
ggcgcgccagtcctatttgtgtaagcccaaggttgagatagatggaaatgttatgcatgccaattatttgttttggagaaattccacagtttggaacgggggtgcttatagcctgtttgatatggctaaattcccgcttaagttggctggtactgccgtaataaatttaagagcagaccagattaatgcgactcggaccgatg

SEQ ID NO: 6940 - DNA, 203 bp, Homo sapiens
ggcgcgccagtcctagattaaatttgagaatcctcacatcctaggaagatgcatagttttagatgttaaaggtgtagaagaattgcatgacgatttagttaattacattcgtgataaaggttgtgttgctgaccaatccaggaaatggattggccattgcaccatagctcaactcacggatgcagcaccgactcggaccgatg

SEQ ID NO: 6941 - DNA, 203 bp, Homo sapiens
ggcgcgccagtccttgtccattaaggaaaatgttgattttataaacagcatgcaattcaattataaaatcaccatcaacccctcatcaccggctagacttgaaatagttaagctcggtgctgaaaagaaagatggtttttatgaaaccatagttagtcactggatgggaattcgttttgaatacacatcgactcggaccgatg

SEQ ID NO: 6942 - DNA, 203 bp, Homo sapiens
ggcgcgccagtcctcacccactgataagctagctatgattatgggttattgttgtttagatgtggtacgtaaagagctagaagaaggcgatcttcccgagaatgatgatgatgcttggtttaagctatcgtaccattatgaaaacaattcttggttcttccgacatgtctacaggaaaagttttcattcgactcggaccgatg

SEQ ID NO: 6943 - DNA, 203 bp, Homo sapiens
ggcgcgccagtccttccttaccaacggcttttgctgttataggagatttaaagtgtacttcagatactagttatattaatgataaagacaccggtcctcctcctataagtactgatactgttgatgttactaatggtttgggtacttattatgttttagatcgtgtgtatttaaatactacgttgtttcgactcggaccgatg

SEQ ID NO: 6944 - DNA, 203 bp, Homo sapiens
ggcgcgccagtcctctgggtaatcatcgcaaagaactatggcatttggatacaggtgttgtttcctgtttatataagcgtaatttcacatatgatgtgaatgctgattatttgtattttcatttttatcaagaaggtggtactttttatgcatattttacagacactggtgttgttactaagtttttgcgactcggaccgatg

SEQ ID NO: 6945 - DNA, 203 bp, Homo sapiens
ggcgcgccagtcctagtgattttatgagtgagattaagtgtaaaacacaatctatagcaccacctactggtgtttatgaattaaacggttacactgttcagccaatcgcagatgtttaccgacgtaaacttaatcttcccaattgcaatatagaagcttggcttaatgataagtcggtgccctctccacgactcggaccgatg

SEQ ID NO: 6946 - DNA, 203 bp, Homo sapiens
ggcgcgccagtcctcctcgacctgcaggtgttcttactaatcatgatgtagtttatgcacaacactgtttcaaagctcctaaaaatttctgtccgtgtaaattgaatggttcgtgtgtaggtagtggtcctggtaaaaataatggtataggcacttgtcctgcaggtactaattatttaacttgtgatcgactcggaccgatg

SEQ ID NO: 6947 - DNA, 203 bp, Homo sapiens
ggcgcgccagtccttgtacaggaggtgccgaaattagggacctcatttgtgtgcaaagttataaaggcatcaaagtgttgcctccactgctctcagaaaatcagatcagtggatacactttggctgccacctctgctagtctatttcctctttggacagcagcagcaggtgtaccattttatttaaatcgactcggaccgatg

SEQ ID NO: 6948 - DNA, 203 bp, Homo sapiens
ggcgcgccagtcctgtcttaaatcagagctacatcaatctcaaggacattggtacatatgaatattatgtaaaatggccttggtatgtatggcttttaatctgccttgctggtgtagctatgcttgttttactattcttcatatgctgttgtacaggatgtgggactagttgttttaagaaatgtggtcgactcggaccgatg

SEQ ID NO: 6949 - DNA, 203 bp, Homo sapiens
ggcgcgccagtcctcaacccaagcaaactgctacctctcagcaaccatcaggagggaatgttgtaccctactattcttggttctctggaattactcagtttcaaaagggaaaggagtttgagtttgtagaaggacaaggtgtgcctattgcaccaggagtcccagctactgaagctaaggggtactggcgactcggaccgatg

SEQ ID NO: 6950 - DNA, 203 bp, Homo sapiens
ggcgcgccagtcctgacattgtcgatcgggacccaagtagcgatgaggctattccgactaggtttccgcctggcacggtactccctcagggttactatattgaaggctcaggaaggtctgctcctaattccagatctacttcgcgcacatccagcagagcctctagtgcaggatcgcgtagtagagcccgactcggaccgatg

SEQ ID NO: 6951 - DNA, 203 bp, Homo sapiens
ggcgcgccagtcctaaaccacagcgtcagcgtggtcataagaatggacaaggagaaaatgataatataagtgttgcagtgcccaaaagccgcgtgcagcaaaataagagtagagagttgactgcagaggacatcagccttcttaagaagatggatgagccctatactgaagacacctcagaaatataacgactcggaccgatg

SEQ ID NO: 6952 - DNA, 203 bp, Homo sapiens
ggcgcgccagtcctgagaatgaaccttatgtcggcatctggtggtaacccctcgcagaaaagtcgagataaggcactctctatcagaatggatgtcttgctgctataatagatagagaaggttatagcagactatagattaattagttgaaagttttgtgttgtaatgtatagtgttggagaaagtgacgactcggaccgatg

SEQ ID NO: 6953 - DNA, 203 bp, Homo sapiens
ggcgcgccagtccttgccattccttctgtagccgttcgcacctatagcgaagccgctgcacaaggttttcaggcatgccgttttgttgcttttggcttacaggattgtgtaaccggtattaatgatgatgattatgtcattgcattgactggtactaatcagctctgtgccaaaattttacctttttccgactcggaccgatg

SEQ ID NO: 6954 - DNA, 203 bp, Homo sapiens
ggcgcgccagtccttgatagaccccttaatttgcgaggttggctcattttttctaacagcaattatgttcttcaggactttgatgttgtttttggccatggtgcaggaagtgtggtttttgtggataagtacatgtgtggttttgatggtaaacctgtgttacctaaaaacatgtgggaatttagggacgactcggaccgatg

SEQ ID NO: 6955 - DNA, 203 bp, Homo sapiens
ggcgcgccagtccttgtgtctttatggcgtgttacagctgttcattctgatggaatgtttgtggcatcatcttcttatgatgcactcttgcatagaaattcattagaccctttttgctttgatgttaacactttactttctaatcaattacgtctagcttttcttggtgcttctgttacagaagatgtcgactcggaccgatg

SEQ ID NO: 6956 - DNA, 203 bp, Homo sapiens
ggcgcgccagtcctatttaaacgacttggtgattatgttcttactgaaaacgctcttgttcgtttgactactgaagttgttcgtggtgttcgtgatgctcgcataaagaaagccatgtttactaaagtagttgtaggtcctacaactgaagttaagttttctgttattgaacttgccactgttaatttcgactcggaccgatg

SEQ ID NO: 6957 - DNA, 203 bp, Homo sapiens
ggcgcgccagtcctgcgtcttgttgattgtgcacctgtagtttgccctaaaggtaagattgttgttattgctggacaagcttttttctatagtggtggtttttatcgttttatggttgatcctacaactgtattaaatgatcctgtttttactggtgatttattctacactattaagtttagtggtttcgactcggaccgatg

SEQ ID NO: 6958 - DNA, 203 bp, Homo sapiens
ggcgcgccagtccttaagcttgatggttttaaccatcagtttgttactgctagttctgctacagatgccattattgctgttgagctgttgttattggattttaaaactgcagtttttgtgtacacatgtgtggttgatggctgtagtgtcattgttagacgtgatgctacattcgctacacatgtgtgcgactcggaccgatg

SEQ ID NO: 6959 - DNA, 203 bp, Homo sapiens
ggcgcgccagtcctactgttgagtattgatgatggccatttatggaatctttttgttgaaaagtttaattttgttacagattggttaaaaactcttaagcttacacttacttctaatggtcttttaggtaattgtgccaaacgttttagacgtgttttggtaaaattgcttgatgtctataatggtttcgactcggaccgatg

SEQ ID NO: 6960 - DNA, 203 bp, Homo sapiens
ggcgcgccagtccttcttgaaactgtctgtagtgtcgcatacactgctggtgtttgcatcaaatattatgctgttaatgttccatatgtagttattagtggttttgtaagtcgtgtaattcgtagagaaaggtgtgacatgacttttccttgtgttagttgtgtcacctttttctatgaatttttagacgactcggaccgatg

SEQ ID NO: 6961 - DNA, 203 bp, Homo sapiens
ggcgcgccagtccttcatcaattagaatgtattgttgatgactctgttagagaagaggttgatataattgaacaaccttttgaagaagttgaacatgtgctctcaattaagcaacctttttctttttcttttagagatgaattgggtgttcgtgttttagatcaatctgataataattgttggattagcgactcggaccgatg

SEQ ID NO: 6962 - DNA, 203 bp, Homo sapiens
ggcgcgccagtccttgtttgttttgttgatgttgattttcatagtgtagaaatagaagctggtgaagttaaaccttttgctgtatataaaaatgttaaattttatttaggtgatatttcacaccttgtaaactgtgtttcttttgactttgttgtcaatgctgctaatgaaaatctcttgcatggaggcgactcggaccgatg

SEQ ID NO: 6963 - DNA, 203 bp, Homo sapiens
ggcgcgccagtcctacttgttgaagcttataattctattttatttgaaaatggtattccacttatgcctcttcttagttgtggtatttttggtgtaaggattgaaaattctcttaaagctttgtttagttgtgacattaataaaccattgcaagtttttgtttattcttcaaatgaagaacaagctgtcgactcggaccgatg

SEQ ID NO: 6964 - DNA, 203 bp, Homo sapiens
ggcgcgccagtcctaaaggcagcactttttgcttctttggatgtaaagccatatggttaccctaatgattttgttggtggttttagagttcttgggaccaccgacaataattgttgggttaatgcaacttgtataattttacagtatcttaagcctacttttaaatctaagggtttaaatgttctttgcgactcggaccgatg

SEQ ID NO: 6965 - DNA, 203 bp, Homo sapiens
ggcgcgccagtcctgcttaatggtattgcttatacaacattttcaggttcttttgataacggtcactatgtagtttatgatgctgctaataatgctgtctatgatggtgctcgtttattttcttcagatttgtctactttagctgttacagctattgttgtagtaggtggttgtgtaacatctaatgtcgactcggaccgatg

SEQ ID NO: 6966 - DNA, 203 bp, Homo sapiens
ggcgcgccagtccttccaacaattgttagtgagaaaatttctgttatggataaacttgatactggtgcacaaaaatttttccaatttggtgattttgttatgaataacattgttctgtttttaacttggttgcttagtatgtttagtcttttacgtacttctattatgaagcatgatattaaagttatcgactcggaccgatg

SEQ ID NO: 6967 - DNA, 203 bp, Homo sapiens
ggcgcgccagtccttgagtttttagctacatttattgtctgcaaaatcgttttatttgttagacatattattgttggctgtaataatgctgactgtgtagcttgttctaaaagtgctagacttaaacgtgtaccacttcaaactattattaatggtatgcataaatcattctatgttaatgctaatggcgactcggaccgatg

SEQ ID NO: 6968 - DNA, 203 bp, Homo sapiens
ggcgcgccagtccttgttaatgatggacgtgttgatgacggttacatttgtggtgatggtcttatagaccttcttgttaatgtactctcaatctttagttcatcttttagcgttgtggctatgtctggacatatgttgtttaattttctttttgcagcatttattacatttttgtgctttttagttaccgactcggaccgatg

SEQ ID NO: 6969 - DNA, 203 bp, Homo sapiens
ggcgcgccagtccttgttgagttttgttatttacaccaaattgagttaggtagtggtgctcatgttggttctgattttactggtagtgtttatggtaattttgatgaccaacctagtttgcaagttgagagtgccaaccttatgctatcagataatgttgttgcctttttgtatgctgctttgttgaacgactcggaccgatg

SEQ ID NO: 6970 - DNA, 203 bp, Homo sapiens
ggcgcgccagtccttggttgtaggtggtggttgtgttcaactagagttaatgttgatggttttaatgaatgggctatggctaatggttatacaagtgtttctagtgttgagtgctattctattttggcagcaaaaactggtgttagtgttgaacaattgttagcttccattcaacatcttcatgaaggcgactcggaccgatg

SEQ ID NO: 6971 - DNA, 203 bp, Homo sapiens
ggcgcgccagtccttaaagaagcacgctctgttaatagaaaatctaaagttattagtgctatgcactctttactttttggaatgttaagacgtttggatatgtctagtgttgaaactgttttgaatttagcacgtgatggtgttgtgccattgtcagttatacctgcaacttcagcttctaaactaaccgactcggaccgatg

SEQ ID NO: 6972 - DNA, 203 bp, Homo sapiens
ggcgcgccagtccttattgttagtccagatcttgaatcttattctaagattgtttgtgatggttctgttcattatgctggagttgtttggacacttaatgatgttaaagacaatgatggtagacctgttcatgttaaagagattacaaaggaaaatgttgaaactttgacatggcctcttatccttaacgactcggaccgatg

SEQ ID NO: 6973 - DNA, 203 bp, Homo sapiens
ggcgcgccagtcctacaagctggtaaacaaactgaattggctgttaattctggacttttaactgcttgtgctttttctgttgatccagcaactacttacttggaagctgttaaacatggtgcaaaacctgtaagtaattgtattaagatgttatctaatggtgctggtaatggtcaagctataacaaccgactcggaccgatg

SEQ ID NO: 6974 - DNA, 203 bp, Homo sapiens
ggcgcgccagtccttagtgtagatgctaacaccaatcaagattcttatggtggagcgtctatttgtttgtattgtcgggcccacgttcctcaccctagtatggatggttactgtaagtttaagggtaaatgtgttcaggttcctattggttgtttggatcctattaggttttgtttagaaaataatgtcgactcggaccgatg

SEQ ID NO: 6975 - DNA, 203 bp, Homo sapiens
ggcgcgccagtcctgtgtaatgtttgtggttgttggttgggacacgggtgtgcttgtgaccgtacaactattcaaagtgttgacatttcttatttaaacgagcaaggggttctagtgcagctcgactagaaccctgcaatggcacggacatcgataagtgtgttcgtgcttttgacatttataataaacgactcggaccgatg

SEQ ID NO: 6976 - DNA, 203 bp, Homo sapiens
ggcgcgccagtcctaatgtttcattcttgggtaagtgtttgaagatgaactgtgttcgttttaaaaatgctgatcttaaggatggttattttgttataaagaggtgtactaagtcggttatggaacacgagcaatccatgtataacctacttaacttttctggtgctttggctgagcatgatttctttcgactcggaccgatg

SEQ ID NO: 6977 - DNA, 203 bp, Homo sapiens
ggcgcgccagtcctacttggaaagatggcagagtcatttatggtaatgttagtagacataatcttactaaatatactatgatggacttggtctatgctatgcgtaactttgatgaacaaaattgtgatgttctaaaagaagtattagttttaactggttgttgtgacaattcttattttgatagtaagcgactcggaccgatg

SEQ ID NO: 6978 - DNA, 203 bp, Homo sapiens
ggcgcgccagtcctggttggtatgacccagttgaaaatgaagatatacatagagtttatgcatctcttggcaaaattgtagctagagctatgcttaaatgcgttgctctatgcgatgcgatggttgctaaaggtgttgttggtgttttaacattagataaccaagatcttaatggtaacttttatgatcgactcggaccgatg

SEQ ID NO: 6979 - DNA, 203 bp, Homo sapiens
ggcgcgccagtcctgttaaagattttgacttttaccgttataataagcctaccattttagatatttgtcaagctagagttacatataagatagtctctcgttattttgacatttatgaaggtggctgtattaaggcatgtgaagttgttgtaacaaatcttaataagagtgctggttggccattaaatcgactcggaccgatg

SEQ ID NO: 6980 - DNA, 203 bp, Homo sapiens
ggcgcgccagtcctagagctttgcctaacatgatacgtatgatttcagccatggtgttgggctctaagcatgttaattgttgtactgcaacagataggttttataggcttggtaatgagttggcacaagttttaacagaagttgtttattctaatggtggtttttattttaagccaggtggtacgactcgactcggaccgatg

SEQ ID NO: 6981 - DNA, 203 bp, Homo sapiens
ggcgcgccagtccttcattcattgatgattattatggttatcttaggaaacatttttcaatgatgattctctctgatgacggtgttgtctgttataacaaggattatgctgagttaggttatatagcagacattagtgcttttaaagccactttgtattaccagaataatgtctttatgagtacttctcgactcggaccgatg

SEQ ID NO: 6982 - DNA, 203 bp, Homo sapiens
ggcgcgccagtcctcttattggtaaacaaaagataactacaatacagggtcctcctggtagtggtaagtcacattgttccattggacttggattgtactacccaggtgcgcgtattgtttttgttgcttgtgcccatgctgctgttgattccttatgtgcaaaagctatgactgtttatagcattgatcgactcggaccgatg

SEQ ID NO: 6983 - DNA, 203 bp, Homo sapiens
ggcgcgccagtcctattaaccagcgtttatcatataaacatattgtttatgttggtgatccacaacaacttcctgcacctagagtaatgattactaaaggtgttatggagcctgttgattataacgttgttactcaacgtatgtgtgctataggccctgatgtttttcttcataaatgttatagatgtcgactcggaccgatg

SEQ ID NO: 6984 - DNA, 203 bp, Homo sapiens
ggcgcgccagtcctaaccaccacacattctgtaacattcatagaaacgagcatgatgcctctggtgatgctgttatgacacgttgtttggcagtacatgattgttttgtcaaaaatgttgattggactgtaacgtacccctttattgcaaatgagaaatttatcaatggctgtgggcgtaatgtccagcgactcggaccgatg

SEQ ID NO: 6985 - DNA, 203 bp, Homo sapiens
ggcgcgccagtcctggacatgttgttcgtgcagccttgaaattgtataaacctagtgttattcatgacattggtaatcctaaaggtgtacgttgtgctgttactgatgccaaatggtactgttatgacaagcaacctgttaatagtaatgtcaagttgttggattatgattatgcaacccatggtcaacgactcggaccgatg

SEQ ID NO: 6986 - DNA, 203 bp, Homo sapiens
ggcgcgccagtccttttgttaaattaaaacctatgccctttttttactttgatgacagtgattgtgatgttgtgcaagaacaagttaattatgtaccccttcgcgctagtagttgtgttactcgttgtaatataggtggtgctgtttgttcaaaacatgcaaatttgtatcaaaaatatgttgaggcacgactcggaccgatg

SEQ ID NO: 6987 - DNA, 203 bp, Homo sapiens
ggcgcgccagtcctcttattggtattaattatttaggtgactttattcaaggtccttttatagctggtaacactgttcatgctaattatatattttggcgtaattctactattatgtctttgtcatacaattcagttttagatttaagtaagtttgaatgtaaacataaagccactgttgttgttacacgactcggaccgatg

SEQ ID NO: 6988 - DNA, 203 bp, Homo sapiens
ggcgcgccagtcctgtaatgctaatctctctatgttacaattaggtgttcctgacaattcttcaactattgttacgggtttattgccaactcattggttttgtgctaatcagagtacatctgtttactcagccaatggtttcttttatattgatgttggtaatcaccgtagtgcttttgcgctccatacgactcggaccgatg

SEQ ID NO: 6989 - DNA, 203 bp, Homo sapiens
ggcgcgccagtcctccacacataatggccgtgtagttaactacactgtttgtgatgattgtaatggttatactgataacatattttctgttcaacaggatggccgcattcctaatggtttcccttttaataattggtttttgttaactaatggttccacactagtggacggggtctctagactttatccgactcggaccgatg

SEQ ID NO: 6990 - DNA, 203 bp, Homo sapiens
ggcgcgccagtccttaccacccactgtgcgtgaaattgttgttgctagaactggccagttttatattaatggttttaagtatttcgatttgggtttcatagaagctgtcaattttaatgtcacgactgctagcgccacagatttttggacggttgcatttgctacttttgttgatgttttggttaatgcgactcggaccgatg

SEQ ID NO: 6991 - DNA, 203 bp, Homo sapiens
ggcgcgccagtcctctgaaggtaattctattactggtgtaccttatcctgtctctggtattcgtgagtttagtaatttagttttaaataattgtaccaaatataatatttatgattatgttggtactggaattatacgttcttcaaaccagtcacttgctggtggtattacatatgtttctaactctgcgactcggaccgatg

SEQ ID NO: 6992 - DNA, 203 bp, Homo sapiens
ggcgcgccagtcctttgactataagtcttgtactaaaggtctttctattgctgaccttgcttgtgctcagtactacaatggcataatggttttgccaggtgttgctgatgctgaacgtatggccatgtacacaggttctcttataggtggcatggtgctcggaggtcttacatcagcagccgccataccgactcggaccgatg

SEQ ID NO: 6993 - DNA, 203 bp, Homo sapiens
ggcgcgccagtcctttactttgctttattcaaacctcttactgctagaggtcgtgttgcttgttttgttttaaaactattgacactatttgtctatgtgcctttattggttctttttggtatgtatcttgacagttttataattttttctacgctgttgtttcgattcatacatgttggctattatgccgactcggaccgatg

SEQ ID NO: 6994 - DNA, 203 bp, Homo sapiens
ggcgcgccagtccttgacctttatgttgctattagaggttcttgtgaaaagaacctacaacttatgcgtaaggttgacttgtataatggtgctgtcatttacatttttgccgaagagcctgttgttggtatagtctactcttctcaactatacgaagatgttccttcgattaattgatgacaatggtacgactcggaccgatg

SEQ ID NO: 6995 - DNA, 203 bp, Homo sapiens
ggcgcgccagtcctgggtcagttgcctaaatatgtaatagttgctacgcctagtaccacaattgtttgtgaccgtgttggtcgctctgttaatgaaacaagccagactggttgggcattctacgtccgtgctaaacatggtgatttttctggtgttgcctctcaggagggtgttttgtcagaaagagacgactcggaccgatg

SEQ ID NO: 6996 - DNA, 203 bp, Homo sapiens
ggcgcgccagtcctgaagttgcttcatttaatctaaactaaacaaaatggctagtgtaaattgggccgatgacagagctgctaggaagaaatttcctcctccttcattttacatgcctcttttggttagttctgataaggcaccatatagggtcattcccaggaatcttgtccctattggtaagggtacgactcggaccgatg

SEQ ID NO: 6997 - DNA, 203 bp, Homo sapiens
ggcgcgccagtcctaacccagggctgataagccttctcagttgaagaaacctcgttggaagcgtgttcctaccagagaggaaaatgttattcagtgctttggtcctcgtgattttaatcacaatatgggggattcagatcttgttcagaatggtgttgatgccaaaggttttccacagcttgctgaatcgactcggaccgatg

SEQ ID NO: 6998 - DNA, 203 bp, Homo sapiens
ggcgcgccagtcctcgtttagcgcatgataagggtttagtcttacacacaatggtaggccagtgatagtaaagtgtaagtaatttgctatcatattaacatgtctagaggaaagtcagaactttttctgtttgtgttgttggagtacttaaagatcgcatacgcgcgccaacaatggaagagccaacacgactcggaccgatg

SEQ ID NO: 6999 - DNA, 203 bp, Homo sapiens
ggcgcgccagtcctttcgaagatgaagctcctcttgctagcaaatttattttagacaattatggtctagtcaaagaaatgagatcaaagtttgcaaacaaacctctgaataaagaagtagttgcacacatgttagaaaaacaattcaatccggaaagtagattcttgcctgttttcggagctataaggcgactcggaccgatg

SEQ ID NO: 7000 - DNA, 203 bp, Homo sapiens
ggcgcgccagtcctaaggtcttaccctttacttatttcgccccaaaacagggaatgtttgaaggaaggcttttctttagcaacgatagctttgttgagcctggagtaaataacaatgtattttcttggagtaaggctgacagttctaaaatatattgtcatggaatagcgataagggtacctttagttcgactcggaccgatg

SEQ ID NO: 7001 - DNA, 203 bp, Homo sapiens
ggcgcgccagtcctctcaatgccaggatgaacagtgatcagtttgcagttaatataactggagacaatagtaaatggaatgaatgccaacaacctgaggcttatttagcacttttggcttacatcaccaaagactcctctgatttaatgaaagacttatgcagtgttgctccagtgcttttctgtaatcgactcggaccgatg

SEQ ID NO: 7002 - DNA, 203 bp, Homo sapiens
ggcgcgccagtcctataaaaaccatagaaaataaagatggattattaattgctgatggtgggaaactgatgaacaacattagcacccttcatattcctgaggaagtactgaagtttgaaaaaatggatgaacaatatagaaatagggtattcaaccccaaaaatccctttactaactttgacaaaactcgactcggaccgatg

SEQ ID NO: 7003 - DNA, 203 bp, Homo sapiens
ggcgcgccagtcctattgatatatttagagcacatggcccaataagggttgaagaaaatgaagcagtagtttcaactcatagcttcagaactagagcaaacagaaccctattgaatacagatatgagagcaatgatggcagaagagaaaagatatcaaatggtttgcgacatgtttaaaagcgtgtttcgactcggaccgatg

SEQ ID NO: 7004 - DNA, 203 bp, Homo sapiens
ggcgcgccagtcctgatagatttgtgctcattgaaggaagaaaaagaggaactgcagtgtctttacaaaatgagctatgtaaaagttatgatcttgaaccactaccttttctttgtgacatttttgacagggaggaaaaacaattcgttgaaattggaataacaagaaaagcagatgatagctattttcgactcggaccgatg

SEQ ID NO: 7005 - DNA, 203 bp, Homo sapiens
ggcgcgccagtcctaatattaaattaccaataaaacattatgagcagaataaatttcgacaaatacgtctaccaaagggaccaatggcaccctatacccacaagttcttaatggaagaagcatggatgtttacaaaaattagtgatccagaaagatcaagagctggtgaaattctcattgatttcttccgactcggaccgatg

SEQ ID NO: 7006 - DNA, 203 bp, Homo sapiens
ggcgcgccagtcctactgtatttgaagcaggacacacaacagttagaatgaagaaaggagagtcagttattggaagagaagtccctctttatttatactgtaggacaactgccctttccaaaatcaagaatgactggctatcaaaggctagaagatgtttcatcacaactatggacacagtggaaacccgactcggaccgatg

SEQ ID NO: 7007 - DNA, 203 bp, Homo sapiens
ggcgcgccagtcctactccagggtgcatgttgatccaaaagcaaaagccatacattggagaagctgatgatcaccatggagatcaagaaatgagggagttgctgtcaggactggactatgaagctagatgcatatcacaatcagggtgggtgaatgaaaccagcccttttacggaagaatacctccttcgactcggaccgatg

SEQ ID NO: 7008 - DNA, 203 bp, Homo sapiens
ggcgcgccagtcctccaggttgctgggtaattgacaataacatttgtgatcaaagttgtcaaaactttattttcaagttcaacgaaactgcacctgttccaaccattccccctcttgacacaaaaattgatctgcaatcagatcctttttactggggaagcagcttgggcttagcaataactgctgctcgactcggaccgatg

SEQ ID NO: 7009 - DNA, 203 bp, Homo sapiens
ggcgcgccagtcctattttcaagttcaacgaaactgcacctgttccaaccattccccctcttgacacaaaaattgatctgcaatcagatcctttttactggggaagcagcttgggcttagcaataactgctgctatttcattggcagctttggtgatctctgggatcgccatctgcagaactaaatgacgactcggaccgatg

SEQ ID NO: 7010 - DNA, 203 bp, Homo sapiens
ggcgcgccagtccttgccttggtgtatgtggttggctgccagacttactctgaaagatgagtttgccaatttctgtgcatatgcaggaagaagagcctttgaagtcttcaatattgcaatggagaaaattggaatttgttcctttcaagggacaataatgaacgatgatgaaattgaatcaatagaggcgactcggaccgatg

SEQ ID NO: 7011 - DNA, 203 bp, Homo sapiens
ggcgcgccagtcctgggcagagtttgctcaaagatttgctcttcaggcaaatacttcaagagaaggcgctcaaatcagcaattcagcagtttttgcagtggaaaggaagataaccacagatgtccaaagagttgaagagctactaaataaagttcaagctcatgaagatgaaccattacaaacactttcgactcggaccgatg

SEQ ID NO: 7012 - DNA, 203 bp, Homo sapiens
ggcgcgccagtcctgcctctttgggattagggataattactatgttgtatttattagtaaaaatcataattgaacttgtcaatggttttgtgctcggcagatgggagagatggtgtggagatataaagaccacaattatgcctgaaattgactcgatggaaaaagatattgccctttctagggagagacgactcggaccgatg

SEQ ID NO: 7013 - DNA, 203 bp, Homo sapiens
ggcgcgccagtcctttcccatcgctttggagcattactcacaatgttttcgctaccatcagccacaatgctcaatcatgtcaaattagctgaccagtcaccagaagctgatatcgaaagggtagagatcgatggctttgaggagggatcattccgcttaatccccaatgcacgttcaggtatgagccgcgactcggaccgatg

SEQ ID NO: 7014 - DNA, 203 bp, Homo sapiens
ggcgcgccagtcctgactgcgccagaccaacctgctgcttctattgagaaacgcctgcaaaaatatcgtcagcaaggcaggatcaacccgagatatctcctgcaaccggaggctcgacgaataatccagaatgtaatccggaagggaatggtggtcagacatttcctcacctttgaactgcagcttgccgactcggaccgatg

SEQ ID NO: 7015 - DNA, 203 bp, Homo sapiens
ggcgcgccagtcctcctcatggcattataccagacccttggtgagcaggcccgatatttggccctattggagtcaccacatttgatggattttgctgcagcaaactacccactgctatatagctatgctatgggaataggctatgtgttagatgtcaacatgaggaactacgctttctccagatcatacgactcggaccgatg

SEQ ID NO: 7016 - DNA, 203 bp, Homo sapiens
ggcgcgccagtcctcaacccgttctcatctgtcactgggacaactcaggtgcccgctgcagcaacaggtgacacactcgagagttacatggcagcggatcgactgaggcagagatatgctgatgcaggcacccatgatgatgagatgccaccattggaagaggaggaagaggacgacacatctgcaggcgactcggaccgatg

SEQ ID NO: 7017 - DNA, 203 bp, Homo sapiens
ggcgcgccagtcctaaatctgatgacacggttcatcgaggaacccagagagaatcctatcgcaaccagttcccccatcgattttaagaggggcagggataccggcgggttccatagaagggagtactcaatcggatgggtgggagatgaagtcaaggtcactgagtggtgcaatccatcctgttctcccgactcggaccgatg

SEQ ID NO: 7018 - DNA, 203 bp, Homo sapiens
ggcgcgccagtcctaatcaccgctgcagcaaggcgatttgaatgcacttgtcaccagtgtccagtcacttgctctgaatgtgaacgagatacttaatacagtgagaaatttggactctcggatgaatcaactggagacaaaagtagatcgcattctctcatctcagtctctaatccagaccatcaagacgactcggaccgatg

SEQ ID NO: 7019 - DNA, 203 bp, Homo sapiens
ggcgcgccagtcctatgacatagttggacttaaagcagggatggctactttagaaggaatgattacaactgtgaaaatcatggacccgggagttcccagtaatgttactgtggaagatgtacgcaagacactaagtaaccatgctgttgttgtgccagaatcattcaatgatagtttcttgactcaatcgactcggaccgatg

SEQ ID NO: 7020 - DNA, 203 bp, Homo sapiens
ggcgcgccagtccttcaaccaggcttccagtgaggctcagctaattgacctcaagaaagcaatcatccgcagtgcaatttgatcaagaaacacccaattacactacactggtatgacactgtactaaccctgagggttttagaaaaaacgattaacgataaataagcccgaacactacacactacctgcgactcggaccgatg

SEQ ID NO: 7021 - DNA, 203 bp, Homo sapiens
ggcgcgccagtcctaggcagccatgccatccatcagcattcccgcagaccccaccaatccacgtcaatcaataaaagcgttcccaattgtgatcaacagtgatgggggtgagaaaggccgcttggttaaacaactacgcacaacctacttgaatgacctagatactcatgagccactggtgacattcacgactcggaccgatg

SEQ ID NO: 7022 - DNA, 203 bp, Homo sapiens
ggcgcgccagtcctttaggaagacatccagcaaagcggaagagatggtctttgaaattgttaagtatccgagaatatttcggggtcatacattaatccagaaaggactagtctgtgtctccgcagaaaaatttgttaagtcaccagggaaaatacaatctggaatggactatctcttcattccgacatcgactcggaccgatg

SEQ ID NO: 7023 - DNA, 203 bp, Homo sapiens
ggcgcgccagtcctaaatcatgggtactataattcaatttctggtggtctcctgtctattggcaggagcaggcagccttgatccagcagccctcatgcaaatcggtgtcattccaacaaatgtccggcaacttatgtattatactgaggcctcatcagcattcattgttgtgaagttaatgcctacaacgactcggaccgatg

SEQ ID NO: 7024 - DNA, 203 bp, Homo sapiens
ggcgcgccagtccttggccaccatttctgcattcattaacaatcaagaagtcatggcccaattaccaacacgtgttatggtgactggcagcttgatccaagcctatcccgcatcgcaatgcaccattacacccaacactgtgtactgtaggtataatgatgcccaagtactctcagatgatactatggcgactcggaccgatg

SEQ ID NO: 7025 - DNA, 203 bp, Homo sapiens
ggcgcgccagtcctcttgcctccaaggtaacttgacaagatgcaccttctctccagtggttgggagctttctcactcgattcgtgctgttcgatggaatagtttatgcaaattgcaggtcgatgttgtgcaagtgcatgcaacctgctgctgtgatcctacagccgagttcatcccctgtaactgtcacgactcggaccgatg

SEQ ID NO: 7026 - DNA, 203 bp, Homo sapiens
ggcgcgccagtcctgaatggagaattttgtttatcataaataagcattccaccactcacgatctgatctcagtgagaaaaatcaacctgcaactcttggaacaagataagacagtcatccattagtaatttttaagaaaaaaacgataggaccgaacctagtattgaaagaaccgtctcggtcaatctcgactcggaccgatg

SEQ ID NO: 7027 - DNA, 203 bp, Homo sapiens
ggcgcgccagtcctcatcaatcagttctatttttcaattgctgagggtcgcaatctgacacttggcccacttcttaatatgcctagtttcattccaactgccacgacaccagagggctgcaccaggatcccatcattctcgctcactaagacacactggtgttatacacacaatgttatcctgaatggcgactcggaccgatg

SEQ ID NO: 7028 - DNA, 203 bp, Homo sapiens
ggcgcgccagtcctttctactcaaccagagagggatgactacttttctgccgctcctccagaacaacgaattattataatgtactataatgatacaatcgtggagcgcataattaatccacccggggtactagatgtatgggcaacattgaacccaggaacaggaagcggggtatattatttaggttgcgactcggaccgatg

SEQ ID NO: 7029 - DNA, 203 bp, Homo sapiens
ggcgcgccagtccttcagtctgggatcctggcatgtcctcttcgacaggatctaaccaatgagtgtttagttctgcccttttctaatgatcaggtgcttatgggtgctgaagggagattatacatgtatggtgactcggtgtattactatcaaagaagcaatagttggtggcctatgaccatgctgtacgactcggaccgatg

SEQ ID NO: 7030 - DNA, 203 bp, Homo sapiens
ggcgcgccagtccttaccagtacatttggatcagaagcaaccttcactggttcttatctcaacacagcaactcagcgtatcaatccgacgatgtatatcgcgaacaacacacagatcataagctcacagcaatttggatcaagcggtcaagaagcagcatatggccacacaacctgttttagggacaccgactcggaccgatg

SEQ ID NO: 7031 - DNA, 203 bp, Homo sapiens
ggcgcgccagtcctaggctctgttatggtatactgtatctatattattgaattgtcctcatctctcttaggacaatttcagattgtcccatttatccgtcaggtgacactatcctaaaggcagaagccttcaggtctgacccagccaatcaaagcattataccagaccatggaatgcataccaaacatcgactcggaccgatg

SEQ ID NO: 7032 - DNA, 203 bp, Homo sapiens
ggcgcgccagtccttgaccgcagggatattgatcttaagacagttgtggcagcatggcatgactcagactggaaaagaataagtgatttttggattatgatcaaattccagatgagacaattaattgttaggcaaacagatcataatgattctgatttaatcacgtatatcgaaaatagagaaggcatcgactcggaccgatg

SEQ ID NO: 7033 - DNA, 203 bp, Homo sapiens
ggcgcgccagtcctaatcatcataacccctgaactggtagcattatttaacactgagaatcatacactaacatacatgacctttgaaattgtactgatggtttcagatatgtacgaaggtcgtcacaacattttatcactatgcacagttagcacttacctgaatcctctgaagaaaagaataacatacgactcggaccgatg

SEQ ID NO: 7034 - DNA, 203 bp, Homo sapiens
ggcgcgccagtcctaactaatagtttcacccaggatgaattaagaactgtgacaactaatttgatatccccattccaagatctgaccccagatcttacggctgaattgctctgtataatgaggctttggggacaccccatgctcactgccagtcaagctgcaggaaaggtacgcgagtctatgtgtgccgactcggaccgatg

SEQ ID NO: 7035 - DNA, 203 bp, Homo sapiens
ggcgcgccagtcctattcacacttaagcattggaaggaagtctctcttataaaattcaagaaatgttttgatgcagacgcaggtgaggaactcagtatatttatgaaagataaggcaattagtgccccaaaacaagactggatgagtgtgtttagaagaagcctaatcaaacagcgccatcagcatcacgactcggaccgatg

SEQ ID NO: 7036 - DNA, 203 bp, Homo sapiens
ggcgcgccagtcctattaattaaatcaggatgtatggattactggatcctttataacttattagggagaaaaccgggaaacggctcatgggctactttagcagctgacccgtactcaatcaatatagagtatcaataccctccaactacagctcttaagaggcacacccaacaagctctgatggaactcgactcggaccgatg

SEQ ID NO: 7037 - DNA, 203 bp, Homo sapiens
ggcgcgccagtccttagatcgataatgaggaaatcactagaaattaagcccttatccaataggaagcttaatgaaatactggattacaacatcaattacctagcttacaatttggcattactcaagaatgctattgaacctccgacttatttgaaggcaatgacacttgaaacatgtagcatcgacatcgactcggaccgatg

SEQ ID NO: 7038 - DNA, 203 bp, Homo sapiens
ggcgcgccagtccttggtatcgagataggaggggatccccgtgataatcctcctatccgtgtaccgtacattggctccaggactgatgagaggagggtagcctcaatggcatacatcaggggtgcctcgagtagcttaaaagcagttcttagactggcgggagtgtacatctgggcattcggagataccgactcggaccgatg

SEQ ID NO: 7039 - DNA, 203 bp, Homo sapiens
ggcgcgccagtccttctggagaattggatagatgcactggatttgtctcacactagagttaacatcacacttgaacagctgcaatccctcaccccacttccaacctctgccaatctaacccatcggttggatgatggcacaactaccctaaagtttactcctgcgagctcttacaccttttcaagtttcgactcggaccgatg

SEQ ID NO: 7040 - DNA, 203 bp, Homo sapiens
ggcgcgccagtccttatgtattgtgggtgggaactactattggaactatcctatcaaatgtattatctgagggtagttgggtggagtaatatagtggattattcttacatgatcttgagaagaatcccgggtgcagcattaaacaatctggcatctacattaagtcatccaaaacttttccgacgagccgactcggaccgatg

SEQ ID NO: 7041 - DNA, 203 bp, Homo sapiens
ggcgcgccagtccttatcaacctagatatagttgcccccttaaatgctcctcattttgcatctctggactacatcaagatgagtgtggatgcaatactctggggctgtaaaagagtcatcaatgtgctctccaatggaggggacttagaattagttgtgacatctgaagatagccttattctcagtgacgactcggaccgatg

SEQ ID NO: 7042 - DNA, 203 bp, Homo sapiens
ggcgcgccagtcctgttgtcatcaactgcttggtataagggtataagctgctgcaggtaccttgagcgattaaagctaccacaaggtgatcatttatatattgcagaaggtagtggtgccagtatgacaatcatagaatacctattcccaggaagaaagatatattacaattctttatttagtagtggcgactcggaccgatg

SEQ ID NO: 7043 - DNA, 203 bp, Homo sapiens
ggcgcgccagtcctattcatcatcaatcgagtcggcccaaggacttgcagtttagtacatgtagatttggaatcaagtgcaagcttaaatcaacaatgcctgtcaaagccgataattaatgctatcatcactgctacaactgttttgtgccctcatggggtgcttattctgaaatatagttggttgcccgactcggaccgatg

SEQ ID NO: 7044 - DNA, 203 bp, Homo sapiens
ggcgcgccagtccttgcacggaatctcatcgatatcgagccagtcgcaactttcatagaatttgaacaattgatctgcacaatgttgacaacccacttgaaggaaataattgatataacaaggtctggaacccaggattatgaaagtttattactcactccttacaatttaggtcttcttggtaaaatcgactcggaccgatg

SEQ ID NO: 7045 - DNA, 203 bp, Homo sapiens
ggcgcgccagtccttgttgcaaaggtatgtgggtcgtattgctttgccttttcctaacctggctcctcctacaattctaacctgcttgataagtgtgattacctgagtaatagactaatttcgtcctggtaattagcattttctagtaaaaccaatactatctcaagtcctaagagaaggtgagaagacgactcggaccgatg

SEQ ID NO: 7046 - DNA, 203 bp, Homo sapiens
ggcgcgccagtccttgaagaggagacaacagaagctaatgctggtcagtttttatcctttgccagtttgtttctacccaaacttgtcgttggggagaaagcgtgtctggaaaaagtacaaaggcagattcaggtccatgcagaacaagggctcattcaatatccaacttcctggcaatcagttggacacgactcggaccgatg

SEQ ID NO: 7047 - DNA, 203 bp, Homo sapiens
ggcgcgccagtcctcatgatggtgatcttccgtttgatgagaacaaactttttaatcaagttcctactaatacatcaggggatgcacatggtcgcaggccatgatgcgaatgacacagtaatatctaattctgttgcccaagcaaggttctctggtcttctgattgtaaagactgttctggaccacatcgactcggaccgatg

SEQ ID NO: 7048 - DNA, 203 bp, Homo sapiens
ggcgcgccagtcctttatccacaactctcagccattgctttgggtgttgcaactgcccacgggagcacgctggctggtgttaatgtaggggagcaatatcagcaactgcgtgaggctgctactgaagctgaaaagcaactccaacaatatgctgaaacacgtgagttggacaaccttgggcttgatgacgactcggaccgatg

SEQ ID NO: 7049 - DNA, 203 bp, Homo sapiens
ggcgcgccagtcctatttcccgggccgatctatgatgaaacccaccccaacccttctgatgataatcctgatgattcacgtgatacaactatcccaggtggtgttgttgacccgtatgatgatgagagtaataattatcctgactacgaggattcggctgaaggcaccacaggagatcttgatctcttcgactcggaccgatg

SEQ ID NO: 7050 - DNA, 203 bp, Homo sapiens
ggcgcgccagtcctcaatttggacgacgacgatgacgacagccaaccaggaccaccagacagggggcagagcaaggaaagagcggctcggacacatggcctccaagatccgaccttggacggagcgaaaaaggtgccggagttgaccccaggttcccaccaaccaggcaacctccacatcaccaagcccgactcggaccgatg

SEQ ID NO: 7051 - DNA, 203 bp, Homo sapiens
ggcgcgccagtcctgggttcaaacaccaaccaaccacaaggcaatatgtcatctactctccagagtatgacccctatacaggaagaatcagagcccgatgatcagaaagatgatgatgacgagagtctcacatcccttgactctgaaggtgacgaagatgttgagagcgtatcaggggagaacaaccccgactcggaccgatg

SEQ ID NO: 7052 - DNA, 203 bp, Homo sapiens
ggcgcgccagtccttccatttgaggcaatcaattattatcacctaatgagtgatgagcccattgcttttagcactgaaagtggcaaggaatatatcttcccagattctcttgaagaagcctacccgccttggttgagtgagaaggaggccttagagaaagaaaatcgttatctggtcattgatggccacgactcggaccgatg

SEQ ID NO: 7053 - DNA, 203 bp, Homo sapiens
ggcgcgccagtccttggtgcaggttatctgcaaaattggtaaggataataatatcctagacataattcatgcagaattccaagcaagcttggctgagggagactccccccagtgtgcattaatccagataacaaaacggatccctgctttccaagatgcctctcctccaattgtgcatatcaagtctccgactcggaccgatg

SEQ ID NO: 7054 - DNA, 203 bp, Homo sapiens
ggcgcgccagtcctgtcaaggaactctcactgatcaagcctgaatccaagatagaaccagcccaaagggcctccccagagtctcttacaagcttagccaatcaattaacatgcataagcgatccatacttcgcccaatcagtgtccgatgttcaccccttcaagcctccttcctagcaaattgacctacgactcggaccgatg

SEQ ID NO: 7055 - DNA, 203 bp, Homo sapiens
ggcgcgccagtcctatctttttaccataatcttgttctcagtaccatttgataagggtacacttgccaatacgcccccatcctaagggtctcgcaatggggggtcttagcctactccaattgcccagggacaaatttcggaaaagctctttctttgtttgggtcatcatcttattccaaaaggcctttcgactcggaccgatg

SEQ ID NO: 7056 - DNA, 203 bp, Homo sapiens
ggcgcgccagtccttctggtgttcctcccaaggtggtcagctatgaagcgggagaatgggctgaaaattgctacaatcttgaaataaagaagccggacgggagcgaatgcttacccccaccgccagatggtgtcagaggctttccaaggtgccgctatgttcacaaagcccaaggaaccgggccctgccgactcggaccgatg

SEQ ID NO: 7057 - DNA, 203 bp, Homo sapiens
ggcgcgccagtcctcatcgtcgagaattacaaagggaagaatctccgaccgggccaccaggaagtattcggacctggttccaaagaattcccctgggatggttccattgcacataccagaaggggaaacaacattgccgtctcagaattcgacagaaggtcgaagagtaggtgtgaacactcaggagacgactcggaccgatg

SEQ ID NO: 7058 - DNA, 203 bp, Homo sapiens
ggcgcgccagtcctccattacagagacagctgcaacaattataggcactaacggcaaccatatgcagatctccaccatcgggataagaccgagctccagccaaatcccgagttcctcaccgaccacggcaccaagccctgaggctcagacccccacaacccacacatcaggtccatcagtgatggccacgactcggaccgatg

SEQ ID NO: 7059 - DNA, 203 bp, Homo sapiens
ggcgcgccagtcctccgaggaaccaacaacaccaccgggaagctcccccggcccaacaacagaagcacccactctcaccaccccagaaaatataacaacagcggttaaaactgtcctgccacaggagtccacaagcaacggtctaataacttcaacagtaacagggattcttgggagtcttgggcttccgactcggaccgatg

SEQ ID NO: 7060 - DNA, 203 bp, Homo sapiens
ggcgcgccagtcctgaaaacgcagcagaagacaaactaacaccaaagccacgggtaagtgcaatcccaacttacactactggactgcacaagaacaacataatgctgctgggattgcctggatcccgtactttggaccgggtgcggaaggcatatacactgaaggcctgatgcataaccaaaatgcctcgactcggaccgatg

SEQ ID NO: 7061 - DNA, 203 bp, Homo sapiens
ggcgcgccagtccttactctttctcaatactatataagttccttcccaagaataatattgatgaagattaagaaaaagtgacattgtgcccacttttgtaatcttcatccacctacacattcatattcaggaatctttgaattaaccctcacacttgcttaggaaagagcctatcctctacaagaatccgactcggaccgatg

SEQ ID NO: 7062 - DNA, 203 bp, Homo sapiens
ggcgcgccagtcctacgcttacttgcccccccaagcgttaatgaagggctccctcctgcaccaggggaatatacttggtcagaagatagtacaacttagcctgtagggaggacaagtaaaacaagatgcccttatcctctatagatggtatttttagagagggggacaggataggaataaagataatgcgactcggaccgatg

SEQ ID NO: 7063 - DNA, 203 bp, Homo sapiens
ggcgcgccagtccttagtatagtcttaggtatagggtagtcctacacgtactatattatacagtctaaacttgtaaaattaaactacaagaacatgatgaaaattaatgagaaggttccaagattgacttcaatccaaacaccttgctctgccaattttcatctccttaagatatatgattttgttcccgactcggaccgatg

SEQ ID NO: 7064 - DNA, 203 bp, Homo sapiens
ggcgcgccagtcctacaagcctaagattccattagagataaccagaatggctaaagccacaggccggtacaacttggtaacaccaaaacgggagctagagcaaggagttgtgtttagcgacctatgcaacttcctagtgactccaactgtgcaaggatggaaggtttactgggctggacttgagtttgcgactcggaccgatg

SEQ ID NO: 7065 - DNA, 203 bp, Homo sapiens
ggcgcgccagtcctctggggaggcaatccttgccaccataggactttttcaattcctctattttatgatggctacccaacatacacaatatcctgatgcaagattgtcttccccaattgtcttagaccaatgtgacctagtgacaagagcatgtggactttactctgagtattcgctgaaccctaaaccgactcggaccgatg

SEQ ID NO: 7066 - DNA, 203 bp, Homo sapiens
ggcgcgccagtcctatgccacagttcgtggaagtagttttgtcacagacctggaaaaatacaatctggccttcaggtatgaattcacagctcccttcatcaaatattgcaaccaatgctatggggttcgcaatgtctttgattggatgcacttcctaattccgcaatgttacatgcatgttagtgattcgactcggaccgatg

SEQ ID NO: 7067 - DNA, 203 bp, Homo sapiens
ggcgcgccagtcctatattttaccatgccgtgttgcagctgcctttcatacatatttctctgttcggatcttacaacatcatcaccttggtttccataagggttcagaccttggacaattggcaatcaataaacctcttgatttcgggaccattgcactatccttagcagttcctcaggtattgggtgcgactcggaccgatg

SEQ ID NO: 7068 - DNA, 203 bp, Homo sapiens
ggcgcgccagtcctcaggcgggttaaatgtccctggatcacaggatttaacatctttccttcgtcagattgtcagaaggagtatcacactttcggcaaggaacaagttaatcaacacgttatttcacgcttctgcagatcttgaagacgaattagtatgtaaatggttactttcttcaacgcccgtgacgactcggaccgatg

SEQ ID NO: 7069 - DNA, 203 bp, Homo sapiens
ggcgcgccagtcctggtttagttacctagaccattgtgacccagctttaatggaagcaattcaaccaattaagtgtactgttgatattgctcaaattcttagagaatactcctgggctcatatccttgatggtagacagttaataggggcaacactgccatgtatacctgagcagttccaaaccacatcgactcggaccgatg

SEQ ID NO: 7070 - DNA, 203 bp, Homo sapiens
ggcgcgccagtcctggttaaaaccttacgagcaatgtgtggaatgttcatccacaaacaattctagtccatatgtatcagttgcattaaaaaggaacgtggttagtgcttggcctgatgcatctagattggggtggacgattggtgatgggattccctacataggctcaagaactgaggacaaaatagcgactcggaccgatg

SEQ ID NO: 7071 - DNA, 203 bp, Homo sapiens
ggcgcgccagtcctatgaactgatttatgattcagatccactaagaggaggtctcaactgcaacttatcgattgacagtcctttgatgaagggcccacgtttaaatattattgaggatgacttaatacggttgccacatttatccggctgggaattagcaaaaacagtcttgcaatcaataatctctgcgactcggaccgatg

SEQ ID NO: 7072 - DNA, 203 bp, Homo sapiens
ggcgcgccagtcctaaacccaggcaaactgtctccatgtcgtacaatgtgctcttcaacagcaagtacaaagagggtcatattggctaagtcatcttaccaaatacaccacaagtagattgcacaatagttatattgcatttggttttccttcattagagaaggtcctatatcataggtataaccttgcgactcggaccgatg

SEQ ID NO: 7073 - DNA, 203 bp, Homo sapiens
ggcgcgccagtcctgtttattgactcttccaatacacagagttggaagcaccgattcaaggtttctaagacgccctatcgattatgttgataatgtaaataatagcttttcctgtctattatgacttaaataatcatatctataacgaccatcacagctaagtcgttgccctagttcatatattaaatcgactcggaccgatg

SEQ ID NO: 7074 - DNA, 203 bp, Homo sapiens
ggcgcgccagtcctctagtgggagtgaagagggtagtcatgggcttgttggatggaagaggaccagtgcgattcgtgctggccttgatgacattcttcaagttcaccgcgcttgccccgacgaaggccttgctaggccgttggaagcgcatcaacaagaccacggcaatgaaacacctgactagcttccgactcggaccgatg

SEQ ID NO: 7075 - DNA, 203 bp, Homo sapiens
ggcgcgccagtcctaaaaaggaattaggaacaatgatcaacgtggttaacaatcggggcacaaaaaagaagagaggcaacaatggaccaggactagtgatgatcataacactcatgacggttgtttcaatggtttcctctttaaagctttccaacttccaggggaaagtcatgatgaccatcaacgcgcgactcggaccgatg

SEQ ID NO: 7076 - DNA, 203 bp, Homo sapiens
ggcgcgccagtcctgggtatgcttttgtagctgtcctcttgggctggatgctgggaagcaacaatggacaaagggtcgttttcgtcgttctcttacttcttgtggcgcctgcttatagcttcaactgccttggtatgagcaacagagacttccttgagggagtctctggtgctacctgggttgacgtgcgactcggaccgatg

SEQ ID NO: 7077 - DNA, 203 bp, Homo sapiens
ggcgcgccagtcctgttttggaaggtgacagctgcataaccatcatggccaaggacaagccgaccattgacattaagatgatggaaactgaagccacgaacctggctgaagtgagaagctactgctatctagccactgtctcagatgtttcaactgtctccaactgtccaacaactggggaggcccaccgactcggaccgatg

SEQ ID NO: 7078 - DNA, 203 bp, Homo sapiens
ggcgcgccagtcctaccgaggcatactacatcatgtcagtgggcaccaaacacttccttgtccatagagaatggtttaatgacttggccctcccatggacttcaccagctagctcaaattggagaaatagagagatactactagagttcgaagagccccatgccacaaagcaatcagttgtggcgcttcgactcggaccgatg

SEQ ID NO: 7079 - DNA, 203 bp, Homo sapiens
ggcgcgccagtcctggttcccaggaaggtgctttgcaccaggccttggcaggagctgttccagtgtctttctcgggcagtgtcaagctcacatctggtcatctcaagtgtcgagtcaagatggaaaagttgacactaaaaggcaccacctacggcatgtgcacggaaaagttttcttttgcaaaaaatcgactcggaccgatg

SEQ ID NO: 7080 - DNA, 203 bp, Homo sapiens
ggcgcgccagtcctccggctgacacgggtcacggcactgtggtccttgaactgcagtacacgggatctgacggaccttgcaaaatcccaatttccattgtggcatcactttccgatctcacccccattggtagaatggttacagcaaacccttatgtggcttcatccgaagccaacgcgaaagtgttgcgactcggaccgatg

SEQ ID NO: 7081 - DNA, 203 bp, Homo sapiens
ggcgcgccagtcctgtcggagggattttcaattctgtaggaaaggcggtacatcaggtctttggaggagccttcagaactctcttcggtggcatgtcctggatcacccagggtctaatgggagctctgcttctatggatgggggtgaatgcgagagatcgatccatcgcactggtgatgttagccacgcgactcggaccgatg

SEQ ID NO: 7082 - DNA, 203 bp, Homo sapiens
ggcgcgccagtcctatcgagcaagcccacgcgaaaggaatatgtggattgaggtccgtctcacgtctggaacacgtgatgtgggagaacatcagagatgaactcaacaccctcctcagagagaatgcagtagatctaagtgtcgtggttgagaagccaaaaggaatgtacaaatcagcaccacagagacgactcggaccgatg

SEQ ID NO: 7083 - DNA, 203 bp, Homo sapiens
ggcgcgccagtcctatcatgtccaccagggtttggctgaaagtcagagaacacaacactactgactgcgacagctcaataattgggacggctgttaaaggagacatagctgtgcacagtgacctctcctactggattgaaagccacaagaacacgacatggaggctcgagagggctgtctttggagagcgactcggaccgatg

SEQ ID NO: 7084 - DNA, 203 bp, Homo sapiens
ggcgcgccagtcctagacccatgaaacatgatgagacgacgctggtaaaatccagcgtcagtgcccatcggagtgacatgattgatccttttcagttgggccttctggtgatgtttctggccacccaggaggtcctgaggaagaggtggacggccagattgactgttccggctattgtgggagctctacgactcggaccgatg

SEQ ID NO: 7085 - DNA, 203 bp, Homo sapiens
ggcgcgccagtcctacgaaccaagagaacatcctgctggctctgggggcagcattctttcagatggcggccaccgatttgaacttttctctcccaggaattctcaatgccactgccacagcttggatgctcctgagggctgccacccagccatccacttcagccatcgtcatgcctttgctttgcctgcgactcggaccgatg

SEQ ID NO: 7086 - DNA, 203 bp, Homo sapiens
ggcgcgccagtcctctggctcctggcatgagactgctctacctggacacgtatagaatcactctcatcatcatcggcatctgcagcctgataggggagcgccgtagggcggccgcaaagaagaaaggggcggtactgctagggttagcactaacatcaacagggcagttctctgcatcagttatggcgcgactcggaccgatg

SEQ ID NO: 7087 - DNA, 203 bp, Homo sapiens
ggcgcgccagtcctgggacctaccaggctggagtgggcgtcatgtatgaaggagttcttcacaccctgtggcacaccacaagaggggcagctatcagaagtggtgaaggaaggctcactccctactggggtagtgtgaaagaagacaggatcacctatggtgggccatggaagtttgacaggaagtggcgactcggaccgatg

SEQ ID NO: 7088 - DNA, 203 bp, Homo sapiens
ggcgcgccagtcctaatggtctcgatgatgttcagctcatcatagtggctcccggaaaggcagccataaacatccaaaccaaaccaggcatcttcaaaacgccacagggggaaataggagcagtcagcctggactatcctgaagggacctcaggctccccaatactggacaagaatggtgacatcgtgcgactcggaccgatg

SEQ ID NO: 7089 - DNA, 203 bp, Homo sapiens
ggcgcgccagtcctggcttgtacgggaatggagtcatcttgggcaacggctcgtatgtcagtgccatcgtgcaaggcgaaagagaagaagaacccgttcctgaagcgtacaacgcagacatgttaagaaagaagcagctgacagtgctggacctgcatccaggagcgggaaagaccaggaggatactccgactcggaccgatg

SEQ ID NO: 7090 - DNA, 203 bp, Homo sapiens
ggcgcgccagtcctccccagatcatcaaagatgccatccagcgccgccttcgtacagctgtgctggctccaacccgtgtggtggctgcagaaatggctgaggccctcaagggccttcgggtccgatacctgaccccagcggtcaacagagagcatagtggcacagagatagtggatgttatgtgtcatcgactcggaccgatg

SEQ ID NO: 7091 - DNA, 203 bp, Homo sapiens
ggcgcgccagtcctgccactctaacccacagactcatgtcacctctaagagctccaaactacaacctctttgtgatggatgaggctcacttcactgacccggcgagcatagcagcacgaggctacattgctacaaaagttgagttgggtgaagcggcagcaatattcatgactgcgactccccctggccgactcggaccgatg

SEQ ID NO: 7092 - DNA, 203 bp, Homo sapiens
ggcgcgccagtcctggcgaagggagagtgatcttgagcaacccctcaccaatcactagtgctagtgctgcccagaggagagggagagtaggtagaaatcctagtcagataggtgatgagtaccactatggaggaggcacaagcgaagatgacacgatcgcagctcattggactgaagcaaagatcatgcgactcggaccgatg

SEQ ID NO: 7093 - DNA, 203 bp, Homo sapiens
ggcgcgccagtcctaatggtatacagtacaccgacaggaagtggtgttttgatggaccaaggtcaaacatcattctggaagacaacaatgaagtcgaaattgtcacccgcacaggtgaacgcaagatgctgaagccacgctggttggatgccagggtctacgctgaccatcagtcgctcaagtggttccgactcggaccgatg

SEQ ID NO: 7094 - DNA, 203 bp, Homo sapiens
ggcgcgccagtcctaaggactttgcggctggtaagcgatcagcagtgggattccttgaagtcctggggagaatgcctgagcacttcgcaggcaagaccagagaggcttttgataccatgtatctggtggcgacagctgagaagggaggaaaagcccaccgcatggcccttgaagagttgccggacgctcgactcggaccgatg

SEQ ID NO: 7095 - DNA, 203 bp, Homo sapiens
ggcgcgccagtcctcttgaaaccataacactcattgtggctttggccgtgatgacagcaggagttttcttgctcctcgttcagaggagaggcataggtaagctggggcttggcggtatggtgctaggcctagccactttcttcttgtggatggctgacgtctcaggcaccaagatcgcaggaaccttacgactcggaccgatg

SEQ ID NO: 7096 - DNA, 203 bp, Homo sapiens
ggcgcgccagtccttccagcacacgtcaaccacaaagtgctctgccgctaccctccatgaacgctttggcattggatttgcgaccagcaacagcgtgggccttatacggagggagcacagtggttctcacgcccttgatcaaacatcttgtaacatcagaatacatcacaacatctctggcttcaatacgactcggaccgatg

SEQ ID NO: 7097 - DNA, 203 bp, Homo sapiens
ggcgcgccagtcctgctgaagctttgagggcggctcaacggagaacagcggccggaatcatgaaaaatgctgtggtagatggtttggtggctacggatgttcctgaactggagagaaccacccccctcatgcaaaagaaggtaggccagattttactgattggagtcagcgcggcggcattgttagtccgactcggaccgatg

SEQ ID NO: 7098 - DNA, 203 bp, Homo sapiens
ggcgcgccagtcctaacccgtgtgttacaactgttcgggaagccggcatcctcatatcagcggcactcctgactctctgggacaacggagccattgcagtatggaattccaccaccgcgaccggactttgtcacgtcatccgtggcaattggttggctggagcctctatagcttggactctgataaagcgactcggaccgatg

SEQ ID NO: 7099 - DNA, 203 bp, Homo sapiens
ggcgcgccagtcctcctggacatgaggaaccgatgcttatgcaaagctatggctggaaccttgtcactatgaagagcggagtggacgtgtattataaaccatctgagccgtgcgacacgcttttctgtgacattggagaatcatcttctagtgctgaggtggaagaacaacgcaccctgaggattttgcgactcggaccgatg

SEQ ID NO: 7100 - DNA, 203 bp, Homo sapiens
ggcgcgccagtcctaggattcaaagattgaaagaggagtatgcagccacatggcaccatgacaaggaccacccatatcggacctggacctaccacggaagttatgaagtgaaaccgaccggttcagcaagctccttggtcaacggagttgtccgcctaatgagcaagccctgggatgcaattctcaaccgactcggaccgatg

SEQ ID NO: 7101 - DNA, 203 bp, Homo sapiens
ggcgcgccagtcctgagctgacctacaaacacaaggtggtgaaagttatgcgacctggcacagatgggaagaccgtcatggatgtgatttcccgagaagatcagagaggaagtggacaggttgtgacctatgctctcaacacattcaccaacattgccgtccagcttattagactgatggaagctgaacgactcggaccgatg

SEQ ID NO: 7102 - DNA, 203 bp, Homo sapiens
ggcgcgccagtcctgcaacgtgggctgaaaacatctacgcagccattaaccaggtgagagccattattggccaggaaaaatacagggattacatgctttcacttagaagatatgaagaagttaatgtccaggaggacagggttttgtaaataagtgtttagggttttgcaatttaattaaatatgcaacgactcggaccgatg

SEQ ID NO: 7103 - DNA, 203 bp, Homo sapiens
ggcgcgccagtcctctgggttaacaaagctgaccgctgatgatgggaaagcccctcagaaccgtttcggagagggaccctgcctattggaagcgtccagcccgtgtcaggccgcaaagcgccacttcgccaaggagtgcagcctgtacggccccaggaggactgggttaccaaagccgaaaggccccccgactcggaccgatg

SEQ ID NO: 7104 - DNA, 203 bp, Homo sapiens
ggcgcgccagtcctacggcccaagcgaacagacggtgatgcgaactgttcgtggaaggactagaggttagaggagaccccgtggaacttaggtgcggcccaagccgtttccgaagctgtaggaacggtggaaggactagaggttagaggagaccccgcatcataagcatcaaaaaaacagcatattgacgactcggaccgatg

SEQ ID NO: 7105 - DNA, 203 bp, Homo sapiens
ggcgcgccagtcctgtgaagggaccgtgtgttctagacatggtagttgtgtaggtacaagaggacttcatttgaatatcctcgatcccggacctaaattaccttgtggatttccggaggaatttaggaaaccacctccttcgggaggctagtaggagcttacatgactctcggattgggaagtccgagcgactcggaccgatg

SEQ ID NO: 7106 - DNA, 203 bp, Homo sapiens
ggcgcgccagtcctcctttaagagaaataagattgcatgtgctgaaaagcaaggtcaagtgcaatccaatcaaactggcaattctccaaatgtaacaccagttaatgccactaatgggtcacaagtaacaactattaattactatggggcacaatatgcacaggcatataatccatccagtcagacaacgactcggaccgatg

SEQ ID NO: 7107 - DNA, 203 bp, Homo sapiens
ggcgcgccagtcctggtacataacagcctggctacagacaaaattggttcatccagctggtgttccaaccaccagtcccattgtagtgtatgcttcagctagtaataacttcaccttcaagtgcccaatagatagtgcatacttccagggacttggtgaccaaataacttcacaagtggaagggttgacgactcggaccgatg

SEQ ID NO: 7108 - DNA, 203 bp, Homo sapiens
ggcgcgccagtcctcaactagagtcacaaaggcaacattttctgcacaagacactgatgtagagtttttcttctcaaggtatatgcttataggatctgttggaagtcgacaaggaacccaggactttgccaaatttgacatgtcttttgaggccattaagggagctagtagggcaattagaacaaaatcgactcggaccgatg

SEQ ID NO: 7109 - DNA, 203 bp, Homo sapiens
ggcgcgccagtcctttcagatgtttacatatatgaggtttgacttggatgtggttctggagccgctagaagagattccttatcaggtgatgtactgccccactgggtcagttgtaccagcaaactctatagataattggaacacaacttgtaatgcagtgattactcaacgacctggtaagaatgtttcgactcggaccgatg

SEQ ID NO: 7110 - DNA, 203 bp, Homo sapiens
ggcgcgccagtcctagttcaagtacagagagcaatcagttttggatttggctgagaaaatacttgagtcaaagagagtgctccttgagatgcagaagacagacaataggatttacctcactttggtgaagtatgctgaaaaggccagtaaattcattcagaattcaaggaaaagaccatttgaaccaacgactcggaccgatg

SEQ ID NO: 7111 - DNA, 203 bp, Homo sapiens
ggcgcgccagtcctgagagaagaagtttaccactcctgatttactgattggcaagttgactggttacagaagggagaaaattaatacaaatgacatggttgatgcactgtttcaagggccgaggaaagttgtaagtctgaaacctactctcaagttcctggacgatgaagaactcaaaactccagtgacgactcggaccgatg

SEQ ID NO: 7112 - DNA, 203 bp, Homo sapiens
ggcgcgccagtcctagctcatgccagagtgcattgaagatctcattagaagtgtgcatgaccaacgcatcattgactggtgcgaagaccagggatacatttttgaaccacacatgcagcactttatagtagagagagagagtaaatggctgaagacagtaataaagactacagtcacttctttggctgcgactcggaccgatg

SEQ ID NO: 7113 - DNA, 203 bp, Homo sapiens
ggcgcgccagtcctttttgggagctgtgtgtggattgatctatgcagcttggagactctggccaacatctgagcaaggagcatacactggaaatcagagagctgttttgaaaagacctgagttaagaacagtgcaagtgcaggggcctggaactcatccagatcttcagtatatccaggcattgctcacgactcggaccgatg

SEQ ID NO: 7114 - DNA, 203 bp, Homo sapiens
ggcgcgccagtcctctgagagacccgccaggaaaagtgtcaatgtcagatcgacaacttcacttcaaccatcggtttggcatgacattgttccaggtgagaaggaacctgcagttttgagtaagtttgacaagagatgtgaggtggactttgagaaggctctattctccaaatacgagcagaatgtggcgactcggaccgatg

SEQ ID NO: 7115 - DNA, 203 bp, Homo sapiens
ggcgcgccagtcctccatcttcaattcaatcattaataacatcattgtgagaactctggtcttggacacctacaaaggtatcgatctcgaccaactccgtattctggcctacggtgatgacctactggtgtcctatccatttccacttgacccagaggcattagcaagggctggaaaggtgtatggtccgactcggaccgatg

SEQ ID NO: 7116 - DNA, 203 bp, Homo sapiens
ggcgcgccagtcctttaaaatgacacctgcagacaagagtgaacactttgatgggccaaagaaaatctgggaggtgaccttcctgaagaggggctttaagcctgattctcggtacccatttctcattcatccagtgtacccaatggatcaggtgtacgagtctctcagatggactaggaaaccttctgcgactcggaccgatg

SEQ ID NO: 7117 - DNA, 203 bp, Homo sapiens
ggcgcgccagtcctgcaggagggtcaagtgtattggtgtggctagccaaagggaatagcccctcctaatgaggttgttgggcgcggcgtcccaactcaaacaaaacgcgtcggataatttcttaacacataatcactttaatcattagttgttaggattttaatcattagtttagatatagtttgttacgactcggaccgatg

SEQ ID NO: 7118 - DNA, 203 bp, Homo sapiens
ggcgcgccagtcctgtgaaacctcgcgtcattctggaggccacaacatccggtgatgcacaaacgcagtatagatctaaaccaaaaattgaagcattcacgtcggcggatgtaataaccattactaaacccaaagtgatggttgaggcagtgtcatctggcgatagtataactcaaaacaaacctaaacgactcggaccgatg

SEQ ID NO: 7119 - DNA, 203 bp, Homo sapiens
ggcgcgccagtcctaagtttcacccaattgagattaagcaagaatacaccaaagctgactttccatatgctccaggagacatgtttggtcccataggtaagtgcccccaccagttatttgagcccggtaaaacagatattcgacctagtgtaatttatggtaaggtaaaacctcctattacgaaaccccgactcggaccgatg

SEQ ID NO: 7120 - DNA, 203 bp, Homo sapiens
ggcgcgccagtcctattaaaggaaatgatatttcagaatatatttctagtataaatcgacaatcatccccaggttacccatggattttagatcgtaaaccaggctttccaggtaagactcaatggtttgggaacgatgaagattacaaaattgatcctgacgtgatgcaaaaagtacatgaaagaattcgactcggaccgatg

SEQ ID NO: 7121 - DNA, 203 bp, Homo sapiens
ggcgcgccagtcctgaaaacgcaaaacaaggaatacggaccccaactttttgggttgacacgctcaaggatgagcgacgacctattgagaaagttgatgcactcaaaacacgcgtcttttcgaacggacccatggattttaatttggctttccgcaaatattttctaggatttatagcgcatttaatgcgactcggaccgatg

SEQ ID NO: 7122 - DNA, 203 bp, Homo sapiens
ggcgcgccagtcctgacggctattggcatttacgaaatatggaatactttttataaaacgtttctcttctggttaccagcaacataggaaattgtcgttgaactacatgttgtaaggctttagagaaataagggagtgtcctatttaggatgaggtgctccggtggcagccccaccaaaacctctagccgactcggaccgatg

SEQ ID NO: 7123 - DNA, 203 bp, Homo sapiens
ggcgcgccagtcctaccagacaagaactcacagttttccatgatgttgaacaacctcgcgtcgctcttccaattgctccgcaaacgactagctctcttgctaagcttgattctacagcgacaattgtggattttctttctagaactgttgtcctcgatcaattcgagcttgttcaaggtgaatcaaaccgactcggaccgatg

SEQ ID NO: 7124 - DNA, 203 bp, Homo sapiens
ggcgcgccagtcctgtggccggaagattttggctaacatattccccatatgaacataaagtagataaggcaagacgccagcaatataatagtagagctggagtgacagcatatcctggaatagaaatggatgttcaaatcaatgattcagcagaaatggttatcccatttgcttcctacaaagaagctcgactcggaccgatg

SEQ ID NO: 7125 - DNA, 203 bp, Homo sapiens
ggcgcgccagtcctgtccccggcaagtattattcccatgtaaaagcgatagataatagtgtagctttagctttgagtaatgagaacgagcttctcccacttagcgacatctttccctcagcggtagatgagatggacttggcatatgtgtgtgctaatcctggagtgaaggaagtcattacgcggtcgcgactcggaccgatg

SEQ ID NO: 7126 - DNA, 203 bp, Homo sapiens
ggcgcgccagtcctcctaaggcggattggcataattatgttgatctttccgcttacgataaagtggataccgcaaattcttacaaatatattttagatttaacaaatgattcagaaattactattagagtgccatttattagcgataggttagctttaagtacaattggtgctaatagttatggtgagcgactcggaccgatg

SEQ ID NO: 7127 - DNA, 203 bp, Homo sapiens
ggcgcgccagtcctttatgtgagactagaaatgccacaatgcagatcaacatttccaatgaagcatcaggaaacagtatcgatattttccaggataataatgcaggtgtgagtccaaatgcagtaatgggtaaaattgcgggtgaacgtctagttaacttgcgaccactactgcgctgcttccgatctcgactcggaccgatg

SEQ ID NO: 7128 - DNA, 203 bp, Homo sapiens
ggcgcgccagtcctacgatttgttatgcgcctgcagactatagctactatttgtggtattaaatatgttgcacaacctacagaagatgtagtagatggagatgtagttatacgtgaacctgtacatttattatctgctgatgcaatagttttaaagcttcctagtttgatgaaagttatgactcatatcgactcggaccgatg

SEQ ID NO: 7129 - DNA, 203 bp, Homo sapiens
ggcgcgccagtcctttcagtcaagtcttatgatgatttggtttattcaggtgtagtaggttgtaaatctattgttaaagaaactgctcttattactcatgcactttacttagattatgttcaatgtaagtgtggtaatcttgaacaaaatcatattcttggcgttaataattcttggtgtaggcaactcgactcggaccgatg

SEQ ID NO: 7130 - DNA, 203 bp, Homo sapiens
ggcgcgccagtcctagtagaagatgatgttattgagaatgtcaaatcttctttatcatcttatgagtattgtcaaccacctaaatctgtagaaaaaatttgtattatagataatatgtacatgggtaagtgtggtgataaatttttccctattgtcatgaatgataaaaatatttgtcttttagatcacgactcggaccgatg

SEQ ID NO: 7131 - DNA, 203 bp, Homo sapiens
ggcgcgccagtccttgattttgttgctgttgtttgtgatgctatagagaatgctttaaactcttgtaaagagcatccagtggttggttatcaagttcgtgcatttttaaataaacttaatgagaatgttgtttatttatttgatgaggctggtgatgaagcaatggcctctcgtatgtattgtactttcgactcggaccgatg

SEQ ID NO: 7132 - DNA, 203 bp, Homo sapiens
ggcgcgccagtcctcaatgacgatgaagatgttgttactggtgacaatgacgatgaagatgttgttactggtgacaatgacgatgaagatgttgttactggtgacaatgacgatgaagatgttgttactggtgacaatgacgatgaagatgttgttactggtgacaataacgatgaagagattgttaccgactcggaccgatg

SEQ ID NO: 7133 - DNA, 203 bp, Homo sapiens
ggcgcgccagtccttggtgacaatgatgaccaaattgttgttactggtgatgatgtagatgatattgaaagtatttatgactttgatacttataaagctcttttagtttttaatgatgtctataatgatgctttgtttgttagttatggttctagtgttgaaacagaaacatattttaaagttaatggcgactcggaccgatg

SEQ ID NO: 7134 - DNA, 203 bp, Homo sapiens
ggcgcgccagtccttggacataatatgactctaatagcagcggacttaccttgtacattacatttttcattatttgatgacaatttttgtgctttttgcacccctaaaaaaatttttattgctgcatgtgctgtggatgtaaacgtttgtcattctgtagctgttataggtgatgaacaaatagatggcgactcggaccgatg

SEQ ID NO: 7135 - DNA, 203 bp, Homo sapiens
ggcgcgccagtccttattgttaatcctgctaatgggcatatgctccatggtggtggagttgcaaaagctatagctgtagctgcaggtaaaaaattttctaaagaaactgctgctatggttaaatctaaaggtgtttgccaagtaggagattgttatgtttctaccggtggtaaattatgtaaaacaatcgactcggaccgatg

SEQ ID NO: 7136 - DNA, 203 bp, Homo sapiens
ggcgcgccagtcctttttgtttcaaattcttctgttatacaagaagttttattgcttcgtcatgatatacaattgaataatgacgttcgtgattatttgttgtctaagatgactagtcttcctaaagattggcgtcttatcaataaatttgatgttattaacggtgttaaaactgttaagtattttgacgactcggaccgatg

SEQ ID NO: 7137 - DNA, 203 bp, Homo sapiens
ggcgcgccagtcctcagaccacataggttagttgctcttgttttagctaaaggtcattttaaatttgatgaaccatcagatgctactgattttattcgtgttgttttgaaacaagctgatttatcaggtgcaatttgtgaattagaacttatttgtgattgtggtattaaacaagaaagtcgtgttggcgactcggaccgatg

SEQ ID NO: 7138 - DNA, 203 bp, Homo sapiens
ggcgcgccagtccttgttgatgctgttatgcattttggtacattagcaaagactgatctttttaatggttataagattggctgtaattgtgcaggtagaattgtccattgtactaaattgaatgtaccatttttgatttgttctaatactcctctgagtaaggatttacctgatgatgttgttgcagccgactcggaccgatg

SEQ ID NO: 7139 - DNA, 203 bp, Homo sapiens
ggcgcgccagtccttaacatgtttatgggtgtaggtgtaggccattatacacatttgaaatgtggttcaccttaccaacattatgatgcttgtagtgttaaaaaatatacaggtgttagtggttgtttaactgactgcttgtatcttaaaaatttaacccagacttttacatctatgttgactaattacgactcggaccgatg

SEQ ID NO: 7140 - DNA, 203 bp, Homo sapiens
ggcgcgccagtcctttatcttcctaatattagtgtttttcctatttttgtgggaagaattgttatgtggataaaggctacttttggtttggttacaatttgtgatttttattctaagttaggtgtaggttttacaagtcatttttgtaatggtagttttatatgtgaattgtgtcattctggttttgacgactcggaccgatg

SEQ ID NO: 7141 - DNA, 203 bp, Homo sapiens
ggcgcgccagtccttatgttggatacatatgcagctatagattttgttcagtatgaagtagatagacgtgttttatttgattatgttagtttagtcaaattaattgttgaactcgttattggttattcattatacacagtatggttttatccattattttgtcttattggtttacaattatttactaccgactcggaccgatg

SEQ ID NO: 7142 - DNA, 203 bp, Homo sapiens
ggcgcgccagtcctgagacatggctttcatgttttacattttttaacttatgcatttgctagtgatagtgttcagtgctatacaccacatattcagatttcttataatgatttttatgctagtggttgtgttttatcatctttgtgtactatgtttaaaagaggtgatggtacaccacatccttattgcgactcggaccgatg

SEQ ID NO: 7143 - DNA, 203 bp, Homo sapiens
ggcgcgccagtcctatacgccgaagagggtatatgttttaattttaatagttcctgggttttgaataatgattattatagaagtatgcctggaactttttgtggtagagatctttttgatttgttttatcaattttttagtagtttaattcgtcctatagatttcttttctcttactgctagttctatcgactcggaccgatg

SEQ ID NO: 7144 - DNA, 203 bp, Homo sapiens
ggcgcgccagtccttacttatggtagtatgactttgaatggtttatggttagatgacaaagtttattgtcctcgtcatgttatatgttcatcctctaatatgaacgaacctgattattctgccttattgtgtagagttactctaggtgattttactataatgtctggtcggatgagtttaacagttgtcgactcggaccgatg

SEQ ID NO: 7145 - DNA, 203 bp, Homo sapiens
ggcgcgccagtccttaaagaaacaatttattggattttgatatctacatttttgtttagttgtataatttctgcatttgttaaatggactatatttatgtatattaatacacatatgattggtgttacattatgtgtactttgttttgttagttttatgatgttactagttaaacataagcatttttacgactcggaccgatg

SEQ ID NO: 7146 - DNA, 203 bp, Homo sapiens
ggcgcgccagtccttttgactatgtatataattcctgtactctgtaccttgttttatgtaaattatttagttgtttataaggaaggttttagaggttttacttatgtctggctctcatattttgttcctgctgtgaattttacttatgtttatgaagtattttatggttgtattttatgtgtttttgccgactcggaccgatg

SEQ ID NO: 7147 - DNA, 203 bp, Homo sapiens
ggcgcgccagtcctacagttagaaaaagcatgtaatatagctaagtctgtgtatgaacgtgataaagctgtagctcgcaaacttgaacgtatggcagacctagcacttactaacatgtataaagaggctcggattaatgataagaagagtaaagttgtttccgctttgcagacaatgctttttagcatcgactcggaccgatg

SEQ ID NO: 7148 - DNA, 203 bp, Homo sapiens
ggcgcgccagtcctggttcgtaaattggataatcaggctttaaattctattctggataatgctgttaaaggttgtgtacctttgagtgctattccagcattggctgctaatactttaactatagtaataccagataaacaagtttttgataaagttgttgataatgtttatgttacatatgctggtagcgactcggaccgatg

SEQ ID NO: 7149 - DNA, 203 bp, Homo sapiens
ggcgcgccagtcctggtgtagttatgaacttagatgttgacacacaccgttatcgtttgtctcttaaagatttacttctttatgcagcagatcctgctatgcacgttgcatctgctagtgctctgcttgatttacgaacttgttgttttagtgtagctgccattacaagtggtataaaatttcaaactcgactcggaccgatg

SEQ ID NO: 7150 - DNA, 203 bp, Homo sapiens
ggcgcgccagtcctttgagtgatgatggtgttgtctgttataactctgattatgctagtaagggttatatagctaatataagtgtttttcaacaagttttgtactatcagaataatgtctttatgtctgaatctaaatgttgggttgaaaatgatattactaatggtcctcatgaattttgttcccaacgactcggaccgatg

SEQ ID NO: 7151 - DNA, 203 bp, Homo sapiens
ggcgcgccagtcctcagagtgtaggtgcatgcgttgtttgttcatcacaaacttctttgcgttgtggcagttgtatacgtaagcctttgttatgttgtaaatgttgttatgaccatgttatggcaactaatcataaatatgttttgagtgtctcaccttacgtttgtaatgcacctaactgtgatgtgcgactcggaccgatg

SEQ ID NO: 7152 - DNA, 203 bp, Homo sapiens
ggcgcgccagtcctgaagttgatgattatgttctggcaaatgagtgtattgaacgtttaaagttatttgctgcagaaactcaaaaggcaactgaagaggcttttaaacaaagctatgcttctgctaccattcaagagattgttagtgatagagaagttattttgtgttgggagacaggtaaagttaaacgactcggaccgatg

SEQ ID NO: 7153 - DNA, 203 bp, Homo sapiens
ggcgcgccagtcctcttgctataggtctagctgtttattactacacagcacgtgtagtttatactgctgctagtcatgctgctgtagatgcattgtgtgaaaaagcttataagtttttaaatattaacgattgtacacgtattattcctgctaaagttcgtgtagattgttatgataagtttaaaattcgactcggaccgatg

SEQ ID NO: 7154 - DNA, 203 bp, Homo sapiens
ggcgcgccagtccttctatgcctgttttgtataagtatttgaatgttccattagagagagtctctttatggaattatggtaaacctattaatttgcctacaggctgtatgatgaatgttgctaagtacactcaattatgtcagtatttgaatactacaacattagctgttcctgttaatatgcgtgttcgactcggaccgatg

SEQ ID NO: 7155 - DNA, 203 bp, Homo sapiens
ggcgcgccagtccttaatggtagtaatgatgtatggcttcttaacaaggtaagattttatcgtgccttatattctaatatggccttttttcgttatcttacttttgttgatattccttataatgtttctctttctaagtttaattcttgtaaaagtgatattttatcacttaacaatcctatttttatcgactcggaccgatg

SEQ ID NO: 7156 - DNA, 203 bp, Homo sapiens
ggcgcgccagtcctactttgcttcgtttagttcatactgattctttttcttgtaataattttgatgaatctaagatatatggtagttgttttaagagtattgttttagataaatttgccatacccaactccagacgatctgatttgcagttgggcagttctggttttctgcaatcttctaattataaacgactcggaccgatg

SEQ ID NO: 7157 - DNA, 203 bp, Homo sapiens
ggcgcgccagtccttgtccttgtgctaaaccttcttttgcttcaagttgcaagagtcataaaccaccttctgcttcctgtcctattggtactaattatcgttcttgtgagagtactactgtactcgaccacactgactggtgtaggtgttcttgtttacctgatcctataactgcttatgaccctaggcgactcggaccgatg

SEQ ID NO: 7158 - DNA, 203 bp, Homo sapiens
ggcgcgccagtccttcttgttctcaaaaaaagtctctggttggtgttggtgaacattgtgcagggttcggtgttgatgaagaaaagtgtggtgtattggatggatcatataatgtttcttgtctttgtagtactgatgcctttctaggttggtcttatgacacttgcgtcagtaacaaccgttgtaatcgactcggaccgatg

SEQ ID NO: 7159 - DNA, 203 bp, Homo sapiens
ggcgcgccagtcctgtctgttctaattatgcagcttgccatgacttattgtcagagtatggcactttttgtgataatattaatagtattttagatgaagttaatggtttacttgatactactcaattgcatgtagctgatactcttatgcaaggtgtcacacttagctccaatcttaatactaatttgcgactcggaccgatg

SEQ ID NO: 7160 - DNA, 203 bp, Homo sapiens
ggcgcgccagtcctcttctttgtgtacaatcctttaatggtattaaagttttgcctcctattttgtctgaatctcaaatttctggttacaccacagccgctactgttgctgctatgtttccaccatggtcagcagcagctggcataccattttctcttaatgtacaatatagaattaatggtttgggtcgactcggaccgatg

SEQ ID NO: 7161 - DNA, 203 bp, Homo sapiens
ggcgcgccagtcctgagaaggttaatgagtgtgttaaaagtcaatctcctcgtattaatttttgtggtaatggtaatcatattttgtcattagttcaaaatgctccttatggtttgttgtttatgcattttagttataaacctatttcttttaaaactgttttagtaagtcctggtttgtgtatatcacgactcggaccgatg

SEQ ID NO: 7162 - DNA, 203 bp, Homo sapiens
ggcgcgccagtcctgtcaacctattgttggttactgtattgtacctttaaatgtttggtgtcgcaagtttggcaaatttgcttctcactttacattacgtagtcacgatatttcccatagtaataattttggtgttgtaactagttttactacttatggtaatactgtttctgaggctgtgtctagatcgactcggaccgatg

SEQ ID NO: 7163 - DNA, 203 bp, Homo sapiens
ggcgcgccagtcctatggccccaaggtctccggctttgaagactttctggaggattgtgccattacaacaggcacaggcagctttgaagcgcatccggaaagtggtgggttcgctgttgcagaatcttcaaaaaagaggaaaacgcagatcggctgtggattggacaggagcggtcacgatggtgattcgactcggaccgatg

SEQ ID NO: 7164 - DNA, 203 bp, Homo sapiens
ggcgcgccagtcctcatgccaaattgacggataccaaagtggcggcgaggtgcccaacgactgggccagcaaccctccctgaagagcaccagaagaacatggtgtgcaaaagagatcagagtgataggggatgggggaaccactgcgggctgttcggaaaaggtagcattgttggatgtacgaagtttcgactcggaccgatg

SEQ ID NO: 7165 - DNA, 203 bp, Homo sapiens
ggcgcgccagtcctgattgcgaggtcaacaagaaagccactgggagagtgtttgacatcaccaagattgtgtacacggtgaaggtggaaccacacactggcacatatgtggcagcaaatgagacaaacagcgacagaaagtcagttgagttcaccgcacagtcggaaaagaagaccatctccttggggcgactcggaccgatg

SEQ ID NO: 7166 - DNA, 203 bp, Homo sapiens
ggcgcgccagtcctagctatggtgaggttggactctcttgcagggtgaattctggcattgacgttgaccaaaccgtggtgctggagttggaaggccaggcactccaccccaaggggtgggctgtgcacaaagactggtttggagacctggcactaccatggaaacaccatgaggcggagatctgggaacgactcggaccgatg

SEQ ID NO: 7167 - DNA, 203 bp, Homo sapiens
ggcgcgccagtcctgtcgatgtggcaaatctcataacccctaacccaaccattgagaatgaagggggtgggtacattgagatgcaacttcctcccggggacaacacaatttatatcggcaatcttcaccaagcatggttccagaaagggagctccataggcagagtgtttgaaaagacacgcaaggggcgactcggaccgatg

SEQ ID NO: 7168 - DNA, 203 bp, Homo sapiens
ggcgcgccagtcctatccagagactggcagcagttggagagcacgcatgggactttggttccgtgggcggcttctttgggtcaattggaaaggcagtgcacatggtcctggggggactgttcggtgtcttgtttggaggcattgggtttatccccaagatgctgatgggagctgccttgatttggcttcgactcggaccgatg

SEQ ID NO: 7169 - DNA, 203 bp, Homo sapiens
ggcgcgccagtcctggaataaacatgaaaaacaccaccttgtctcttagctttctggccacaggtggactcatcctgatgatgacacttggcgttggggcagaccaaggatgttccattgacagtgagagaatggagctcagatgtggagcaggactggccgtttggaaggaaaccgcagagtggtatcgactcggaccgatg

SEQ ID NO: 7170 - DNA, 203 bp, Homo sapiens
ggcgcgccagtcctgacggctatgcgttccaccctgagtccccgggagagctggctgcagcgctcgtggaggcagccaagaacaacgtgtgtggaatagtgccccaaaacaggctagaactggcaatgtggagatcgcgcagagatgagatcaatctacacctcgctgaagcagaggccaatctcacacgactcggaccgatg

SEQ ID NO: 7171 - DNA, 203 bp, Homo sapiens
ggcgcgccagtcctaagtccagaggcaatgcaaccggtttctatattcaggagctgcatgtcatggacttgcgtaactgcacttggccagatgagtacaccattgacaacaagggggtgatagagtcacacctgtttctcccggtgacgctggctgggccgagaaccatgtacaaccagatcccaggacgactcggaccgatg

SEQ ID NO: 7172 - DNA, 203 bp, Homo sapiens
ggcgcgccagtccttatgctgtgcagctgtctgggccgtggaatcaaacacctctgcgcgtgaaacgagaaccatgccctgggacagaggtcaagattgaccctggatgtcctggcagaggagcttctgtgcgtagcaccacggaaagcgggaaggtgattccggagtggtgctgtagaacttgcacacgactcggaccgatg

SEQ ID NO: 7173 - DNA, 203 bp, Homo sapiens
ggcgcgccagtccttactgggcggacatcagagaggatgtagtgtgctatgggggtgcctggaacctgccaaccaagtgggagggcgaggtggtacagcttcatgctttccctccgggaagggctcatgagatcaagcaatgtcagcctggcagactcaacctgggtaatgggagggtcatgggagcgcgactcggaccgatg

SEQ ID NO: 7174 - DNA, 203 bp, Homo sapiens
ggcgcgccagtcctggatggatgtcaaaaggagagatcacggtgattgacatgcatccaggtgcggggaagactcatagagtcctccctgaactcatcaggcaatgcatagacaggaggcttcgaaccctgattctggccccaacaagggtggttttaagggagatggagcaggctctgaaaggcaagcgactcggaccgatg

SEQ ID NO: 7175 - DNA, 203 bp, Homo sapiens
ggcgcgccagtcctatgggggccaactttgatgtcgacagggtgatcgatggcaggaataacatcaagcctgaggaaattgacggagcagtcgaactcattggggtcaggaaagtcaccactgcgtcggctgcccagagaagaggcagggtggggcgcaaggaaggaagaagggaccggtatgtgtaccgactcggaccgatg

SEQ ID NO: 7176 - DNA, 203 bp, Homo sapiens
ggcgcgccagtccttctggccagtgtgatgatgatgacagcatgctggtacagtggaaagaagcccaaatgctgttggacaatatcacaacccttaggggaatggcggcagtcttttacggtcctgaacaggaacggatgcccgaggtggctggcttctacaggctcaccgaggagaagaggaagtaccgactcggaccgatg

SEQ ID NO: 7177 - DNA, 203 bp, Homo sapiens
ggcgcgccagtcctttccggcatctcttgtcacagaatgatttcacaccctggctggcatggcatgtggctaagaacacagcgggaccgattgaccgaagttggacttgggagggaccggagggcaacgctatagagggccagaatggtgaggtcgtccggttcagaactcctggtggcgctgagaaacgactcggaccgatg

SEQ ID NO: 7178 - DNA, 203 bp, Homo sapiens
ggcgcgccagtcctatcttgaaaccaacctggagagacatgcgcatgttccgagaggggcgtgacatccgagagtttgtccagtatgcaagttgccgcaggggagcgtctgaactgctgatgggaatgagtgaagtcccaggtttgatgaggaacagagtgctgggggcttatgacgtgttctacacccgactcggaccgatg

SEQ ID NO: 7179 - DNA, 203 bp, Homo sapiens
ggcgcgccagtcctctcatttctttgtgtctcatgtgggctgggggcatgtcttatggacatatggcgggggtttctctcgtcttttatgctttcctgactgtgatacagcccgaacctggcaaacagagaagcgccgatgacaacagattggcgttcacactccttgtcctgggattggtaattggacgactcggaccgatg

SEQ ID NO: 7180 - DNA, 203 bp, Homo sapiens
ggcgcgccagtcctacagtggcagccaatgagcttggttggcttgagaggaccaaggctgacttaggccagcttctctggaaacccacggaggaagccgataggggagggtggaccgagtggaccaacattgacattcagccggcacgttcgtggggaacttatgtgcttgtggtgtctctcttttcgcgactcggaccgatg

SEQ ID NO: 7181 - DNA, 203 bp, Homo sapiens
ggcgcgccagtcctccatacatgattcatcagatgcagaccagagtccaacgtctggtcaacagtgccgtggtgtcgggtggccagaccatccgtgagataggagggggagcacctttctttggagtgaaggggcacgtcatcacaatggggataagttccctagttggggcaactccactatcactgcgactcggaccgatg

SEQ ID NO: 7182 - DNA, 203 bp, Homo sapiens
ggcgcgccagtcctgaaagaaagctcagcctcatgcttgcagtcggcctgggcgccctggctgtgtccctcaacagaactgcgtgggccttggcagaggctggggcgctgatggtggcagctgtgggtcaactggtgtcaaccgaaggcgagttttggtggacaatgccggtggcgtgcggaatggcacgactcggaccgatg

SEQ ID NO: 7183 - DNA, 203 bp, Homo sapiens
ggcgcgccagtcctttagaaaccgacaggaccaaggctagggaactcttgagacgtggagagacaaacatggggttggccgtctcacgcggaactgccaagttggcgtggctagaggaaagaggttatgccaccgtcaagggggaggtcgtagacctgggctgtggacgcggtggatggtcatactaccgactcggaccgatg

SEQ ID NO: 7184 - DNA, 203 bp, Homo sapiens
ggcgcgccagtcctgccgcttccagacccaccgtattgagtgtgaaggcatacaccatcggagggaaaggacacgaggaaccccgtatggtcaccagcttgggatggaacctcgtgaagttcagaagtggaatggatgtgttttctatggaggcccacagagcagacacggtgatgtgtgacattggacgactcggaccgatg

SEQ ID NO: 7185 - DNA, 203 bp, Homo sapiens
ggcgcgccagtcctgagagtgatccggacccagagaaggaaggggagagaagccgcagagtgatccagctcatgagccgctggaagcagcggaacccagacgcctcctgtgtattcaaggtgctggctccttacagacctgatgtcattgaggcactccacagattccagctgctgtggggtggggggcgactcggaccgatg

SEQ ID NO: 7186 - DNA, 203 bp, Homo sapiens
ggcgcgccagtcctctggtgagaaaccctttctccagaaactcgacccatgagatgtactacacgacgggggtttgtggaaacatcatcaatgctgtcaatgtgacatcaaaacgactgttgagtaggtatggtgatgctgctggacccgtccttgttcctgaggtagatttgggaactggaactcgtcgactcggaccgatg

SEQ ID NO: 7187 - DNA, 203 bp, Homo sapiens
ggcgcgccagtccttgcgtggcactggccagtgacgtggtgaagccaaaggatgtggaagagaggatcaacgccctaaagagacagtactcagacacgtggcatgtggacaaagaacacccatatcggacatggcagtattgggggagttaccgaacagcggccacaggctcggcggcgtccttgatccgactcggaccgatg

SEQ ID NO: 7188 - DNA, 203 bp, Homo sapiens
ggcgcgccagtcctacactcacgaacgtgaaggtacagctcatcaggatgatggaaggtgagggcgtcattgggccctctgacgcacaggatcctaggctccgccgagttgaacaatggcttcatgcccacggggcagaaaggttgactcggatgttggtcagtggtgacgactgtgtggtgagaccccgactcggaccgatg

SEQ ID NO: 7189 - DNA, 203 bp, Homo sapiens
ggcgcgccagtcctattgatgacaggttcggcacggccctctacttcctgaatgacatggcgaaagtgagaaaggacatcggcgagtgggagccatccatcggtttcgctaggtgggaggaagttccattttgctcccaccacttccatgagcttgccatgaaggatggaagaacgctgatagtgccacgactcggaccgatg

SEQ ID NO: 7190 - DNA, 203 bp, Homo sapiens
ggcgcgccagtcctgatatgttgtgcgcgtcattgattggccataccgagagggctgactgggcacggcacatatggactggggtcatgaaggttcgagccatgataggtagggagacgtatgtggactacctgtcgcacatggacaggcatgaggccccatggctccctgtctacgaaagctccatccgactcggaccgatg

SEQ ID NO: 7191 - DNA, 203 bp, Homo sapiens
ggcgcgccagtcctgtggaccagtgaaaactttgtgagactgaccatccctcaaggccgagtgggatgcgtatgaaggcccctggagagatccaggaggggggagagaggaaaattggcagcctctctcaggagatttcctccccctataccaaattccccaggaatctggggggcggttcttgttctcgactcggaccgatg

SEQ ID NO: 7192 - DNA, 203 bp, Homo sapiens
ggcgcgccagtcctgattttgataatgatgaattgaaacgtttaggaaatttattaaaacaggaagaagaccctcttcatgatcctgactcggaaaatagttatgatgctcctccccctcctcatccgtccctacattcgtcgcgtccctcagataatgatgatttactttcatctacagatgaggctcgactcggaccgatg

SEQ ID NO: 7193 - DNA, 203 bp, Homo sapiens
ggcgcgccagtccttcttaacggtcttgtgattgctgatgagaaaattcaaacgcattttccttataattatttaggtttctccttgtatcctcgtacctataacacccaactagtaaagctgcaaactgatcatttgaaaactctaaatgattttcagaaacttttaggagatattaactggatccgcgactcggaccgatg

SEQ ID NO: 7194 - DNA, 203 bp, Homo sapiens
ggcgcgccagtcctggagcctccctttatctgtgttccttatgctttagaacaacaggattggctttttcaattttcagataattgggccatagcatttgcgaattaccccggacgaattattcatcattaccctcctgataaattattgcaatttgctagctctcatgcttttatttttccaaaaatcgactcggaccgatg

SEQ ID NO: 7195 - DNA, 203 bp, Homo sapiens
ggcgcgccagtcctagttcgccgacaacctattcctaacgctacacttatatttacagacggctcttccaatgggactgcagccttaattattaatcatcaaacttattatacacaaaccagtttctcttctgctcaagttgtggaattatttgcagtccaccaagcattgctaacagtacctacttccgactcggaccgatg

SEQ ID NO: 7196 - DNA, 203 bp, Homo sapiens
ggcgcgccagtcctatcttgttctacttgtcctcaattctttgtccttcctcaatatggtgtcaaccctcgaggtttacgccctaatcatctctggcaaacagacgttactcacattcctcaatttgggcgtctgaaatatgttcatgtttcaatcgacaccttttccaactttctcatggcttccctcgactcggaccgatg

SEQ ID NO: 7197 - DNA, 203 bp, Homo sapiens
ggcgcgccagtcctttggggagaacgatcctcatgcaaaaaaccacttgtacgatggaaagatccacttaccaatctgtggtatgggcctgaccctgtattaatatggggacgagggcatgtttgtgtttttccacaggatgccgaagcaccgcgctggattccggaaaggctggtacgcgcggcagacgactcggaccgatg

SEQ ID NO: 7198 - DNA, 203 bp, Homo sapiens
ggcgcgccagtcctccaccctcaggaagtcttaagagcttttggagctcaaatgtgttttggttttgcaacatggcttaaaaagcaggaaatctgattatgtaagaaaccagtaattatgtaagtaaatgatctcaagttacttaacttgcttatatatactgctgcacaataaagcaaggtatcagccgactcggaccgatg

SEQ ID NO: 7199 - DNA, 203 bp, Homo sapiens
ggcgcgccagtcctagagaaacccgtcaagggcgactatatcaggctgatatgagttttgtgaaaaattacctgctacctaagctaccactgaatgattgctattatgcatggactaatatagacaggtttgaagcagctgtactgagcgtgcgcaacagacagctttcaggtcctcaaggtgctattcgactcggaccgatg

SEQ ID NO: 7200 - DNA, 203 bp, Homo sapiens
ggcgcgccagtcctgcttggtggtaagtgtgattttatgttttctttgattttcttgtagacttgttcctgacgctgctacaggagcagaagactaacaagcttcatttatttttccaggtaagcaaacatgtctgctgctgatgcttatcgtccaggtggcaagctgcctctagatgagctaatgcacgactcggaccgatg

SEQ ID NO: 7201 - DNA, 203 bp, Homo sapiens
ggcgcgccagtcctaagaatgaatagagcaattcctgtgggaccggaaccttcaagtcaagccaaccgcggaggggggccatatcaaactcactttgctataggaataatgtactccaaggctttccaaggcttgcttagatttgctaatgctttacctcctgaattgagccctgtaaaacagcttgtcgactcggaccgatg

SEQ ID NO: 7202 - DNA, 203 bp, Homo sapiens
ggcgcgccagtccttaatcagttagaaaattataggcgtaagacatctgataccagggtatggtacagagtgtacttagacatgacaagacttctaatttctgtggctcctccaggagcagcaaacaaactcagacaggcagcagcaggtataactcactcaaaagcccccaatgctgaaagcctgagcgactcggaccgatg

SEQ ID NO: 7203 - DNA, 203 bp, Homo sapiens
ggcgcgccagtcctaggcattgtgcggttcgcagctgctgcttttgtacctactgtagaaaatattgatagattttttgaagactcgctaacgaactttgccaaagaagacttagacacctggcaacaactccacgagcagtttatcaaactctttcaccctccagatgtcggagtccaccttgttagcgactcggaccgatg

SEQ ID NO: 7204 - DNA, 203 bp, Homo sapiens
ggcgcgccagtccttgctgatgttcaactttctcaggtcctaccgcccgctcctccttcttcggaccaacaaccggcttattccgcaggagagccctcagccaagaaggcgcggattggtacccctgacgagtctgacccggccttgcttctgcagcctcataccaatacaatgtccgtggaaccagccgactcggaccgatg

SEQ ID NO: 7205 - DNA, 203 bp, Homo sapiens
ggcgcgccagtcctcaggttagctattatgacaggtgttgataatgatgggactgccatttggaaacgccctgaaggcatggatgttggcagactcccattaaattatgttccagggccagctctaatgatgccaacagacacccaaattagaaacacaactttcagagatcctgtggctattggaaacgactcggaccgatg

SEQ ID NO: 7206 - DNA, 203 bp, Homo sapiens
ggcgcgccagtccttcctgctacaagtgacaggtatagtgtagctcctttagtccatcaaccatggtctgtccgtacagaagaatggctagcaaacaaaacagactatgctgttcataattatttaggaggtgttgcatacactagaagaaagcatgaagagtcttatgataaacatgaggaggaccgcgactcggaccgatg

SEQ ID NO: 7207 - DNA, 203 bp, Homo sapiens
ggcgcgccagtccttgctgtttggaacccaaatcctttatcatatgattgccaaatatggactaaaattcctaatacagaatgtcatttttttgctcaatatcctcttttgggaggttggggagttcttactcctcctccaatgatttttgtgaagctcaggtcacaaccaggccctcctagtccaggcgactcggaccgatg

SEQ ID NO: 7208 - DNA, 203 bp, Homo sapiens
ggcgcgccagtcctccaagaagtacagttctaagacgaaccgcggcacgaaacgtgcgccgcgcgatcaggaggttgggacgggtgcgcaagaaagtactcgtaatgacgttgcttggtatgctcgttatcctcatattttggaggaagctacgcgcctgccttttgcttatcctattgggcagtattcgactcggaccgatg

SEQ ID NO: 7209 - DNA, 203 bp, Homo sapiens
ggcgcgccagtcctatgatactggatactctgttgcaagcgctactgagtggtctaagtacgtagatactagcctgaccattcctggtgtgatgtgtgttaactttacacccaccccgggtgaatcttataataagaattcacctatcaatatagctgcacagaatgtctacacgtatgtgcggcacacgactcggaccgatg

SEQ ID NO: 7210 - DNA, 203 bp, Homo sapiens
ggcgcgccagtcctctgaagatgttttcgctaaccaggcgcaatgggaatacttcgtcaacatggtggcatacagggctggagcgttcgctgctcctgcaagtatgacttattatgagcgtcacgcgtggatgtccaatggtctgtacgtggatcaagatgtcacacgagctcaaatctacatgttcacgactcggaccgatg

SEQ ID NO: 7211 - DNA, 203 bp, Homo sapiens
ggcgcgccagtccttctttaaggcgttcggtgctgatggtctggttaaactgctggctgttgacagcactaccatgacattgcccacatacgatcccctcatcctggctcaaattcatagtgctagggctgtgggcgcacctatcctggaaacttccactcttactggtttcccaggccgtcagtggccgactcggaccgatg

SEQ ID NO: 7212 - DNA, 203 bp, Homo sapiens
ggcgcgccagtcctattgctcaggagtcgtttggtccctttgctcagctgaatgattggaccatccttacgggtgaaactctggctcggatgcatgaagtatgtgtcaccagcatgttcgatgttcctcagatgggcttcaacaaataaatgttggcctggggtgtgtgtgcgttaagcacacacctccgactcggaccgatg

SEQ ID NO: 7213 - DNA, 203 bp, Homo sapiens
ggcgcgccagtcctgtagtgtggatgtttcctttcgctgttaatattcgtgagctgcaggtctatcaaccactaatccttacgttccaaagattgggattggtgccagcgtgggttagcatggaagctgttgataggcgtatcactaagatgtttgatacaaaaggaccacgtgatgtggtggtctgtcgactcggaccgatg

SEQ ID NO: 7214 - DNA, 203 bp, Homo sapiens
ggcgcgccagtcctacagacttctccaagttcgaccagcattttaatccaacgtgccagagtgtagccaaagagctgttggctgatctgcttacaggtcaggaagccgtcgactggttagaacgtgtgttcccaattaaatatgctatacccttagcttataattggggtgaaatcaggtatggtatccgactcggaccgatg

SEQ ID NO: 7215 - DNA, 203 bp, Homo sapiens
ggcgcgccagtcctcatggaatgggatcgggttctggcggcactaacgccgatgagacgttggtgcatagggtgctgcaacacgaagcagcgattagccaccataccactcttaacccaaattcgcagtgtctgggtgacgatggcgttttaacttacccaggtatatctgcggaggatgtaatgcaacgactcggaccgatg

SEQ ID NO: 7216 - DNA, 203 bp, Homo sapiens
ggcgcgccagtccttcatactcgcgccacggtctcgatatgaacctagagaaacagtatgtgagcaaacaagactgcacatatttacgcaggtggcatcatacagattatcgcgtagacggcatgtgtgtgggagtgtactcaaccatgcgggcgttaggcaggttggctatgcaagagcgctactatcgactcggaccgatg

SEQ ID NO: 7217 - DNA, 203 bp, Homo sapiens
ggcgcgccagtcctgacccagacgtatggggtgagaagatggtcaccctacgttatctatccatcattgagaatgtgaagtatcatcctctaaaggaagagttcctggacttttgcatcaaaggggataaaactagacttggactaggaatcccaggctttctggacaacatcgctggtgaggcccagcgactcggaccgatg

SEQ ID NO: 7218 - DNA, 203 bp, Homo sapiens
ggcgcgccagtccttatcgacatgatgccagatttccttggctacaccaagtcgttgcagtatgatggtgatctgcgacgtaatgctgctgccggtattgaaaactggtgggttgttcaagcattgaaatcgagacgctgacgatcgagatggtgcagcaaaccattgggactaacagtcccaactgccgactcggaccgatg

SEQ ID NO: 7219 - DNA, 203 bp, Homo sapiens
ggcgcgccagtcctgaaaaggggaaatggacaacgaacacagagactggagcaccccaactcaatccgattgatggaccactacctgaggataatgagccgagtgggtatgcacaaacagattgtgtattggaagcaatggctttccttgaagaatcccacccagggatctttgaaaactcgtgtcttcgactcggaccgatg

SEQ ID NO: 7220 - DNA, 203 bp, Homo sapiens
ggcgcgccagtcctaacacaatgacaaaagacgcagaaagaggcaaattgaagaggcgggcaattgcaacacccgggatgcaaatcagaggattcgtgtactttgtcgaaacactagcgaggagtatctgtgagaaacttgagcaatctggactccccgtcggagggaatgaaaagaaggctaaattgcgactcggaccgatg

SEQ ID NO: 7221 - DNA, 203 bp, Homo sapiens
ggcgcgccagtcctggcacagcctcattgagtcctggaatgatgatgggcatgttcaatatgctgagtacagtcttaggagtttcaatcctgaatcttgggcagaagaggtacaccaaaaccacatactggtgggacggactccaatcctctgatgatttcgctctcatagtgaatgcaccaaatcatcgactcggaccgatg

SEQ ID NO: 7222 - DNA, 203 bp, Homo sapiens
ggcgcgccagtcctgagggaatagaagcaggggtggataggttctataggacttgcaaactagttggaatcaatatgaccaagaagaagtcttacataaatcggacaggaacatgtgaattcacaagcttcttctaccgctatgggttcgtagccaacttcagtatggagctgcccagctttggagtgcgactcggaccgatg

SEQ ID NO: 7223 - DNA, 203 bp, Homo sapiens
ggcgcgccagtccttcattcgagctgaagaagctgtgggagcagacccgctcaaaggcaggactgttggtttcagatggaggaccaaacccatacaatatccggaatctccacattccggaggctggcttgaagtgggaattgatggatgaagactaccagggcagactgtgtaatcctctgaacccgcgactcggaccgatg

SEQ ID NO: 7224 - DNA, 203 bp, Homo sapiens
ggcgcgccagtcctttgctgatggatgcccttaaattaagcatcgaagacccgagtcatgagggggaggggataccgctatatgatgcaatcaaatgcatgaaaacatttttcggctggaaagagcccaacattgtaaaaccacatgaaaaaggcataaaccccaattacctcctggcttggaagcagcgactcggaccgatg

SEQ ID NO: 7225 - DNA, 203 bp, Homo sapiens
ggcgcgccagtcctggctccatcgggaaggtgtgcagaaccttactggctaaatctgttttcaacagtctatatgcatctccacaactcgaggggttttcagctgaatcaagaaaattgcttctcattgttcaggcacttagggacaacctggaacctggaaccttcgatcttggggggctatatgaacgactcggaccgatg

SEQ ID NO: 7226 - DNA, 203 bp, Homo sapiens
ggcgcgccagtcctgcatatgagagaatgtgcaacatcctcaaagggaaattccaaacagcagcacaaagagcaatgatggatcaggtacgggaaagcagaaatcctgggaatgctgagattgaagatctcatatttctggcacggtctgcactcatcctgagaggatcagtggcccacaagtcctgccgactcggaccgatg

SEQ ID NO: 7227 - DNA, 203 bp, Homo sapiens
ggcgcgccagtcctgggcatatggagtaaaagggttttcatttaaatacggcaatggtgtttggatcgggagaaccaaaagcactaattccaggagcggctttgaaatgatttgggatccaaatgggtggactggaacggacagtagcttctcggtgaaacaagatatcgtagcaataactgattggtcgactcggaccgatg

SEQ ID NO: 7228 - DNA, 203 bp, Homo sapiens
ggcgcgccagtccttctgggttgagctaatcagagggcggcccaaagagagcacaatttggactagtgggagcagcatatctttttgtggtgtaaatagtgacactgtgggttggtcttggccagacgatgccgagttgccattcaccattgacaagtagtttgttcaaaaaactccttgtttctactcgactcggaccgatg

SEQ ID NO: 7229 - DNA, 203 bp, Homo sapiens
ggcgcgccagtcctagaagaaaaaagagaggactatttggagctatagcaggttttatagagggaggatggcagggaatggtagatggttggtatgggtaccaccatagcaatgagcaggggagtggatacgctgcagacaaagaatccactcaaaaggcaatagatggagtcaccaataaggtcaaccgactcggaccgatg

SEQ ID NO: 7230 - DNA, 203 bp, Homo sapiens
ggcgcgccagtcctgactcaaatgtcaagaacctttatgacaaggtccgactacagcttagggataatgcaaaggagctgggtaatggttgtttcgagttctatcacaaatgtgataatgaatgtatggaaagtgtaaaaaacggaacgtatgactacccgcagtattcagaagaagcaagactaaaccgactcggaccgatg

SEQ ID NO: 7231 - DNA, 203 bp, Homo sapiens
ggcgcgccagtcctattccatggggctaaggaggtcgcactcagctactcaaccggtgcacttgccagttgtatgggtctcatatacaacaggatgggaacggtgaccacagaagtggcttttggcctagtgtgtgccacttgtgagcagattgcagattcacagcatcggtctcacagacagatggccgactcggaccgatg

SEQ ID NO: 7232 - DNA, 203 bp, Homo sapiens
ggcgcgccagtcctcttcaaatgcatttatcgtcgccttaaatacggtttgaaaagagggccttctacggaaggggtacctgagtctatgagggaagagtatcggcaggaacagcagagtgctgtggatgttgacgatggtcattttgtcaacatagagctggagtaaaaaactaccttgtttctactcgactcggaccgatg

SEQ ID NO: 7233 - DNA, 203 bp, Homo sapiens
ggcgcgccagtcctaaattgaagtcactaatgctactgaactggttcagagttcctcaacaggtggaatatgcgacagtcctcatcagatccttgatggagaaaactgcacactaatagatgctctattgggagaccctcagtgtgatggcttccaaaataagaaatgggacctttttgttgaacgcacgactcggaccgatg

SEQ ID NO: 7234 - DNA, 203 bp, Homo sapiens
ggcgcgccagtccttaccagagaaacaaactagaggcatatttggcgcaatcgcgggtttcatagaaaatggttgggagggaatggtagacggttggtacggtttcaggcatcaaaattctgagggaacaggacaagcagcagatctcaaaagcactcaagcagcaatcaaccaaatcaatgggaagccgactcggaccgatg

SEQ ID NO: 7235 - DNA, 203 bp, Homo sapiens
ggcgcgccagtccttaactgactcagaaatgaacaaactgtttgaaagaacaaagaagcaactgagggaaaatgctgaggatatgggcaatggttgtttcaaaatataccacaaatgtgacaatgcctgcatagggtcaatcagaaatggaacttatgaccatgatgtatacagagatgaagcattaacgactcggaccgatg

SEQ ID NO: 7236 - DNA, 203 bp, Homo sapiens
ggcgcgccagtccttggtggggacatctgggtgacaagagaaccttatgtgtcatgcgaccctgacaagtgttaccaatttgcccttggacagggaacaacactaaacaacgtgcattcaaatgacacagtacatgataggaccccttatcggaccctattgatgaatgaattaggtgttccatttcacgactcggaccgatg

SEQ ID NO: 7237 - DNA, 203 bp, Homo sapiens
ggcgcgccagtcctggagtcagaatgcgtttgtatcaatggaacttgtacagtagtaatgactgatgggagtgcttcaggaaaagctgatactaaaatactattcattgaggaggggaaaatcattcatactagcacattgtcaggaagtgctcagcatgtcgaggagtgctcctgctatcctcgatacgactcggaccgatg

SEQ ID NO: 7238 - DNA, 203 bp, Homo sapiens
ggcgcgccagtccttgccttgagaattttagagcctatgtggatggattcgaaccgaacggctgcattgagggcaagctttctcaaatgtccaaagaagtgaatgccaaaattgaaccttttctgaagacaacaccaagaccaatcaaacttcctaatggacctccttgttatcagcggtccaaattccgactcggaccgatg

SEQ ID NO: 7239 - DNA, 203 bp, Homo sapiens
ggcgcgccagtcctgtattgtcagaattgcaggacattgaaaatgaggagaagatcccaaggactaaaaacatgaagaaaacgagtcaactaaagtgggctcttggtgaaaacatggcaccagagaaagtagactttgacaactgcagagacataagcgatttgaagcaatatgatagtgacgaacctcgactcggaccgatg

SEQ ID NO: 7240 - DNA, 203 bp, Homo sapiens
ggcgcgccagtcctgagaaggggaagtggacgacaaatacagaaactggggcaccccaactcaacccaattgatggaccactacctgaggataatgagccaagtggatatgcacaaacagactgtgtcctggaggctatggccttccttgaagaatcccacccaggtatctttgagaactcatgccttcgactcggaccgatg

SEQ ID NO: 7241 - DNA, 203 bp, Homo sapiens
ggcgcgccagtcctggcacagcatcattgagccctgggatgatgatgggcatgttcaacatgctaagtacggttttaggagtctcggtactgaatcttgggcaaaagaaatacaccaagacaacatactggtgggatgggctccaatcctccgacgattttgccctcatagtgaatgcaccaaatcatcgactcggaccgatg

SEQ ID NO: 7242 - DNA, 203 bp, Homo sapiens
ggcgcgccagtccttaccaaaagtgctgcaacttgttcgagaaatttttccctagtagttcatataggagaccgattggaatttctagcatggtggaggccatggtgtctagggcccggattgatgccagaattgacttcgagtctggacggattaagaaggaagagttctctgagatcatgaagatccgactcggaccgatg

SEQ ID NO: 7243 - DNA, 203 bp, Homo sapiens
ggcgcgccagtcctgttgtttttcccaatgaagtgggagccaggatactaacatcagaatcgcaattaacaataactaaagagaaaaaagaagaactccgagattgcaaaatttctcccttgatggttgcatacatgttagagagagaacttgtccgaaaaacaagatttctcccagttgctggcggacgactcggaccgatg

SEQ ID NO: 7244 - DNA, 203 bp, Homo sapiens
ggcgcgccagtcctagtgtgatgggaatggttggagtattaccagatatgactccaagcacagagatgtcaatgagaggaataagagtcagcaaaatgggtgtggatgaatactccagtacagagagggtggtggttagcattgatcggtttttgagagttcgagaccaacgcgggaatgtattattgcgactcggaccgatg

SEQ ID NO: 7245 - DNA, 203 bp, Homo sapiens
ggcgcgccagtccttccgccgtcttgagagggtttctcattataggtaaggaagacagaagatacggaccagcattaagcatcaatgaactgagtaaccttgcaaaaggggaaaaggctaatgtgctaatcgggcaaggagacgtggtgttggtaatgaaacgaaaacgggactctagcatacttactcgactcggaccgatg

SEQ ID NO: 7246 - DNA, 203 bp, Homo sapiens
ggcgcgccagtcctagggatcatgaagacagaaggaacacttgagaactgtgaaaccaaatgccaaactcctttgggagcaataaatacaacactaccttttcacaatgtccacccactgacaataggtgaatgccccaaatatgtaaaatcggagaaattggtcttagcaacaggactaaggaatgtcgactcggaccgatg

SEQ ID NO: 7247 - DNA, 203 bp, Homo sapiens
ggcgcgccagtcctcagcatgggggtttatcaaatccttgccatttatgctacagtagcaggttctctgtcactggcaatcatgatggctgggatctctttctggatgtgctccaacgggtctctgcagtgcagaatctgcatatgattgtaagtcattttataattaaaaacacccttgtttcctgacgactcggaccgatg

SEQ ID NO: 7248 - DNA, 203 bp, Homo sapiens
ggcgcgccagtccttttcaaatgcatttatcgcttctttaaacacggtctgaaaagagggccttctacggaaggagtacctgagtctatgagggaagaatatcgaaaggaacagcagagtgctgtggatgctgacgatagtcattttgtcagcatagagctggagtaaaaaactaccttgtttctactcgactcggaccgatg

SEQ ID NO: 7249 - DNA, 203 bp, Homo sapiens
ggcgcgccagtcctgtacccttgcaaaaggagaaaaggctaatgtactaattgggcaaggagacgtggtgttggtaatgaaacgaaaacgggactctagcatacttactgacagccagacagcgaccaaaagaattcggatggccatcaattaatgttgaatagtttaaaaacgaccttgtttctactcgactcggaccgatg

SEQ ID NO: 7250 - DNA, 203 bp, Homo sapiens
ggcgcgccagtcctaacagcttaacaatagagagaatggtgctctctgcttttgacgagagaaggaataaatatctggaagaacatcccagcgcggggaaggatcctaagaaaactggaggacccatatacaagagagtagatggaaagtggatgagggaactcgtcctttatgacaaagaagaaatacgactcggaccgatg

SEQ ID NO: 7251 - DNA, 203 bp, Homo sapiens
ggcgcgccagtcctaggcgaatctggcgccaagccaataatggtgatgatgcaacagctgggctgactcacatgatgatctggcattccaatttgaatgatacaacataccagaggacaagagctcttgttcgcaccggaatggatcccaggatgtgctctttgatgcagggttcgactctccctaggcgactcggaccgatg

SEQ ID NO: 7252 - DNA, 203 bp, Homo sapiens
ggcgcgccagtcctgctgcacaaagagcaatgatggatcaagtgagagaaagccggaacccaggaaatgctgagatcgaagatctaatctttctggcacggtctgcactcatattgagagggtcagttgctcacaaatcttgtctgcccgcctgtgtgtatggacctgccatagccagtgggtacaaccgactcggaccgatg

SEQ ID NO: 7253 - DNA, 203 bp, Homo sapiens
ggcgcgccagtccttgtgtagcatggtccagctcaagttgtcacgatggaaaagcatggttgcatgtttgtgtcactggggatgataaaaatgcaactgctagcttcatttatgacgggaggcttatggacagtattggttcatggtctcaaaatatcctcaggacccaggagtcggaatgcgtttgtcgactcggaccgatg

SEQ ID NO: 7254 - DNA, 203 bp, Homo sapiens
ggcgcgccagtcctatcaatgggacttgcacagtagtaatgactgatggaagtgcttcaggaagagccgatactagaatactattcattgaagaggggaaaattgtccatattagcccattgtcaggaagtgctcagcatgtagaggagtgttcctgttatcctcgatatcctgacgtcagatgtatccgactcggaccgatg

SEQ ID NO: 7255 - DNA, 203 bp, Homo sapiens
ggcgcgccagtccttctggtattttctctgttgagggcaaaagatgcatcaataggtgcttttatgtggagttgataaggggaaggcaacaggagactagagtatggtggacctcaaacagtattgttgtgttttgtggcacttcaggtacttatggaacaggctcatggcctgatggggcgaacatccgactcggaccgatg

SEQ ID NO: 7256 - DNA, 203 bp, Homo sapiens
ggcgcgccagtcctgaagaattggaatgtataatagatgcatttgaaaaaggaaaagatatcaccattgatttagacgctatgaacggtgaagttaaattagatggaaattcatgttcatataattcaactgctgctcttgtttcgactattttgggtacacctattaaaatgtataatgaatctggacgactcggaccgatg

SEQ ID NO: 7257 - DNA, 203 bp, Homo sapiens
ggcgcgccagtcctatacctgatttaactgaactggtggatgctgaaaagcaaataaaagaaatggctgcacatttacaactagaggctattacggtacaggttgaatcacaatttttagcaggaattagtgctgctgcagctaatgaagcgtttaaatttataattggctcagttttatctaccagacgactcggaccgatg

SEQ ID NO: 7258 - DNA, 203 bp, Homo sapiens
ggcgcgccagtccttcaacaatgttagtggctctatcatctcagcctttcgctacatatcctttagactataaaagatctgtacaaagagcgttacaacttttatcaaatagaacagctcaaatagcagatttaaccagattaatagtatacaattatactacattatctgcttgtatagttatgaatcgactcggaccgatg

SEQ ID NO: 7259 - DNA, 203 bp, Homo sapiens
ggcgcgccagtcctgagaagaccggtgactattcagctataacgaatgcattacttcgggatactccaatcatattgaaaggtgcgattccatatgttactaactcatcagtaattgatgttttatctaaagtggacaccacagtgttcgcaagcattgtaaaagatagggacatttcaaagttaaaacgactcggaccgatg

SEQ ID NO: 7260 - DNA, 203 bp, Homo sapiens
ggcgcgccagtccttgtcagatgctgtatatgatcagattactgtaacgtatagcgataatgtcaatatggaaatgtataaagaatattctgaacgtatagagaatgaaatatttaccattttaaaagataaaataatacatgaagataaaagattagaagaatacgaattatcagcgttactatcaacgactcggaccgatg

SEQ ID NO: 7261 - DNA, 203 bp, Homo sapiens
ggcgcgccagtcctgacgtagaacaagagctatttttatattaccatatcagtattttatcgctcaacattcatttgctgaaataatgcttaactatgcaaaacgtgaaagagagtattcagagttttattctcaagcaaatcaagtattatcgtatggagatgtaactagatatcttgattcaaatacgactcggaccgatg

SEQ ID NO: 7262 - DNA, 203 bp, Homo sapiens
ggcgcgccagtcctaattgcatctgtgaagagaatggtaatgtagataagctagagggctaaacatcttctatgcggcctacataccatgtagcatgaatcacgactgggtttagtccatgcttgcataggggcaaatatgcatgatatggatgatccccagaaggatgaaatgtgaactatgtggctcgactcggaccgatg

SEQ ID NO: 7263 - DNA, 203 bp, Homo sapiens
ggcgcgccagtcctatgacagcaatggatggagagatacctgatggatattgtgtacattctcctacaacataccgaaaaagtgaatactatttactcattgataaacatatcattaaaagacaaaaaataaaagttactaaatccttaatgtataatgccataaatactatatactcagataatgtacgactcggaccgatg

SEQ ID NO: 7264 - DNA, 203 bp, Homo sapiens
ggcgcgccagtcctttaaacgtgacctcggatccatgctagacaccatcaaccggcggccaagcaagaagagaggagggaccagatcgttgctcggattggctgcgctaattggactggcgagttcattgcagttatcaacctatcaggggaaagtgttaatgtcaatcaacaagactgacgctcaaacgactcggaccgatg

SEQ ID NO: 7265 - DNA, 203 bp, Homo sapiens
ggcgcgccagtcctgcgccataaacattcctagtgccaacggagcaaacacttgcattgtgagggctctagatgtgggggtcatgtgcaaagatgacatcacatacctgtgcccagtgctttcagcgggaaatgatcccgaggacattgactgttggtgtgacgtcgaagaggtgtgggtgcactacgcgactcggaccgatg

SEQ ID NO: 7266 - DNA, 203 bp, Homo sapiens
ggcgcgccagtcctgaagctgtgttacagtgatggcaccagagaaaccaacactggacttcaaggtgatgaagatggaggctaccgagttagccactgtgcgtgagtattgttacgaagcaaccttggacacgctgtcaacagtggcaaggtgccctacaacaggagaggctcacaacaccaaaaggacgactcggaccgatg

SEQ ID NO: 7267 - DNA, 203 bp, Homo sapiens
ggcgcgccagtcctgtgacccaacatttgtctgcaaaagagatgttgtggaccgcggatggggtaacggatgtggcctgtttggaaaagggagcattgacacatgcgctaagttcacatgcaaaaacaaggcaacagggaagacgatcttgagagaaaacatcaagtatgaggttgcaatttttgtgccgactcggaccgatg

SEQ ID NO: 7268 - DNA, 203 bp, Homo sapiens
ggcgcgccagtcctatgtcttcactgtcaaggagaagtcatggctagtgaacagggactggtttcacgacttgaaccttccatggacgagccctgccacaactgattggcgcaacagagaaacactggtggaatttgaggaaccgcatgccaccaagcaaactgtagtagccctaggatcgcaagaagcgactcggaccgatg

SEQ ID NO: 7269 - DNA, 203 bp, Homo sapiens
ggcgcgccagtcctgtgccctgcacacagcattggctggagctattccagccactgttagcagctcaaccctaaccttgcaatcagggcatctgaaatgcagagctaagcttgacaaggtcaaaatcaagggaacgacatatggcatgtgtgattctgccttcaccttcagcaagaacccaactgacacgactcggaccgatg

SEQ ID NO: 7270 - DNA, 203 bp, Homo sapiens
ggcgcgccagtcctcagggcacgggacagtgattgtggaactgcagtatactggaagcaacggaccctgccgagttcccatctccgtgactgcaaacctcatggatttgacaccggttggaagactggtcacggtcaatccttttataagcacagggggagcgaacaacaaggtcatgatcgaagttgcgactcggaccgatg

SEQ ID NO: 7271 - DNA, 203 bp, Homo sapiens
ggcgcgccagtcctaaccaccctttggcgattcttacatcgtcgtcggaagaggcaccacccagattaactaccactggcacaaagaaggaagcagcattggtaaggctttggcgaccacatggaaaggagcccaacggctagccgtcttaggggacacagcgtgggactttggatctattggaggagcgactcggaccgatg

SEQ ID NO: 7272 - DNA, 203 bp, Homo sapiens
ggcgcgccagtcctctcgattgtggctcacaatccgggaggaaaacacaacggaatgcgattcggcaatcatcggcacagctataaaaggagacagagctgttcacagtgacctatcgtattggattgagagcaaaaagaatgagacatggcaactggaacgagccgtcatgggagaagtgaaatcttcgactcggaccgatg

SEQ ID NO: 7273 - DNA, 203 bp, Homo sapiens
ggcgcgccagtcctcaggaacaacagtcaccgttactgaacattgtggaaacaggggagcgtcgctgcgcacaaccacagcgagtggcaagctggtcactgattggtgttgcaggagctgttccttgccaccactgcgatacaccacaaaagatggatgctggtatggaatggaaatccggccggtgacgactcggaccgatg

SEQ ID NO: 7274 - DNA, 203 bp, Homo sapiens
ggcgcgccagtcctaggaggaggaagcaaagcttgtgaaatctcgagtgacagctggagttgcaggagggatggaaccattccaacttggtctcctggtagcattcatagccacacaagaagtgctgaaacgcagatggactgggaagctgaccctgacctcactagcagtatgtttggcactgttgacgactcggaccgatg

SEQ ID NO: 7275 - DNA, 203 bp, Homo sapiens
ggcgcgccagtcctaaaacatcttgatggttattggagcagcttttctccaaatggcggccaatgacttgaagcttgaggtccttccgatactcaacgccatgtccattgcgtggatgctgataagggcaatgaaagaaggtaaagtggcgatgtacgctcttcccatcttgtgtgctttgactccagcgactcggaccgatg

SEQ ID NO: 7276 - DNA, 203 bp, Homo sapiens
ggcgcgccagtcctgaatgaggatggctgggcttgatgtcatcagatgtttgttgttgataattgggattgtaacacttctgaatgaaagaagagaaagtgtggccaagaaaaaaggcggctacttgctcgcagcggccctctgccaagctggagtgtgcagtcccttgattatgatgggaggcttaacgactcggaccgatg

SEQ ID NO: 7277 - DNA, 203 bp, Homo sapiens
ggcgcgccagtcctgtgcacgattccattggttcattccattcggagtactggggttttggctacttggcaaacactcgaagcgaggaggagcattgtgggacgtgccgtcaccaaaagtgtatccaaagtgtgagacaaaaccaggaatctatcgaatcatgactagaggaattttgggcactttcccgactcggaccgatg

SEQ ID NO: 7278 - DNA, 203 bp, Homo sapiens
ggcgcgccagtcctcttttccagattcaaattctcccatactggatgttgaggcccaggttccggataaggcgtggagcaccgggtatgagtggatcaccaacttcacagggaggactgtgtggtttgttcccagtgtgaaaagtgggaacgaaattgccatctgcctacaaaaagcaggaaagcgagcgactcggaccgatg

SEQ ID NO: 7279 - DNA, 203 bp, Homo sapiens
ggcgcgccagtccttcatcctcaatggacccatggcaatcacatcagcgagcgcagcacagcgcagaggccgcattggaagaaatccttcgcagattggagatgagtaccattatgggggtgcaaccaatgaggacgaccatgatctggccaactggactgaagcaaagattctccttgacaacatatcgactcggaccgatg

SEQ ID NO: 7280 - DNA, 203 bp, Homo sapiens
ggcgcgccagtcctacctcccaaacggactggtggcacaaatgtaccagcccgagcgagataaggttttcaccatggatggggagtttcgattgcgtggagaagaaaggaagaactttgttgagctgatgcgcaacggtgacctcccagtgtggttagcttacaaagtagcctctaatggacacagttcgactcggaccgatg

SEQ ID NO: 7281 - DNA, 203 bp, Homo sapiens
ggcgcgccagtcctaccaagaccgctcatggtgttttacaggacaaaccaacaacacaatcctggaagacaacaacgaagttgaagttttcaccaaaactggagacaggaaaattctcaggccaaagtggatggatgcgcgggtctgctgcgactaccaagcgctcaagtcatttaaagagtttgcagcgactcggaccgatg

SEQ ID NO: 7282 - DNA, 203 bp, Homo sapiens
ggcgcgccagtcctcagggaagagatcagcgctgggcatgatggaggtcatgggtagaatgccaaatcacttctgggaaaagacagttgccgctgcagacacactgtatctcctaggaaccagtgaggcaaacagtagggcacacaaagaggcactggcagaactgccagattccctggaaacgcttccgactcggaccgatg

SEQ ID NO: 7283 - DNA, 203 bp, Homo sapiens
ggcgcgccagtcctgtgtactattaggtttgaccaatggaatgccattcactgctatggatctatcggtgccattattggtgctagggtgttggaatcagatgaccctgccaagtttggccgttgcagtgatgcttttggctatccactatgcattcatgatcccaggctggcaggctgaagcaatgacgactcggaccgatg

SEQ ID NO: 7284 - DNA, 203 bp, Homo sapiens
ggcgcgccagtcctccaagggaaagcgtggaggaggaaaaggagccactcttggagagatctggaagtcaagactgaatcagttgacacgagccgaattcatggcatacaggaaagatggaatcgtggaagtagacagagcccccgccaggaaagccaggagagaagggcgtctcacaggtggccacccgactcggaccgatg

SEQ ID NO: 7285 - DNA, 203 bp, Homo sapiens
ggcgcgccagtcctcagtgtccagagggtcagcaaaattaagatggataacagaaagaggattcgtcaaacccatgggaaaggttgttgacttaggctgtggacgaggagggtggagctactactgcgcaaccctgaagcatgttcaagaagtgaaaggattcacaaagggcggaccaggccatgaagcgactcggaccgatg

SEQ ID NO: 7286 - DNA, 203 bp, Homo sapiens
ggcgcgccagtcctgccataaggtggtgaaagtcatgagaccagggcctgatggtaaaacctacatggatgtcatctccagagaagaccaaaggggcagtggacaggtggtcacatatgccctgaacaccttcaccaacctggccgttcaactgataagatgcatggaggctgaaggggtggtagatgcgactcggaccgatg

SEQ ID NO: 7287 - DNA, 203 bp, Homo sapiens
ggcgcgccagtcctaggatgacattacgagagtgagacttggacggttggccaaagcggtcgagtggctgaggaagaatggacctgaacgattgagcagaatggcagtgagtggggacgactgtgttgtgaaaccaattgatgacagatttgccactgcactccactttctcaacaacatgtcaaagacgactcggaccgatg

SEQ ID NO: 7288 - DNA, 203 bp, Homo sapiens
ggcgcgccagtccttcagaaaggacattcaggagtggaaaccttcaacaggctggcacaactggcaagaggtgcccttctgctcacaccacttcaatgaactaatgctgaaggatgggcggaccatcgtggtgccatgtaggagccaggatgagctgattggcagagccagaatctcaccaggagcagcgactcggaccgatg

SEQ ID NO: 7289 - DNA, 203 bp, Homo sapiens
ggcgcgccagtcctctatggcatcttcacaacctcttaagatgaaatttagcgagtatctagaccagcgcatgcaggacagggcaggtgggaaggtacagtggaaagaccataagaaagtgtgggaaaggttaaaattaaggtggacacaagaaggttatttggcagggggagcaccaaccagggttccgactcggaccgatg

SEQ ID NO: 7290 - DNA, 203 bp, Homo sapiens
ggcgcgccagtcctagctgagcacaatggaaggagaattaagagagggaaagcagagagcgaaggacagcgaagtggatttgaataggcagcacgtatttaggaaggaagggactaagcagagagaaaaagcagaagaggagctgagaataggcacttgggctatcgaggagaccagaagatttataacgactcggaccgatg

SEQ ID NO: 7291 - DNA, 203 bp, Homo sapiens
ggcgcgccagtccttgctaagaactccagcagtgatggggatagccacggacatgaaggagggtggggtccctactatctcaccagccaccccagccgaaaaccaaacccccacccagcgcctctatccagacctgccagaagattccagacccccaccctactccccatcagcctcaccatcacctacgactcggaccgatg

SEQ ID NO: 7292 - DNA, 203 bp, Homo sapiens
ggcgcgccagtcctctgtacaagcacctgtattgacagtaagagggggcgtgataaagggagaagtgcacctggtagaaggaacaatagatgtggagaactcggagccgccccaacgctctatggacactgacgatttggggcccgccggagggcggtctaccagaggtcctgactcattggaagaagcgactcggaccgatg

SEQ ID NO: 7293 - DNA, 203 bp, Homo sapiens
ggcgcgccagtcctaacaactaccaagtctgcatggaggtgcctcagcgtggctcctacagttgcaaaccctgacctcagggttcagattaggacttggggacatgagagcactgttggctagggcaacagaccacgtgactatgaatgtcataatgaaaacagctggactagatcacctgccaggaccgactcggaccgatg

SEQ ID NO: 7294 - DNA, 203 bp, Homo sapiens
ggcgcgccagtcctcacagccaccgtatcaacctccaccacctcccctttcgccacagtacccccaggcttatccggggtatggctatcctcccaggggaccaccacaggcaggaggacattggggatcacgttacatgaataatggtgcctgttacaattgtggacagccggggcatcaagcaagaacgactcggaccgatg

SEQ ID NO: 7295 - DNA, 203 bp, Homo sapiens
ggcgcgccagtcctatactccctgggaatgaagatgcccaccaccacctgaggctgaggtccaacgttactctgtatataccgaacccacagtttcatgtcaaatagagggggtgaaccatcgatttctagtggatactggttgcacctactcagccattaagacaatgcaacccttatcaatggattcgactcggaccgatg

SEQ ID NO: 7296 - DNA, 203 bp, Homo sapiens
ggcgcgccagtcctcagaagatggggtggaagtctccatcaactctccgaaatctgggagggtgcttctcctaccttcacttccggtcccaccgctgtcgttaacgcaagaagtctactggctaaaatgcacccagactggcccgtccaccccagccatacagtttcaatttaacacctggagaagaccgactcggaccgatg

SEQ ID NO: 7297 - DNA, 203 bp, Homo sapiens
ggcgcgccagtcctttatctacgcactccacccatataagacacccctacccgaggttcactgcaccatgaacgttacggatgatgaagataacccatataccgaggactgggatgaaaacatgtcacaccaaactcccagtatccgttgtctgtctattgtatgtggacccgagggtgtggcagcaccgactcggaccgatg

SEQ ID NO: 7298 - DNA, 203 bp, Homo sapiens
ggcgcgccagtcctctgtcatcctaccttcacatctcaaaccatggtaccagctggcccctgactcatcaccccacgttactcttgccgtaggaaatgggttcgaagcaagaagcctgggtcctatgatacgacgtgcatctaaacttgattgggtgcccacagcaactcctggaataatgaaggcatcgactcggaccgatg

SEQ ID NO: 7299 - DNA, 203 bp, Homo sapiens
ggcgcgccagtcctgactagcagtcccaccggtcagagtgcagcttacccaccaaggccaacttcctgtttaccgatctcaatatcgtttgaagtatgaacagattgaagggatcaggcccaccgtggaaggactgctgggagctgactgcatctatgctaccagctcaccatggaacactcccataccgactcggaccgatg

SEQ ID NO: 7300 - DNA, 203 bp, Homo sapiens
ggcgcgccagtccttccctgtccccaaagctgatgggaagacgtaccgaatggttcaagacttccgagctgtcaatgatgtcaccacaggggtggacctcccggtaccagatcctcacgtttctttgagcaatctttcacccaaacaccaatacttcaccgtggtggaccttgccaatgcctttttcacgactcggaccgatg

SEQ ID NO: 7301 - DNA, 203 bp, Homo sapiens
ggcgcgccagtccttgtccacagctcaccgtaactcaattttacaccaccccaggcccaccacagtctccggactgctctcattccttggactgactggctacagccgtactcacattcctgattacacctgcagaaccgaaccattgagagaaattgtcaggcaggctggggctaggaatcttcatgcgactcggaccgatg

SEQ ID NO: 7302 - DNA, 203 bp, Homo sapiens
ggcgcgccagtccttctcagcggtggcactcccgaaaaaggtggccatcatgaaatgtaaaggccaccaggtattgaactccagaatcagcaagggaaatgatgcagctgaccaagccgcgaagaaggcaggaggatactcacctggacagatggtactcagagtggacccacccagtacggaattgacgactcggaccgatg

SEQ ID NO: 7303 - DNA, 203 bp, Homo sapiens
ggcgcgccagtcctcagggacaaaattgacgtgggtggaagccctgcccctggcactgatggccatgaggtcctcaccaggtgcagggacacatctatcaccccatgagataatgacaggccgagtgatgcctgggccgccaagagagggaggtcatatgcccgctcttgatgtccaccagataggaacgactcggaccgatg

SEQ ID NO: 7304 - DNA, 203 bp, Homo sapiens
ggcgcgccagtcctcgtacgaagtgaaggaagttacttcacactcagtccaggtcaaaggtaaatcaggcgcaccttggcaccacctgacacattgtacaccagcaccagcacctgacagaacgctgacagaagtcagaagcgacttgatcgcctccaatttggctataaattctgagagccccgacacgactcggaccgatg

SEQ ID NO: 7305 - DNA, 203 bp, Homo sapiens
ggcgcgccagtcctgtccagactggtctgattggtctaaagggaatcttgttggaggatggaggaaggtcctaactttatctactactccaacggggttgaaatttgttattcgaccgaaagaaagcctaggctgtagtcagtttgtactggctccatatgtgtctaactcattagattggagtttgccgactcggaccgatg

SEQ ID NO: 7306 - DNA, 203 bp, Homo sapiens
ggcgcgccagtcctcggcctccgatggtagtttgacacatgccctagatggccttaggactctgaatggtaaaatgaagtcacactccggtattgactcctcttcctgggacaattggatggatgtgtttgggaaatacaaaactttgatttcctccatcctagtctcaatttctgtcttttctgctgcgactcggaccgatg

SEQ ID NO: 7307 - DNA, 203 bp, Homo sapiens
ggcgcgccagtcctataatgcactttggactgaaatttcatggcaagacctcctcctcaaggtagtctcacacaaattggaatatttgtcattgtctcaggttcttggaaacaggattttgcgtcgcaaattcaacattcgctctcacatgttgagaatgttgctatcggcgatacgcatggacctggcgactcggaccgatg

SEQ ID NO: 7308 - DNA, 203 bp, Homo sapiens
ggcgcgccagtcctaaagagaattgaaacttgaaggaaaagtgcaacagcgaattgatcaagtcaaagcagagaatgcagaagattggagagagtatgacagaggtggacctgtcccttcacgagacagagatacctactgccagattcttttggagaacgaactggaacgactcatgcaatccacctcgactcggaccgatg

SEQ ID NO: 7309 - DNA, 203 bp, Homo sapiens
ggcgcgccagtcctttggcttgcgtattcttcagacttctggtttaggagagtatcgcgctgttgtctcacaacagtatgccattttgcgacggcttcacgaccgtcttggactgagaggactgaatgccaaaggacagcgaatggcacccatcataattcagttgtatggagagacaggacaaggaacgactcggaccgatg

SEQ ID NO: 7310 - DNA, 203 bp, Homo sapiens
ggcgcgccagtcctaacatcaagattttgctcaggttccaaaccctgagctatttgaaatcattcgagcaggaaacactttcccctatcctttgcatatggctgacattgctgacaaaaacacaacaacttttcagtcacgcattgtcattttgacgaccaaccaaaagaagccaaaagtggaatcctcgactcggaccgatg

SEQ ID NO: 7311 - DNA, 203 bp, Homo sapiens
ggcgcgccagtcctaacacaaagttgtgttgaaggctcttggcgttgttgctatggctgttggggtgtataagattggtagtgcacttgctggacttgtttcaaaaagagacactcaacctaaagtgtctgcaagtgcgcaatcaccttatgctccccgacctgtggcgctgcgtcagtcagcctatccgactcggaccgatg

SEQ ID NO: 7312 - DNA, 203 bp, Homo sapiens
ggcgcgccagtcctatccgacaacacgggcaacaaaaaccaccatcaacaaaattgtgaaagcgacaggacaagcagcggataatagcgcgcgtgacatcatcacaagcgttatgaaccgaggcatgtactccttgagcgtcgattctcgcgttctagggagtgcaacgttcttaactggaaaaatttcgactcggaccgatg

SEQ ID NO: 7313 - DNA, 203 bp, Homo sapiens
ggcgcgccagtcctcgtgtgtttcagcatctggtgtccaacgagtaacgcctggggcaggaccacctgtctatggtgaatacgaaattggagacactcaatatagaacctacacgcgtgactattggagatatgccctcaacactacctacggggactgtggaggactaatcttcttgaacaacaaaacgactcggaccgatg

SEQ ID NO: 7314 - DNA, 203 bp, Homo sapiens
ggcgcgccagtccttgagtcaccgtaagattcttggaatgcacgttatgggactttcgcaactagattctggctttgccctctcggtttaccgagaggatgtacaagcttacgttcgactagtacgacaggacgatccttcactggtgacaccctgtgcagagcccatcataacgacagcagtccagtcgactcggaccgatg

SEQ ID NO: 7315 - DNA, 203 bp, Homo sapiens
ggcgcgccagtcctgtttgccatttgctggagacttccaccccttgggaaaaagtccgttccctagcacaaatcctggaaagagtaagattgaaaagtcagaactccatcctgacaattgtgctgtggcatggagggaacccgtttctcatcccgcactgttgaaacccatcacagtgaggcctgaggcgactcggaccgatg

SEQ ID NO: 7316 - DNA, 203 bp, Homo sapiens
ggcgcgccagtcctacggtattcccttcccaagtggcacgacattcgacccccttcattaccgactggaaaagtgtggacagcgtgcaaaatgtctagaccaacagcttttggacattgtgcgtcgttcatacaccaccgaacttcgacaaattttgcagactcacaagcaccctgagtacaagtcagcgactcggaccgatg

SEQ ID NO: 7317 - DNA, 203 bp, Homo sapiens
ggcgcgccagtcctgaattgttttgaatgatctcgccggtgatcttccagaccatcaacgagaacatgatgatattcgttctgtgctgttcctcgaccttgtacattccacccaccttgctcgggatgtcctctattcatggacacattcactcccaagtggtcattttctcacagcaattgtaaattcgactcggaccgatg

SEQ ID NO: 7318 - DNA, 203 bp, Homo sapiens
ggcgcgccagtcctctttgtacgtaaatctgatcttcagatatcttcttgcaaaatcttcaaaattgacttcacacatccaaattgaccagctgtgtcgtcggatgaaacttgtttcatacggcgatgaccacattgtctctatcccttctggatacgagaaaattttcaaccaatccactcttccaacgactcggaccgatg

SEQ ID NO: 7319 - DNA, 203 bp, Homo sapiens
ggcgcgccagtccttttggcgctcaaaatccctcaacccgcgctctatcacagagagtagcgtagagtgggcttgccatgagctagccctccacgatgagtcaacatttcaggagtggacgaaaaagattgggttagtctgcaaagatgcaattaattttgtgcctaatctgtctgcgcaacgcgtggcgactcggaccgatg

SEQ ID NO: 7320 - DNA, 203 bp, Homo sapiens
ggcgcgccagtcctgcgcgaaatcacccacttcacagaggatgaccgcgtactcaccgacgcagtgacagaaattacttcattacccctctctttactacagtatggagacgagccacgagaacatagtgtaatatcctttcttcaaagaccggagaaaatcgctacagtgacgtggactacggctcacgactcggaccgatg

SEQ ID NO: 7321 - DNA, 203 bp, Homo sapiens
ggcgcgccagtcctaacaaagacgactaacttggtatccttgccaattccatcgtctgtgttgacgactatgtacagagagaagctgagaggctttggcctgcttcgcgcagacattgtctttaagctgcaattcaactcacagcccttccaagctgggagattgattgcgacatacattccagttcccgactcggaccgatg

SEQ ID NO: 7322 - DNA, 203 bp, Homo sapiens
ggcgcgccagtccttgcctatcttttacaaagaacgcgtatggctcgagcaagtctcacaagactgacctcgttacctaacgtgattattgacattagtaagcagactgaatgtaatatcacattaccctacgtaagctcgtttacccactatgatttaacaagtggcggaggagattggggcttgttcgactcggaccgatg

SEQ ID NO: 7323 - DNA, 203 bp, Homo sapiens
ggcgcgccagtcctcgacctttgggtctatagtcccctcagtagtgcgtcttctcagacaatcaacatctcaatacgagcctacctcgacaatgtacgcttgggtgcgcccacgcaacaatcgttagtcacagcggaaaagatgctaaaagcaaacgtacagacacgggatttatcccggggtacatccgactcggaccgatg

SEQ ID NO: 7324 - DNA, 203 bp, Homo sapiens
ggcgcgccagtccttagttgtggctcgatctcagcgcgcgcccaaggaggaaagcagacagccggctcgggcgatggatccttcggatctctcctgaataagggcacaaaaagtgtcactatgcaggagcgatccgcagggactatctcccgagttggacatagtatacgtgagggccttgtcaggggcgactcggaccgatg

SEQ ID NO: 7325 - DNA, 203 bp, Homo sapiens
ggcgcgccagtccttgactatcatagcgtaaggttaaagatcgtctacgatccaatggcgcagtccgctgctgccgtgacgtatgatgcatccgaatactgctactcaatagttgtagatttccgtgacaagactgacatatatgtgcgtttaccattcatttccgcaacaccttggaaattggtacccgactcggaccgatg

SEQ ID NO: 7326 - DNA, 203 bp, Homo sapiens
ggcgcgccagtcctgattgtcgacattcgaacagggcctccctatgccaacaacacagtctcagattgcgctttggtggatgttgtaggagcattgtttgcctttagagcgggcgggtttcgatggaaagcctgggactccggttctgagctcatatcagcctatctcgttccttttggaccatacaacgactcggaccgatg

SEQ ID NO: 7327 - DNA, 203 bp, Homo sapiens
ggcgcgccagtcctctcttccctttggtatgtatcctagatacagtcactattggggggcagcccttagctaacttagatttaaggcagattagtttatagtcaaattaggcagagcgaagcaactttcttgaggtaagtggtcatccactgtcacttcgagggggcttgccgacactctagataagtcgactcggaccgatg

SEQ ID NO: 7328 - DNA, 203 bp, Homo sapiens
ggcgcgccagtcctagaactcagagagtcgttggaagacgggaaggaagcccgacgactgagcagtccaccccaggcgtgattctggtcgcccggtggatcaagcatggaagccgtcataaaggagctgagctgactctgctggtggcctcgcgtaccactgtggccaggcggtagctgggacgtgcacgactcggaccgatg

SEQ ID NO: 7329 - DNA, 203 bp, Homo sapiens
ggcgcgccagtcctgcccaccaccatggggagcagcaagagcaagcccaaggaccccagccagcgccggcgcagcctggagccacccgacagcacccaccacgggggattcccagcctcgcagacccccaacaagacagcagcccccgacacgcaccgcacccccagccgctcctttgggaccgtggccgactcggaccgatg

SEQ ID NO: 7330 - DNA, 203 bp, Homo sapiens
ggcgcgccagtcctcttcttggtccgggagagcgagacgacaaaaggtgcctattgcctctccgtttctgactttgacaacgccaaggggctcaatgtgaagcactacaagatccgcaagctggacagcggcggcttctacatcacctcacgcacacagttcagcagcctgcagcagctggtggcctacgactcggaccgatg

SEQ ID NO: 7331 - DNA, 203 bp, Homo sapiens
ggcgcgccagtcctcggcaccaccagagtggccataaagactctgaagcccggcaccatgtcctcggaggccttcctgcaggaagcccaagtgatgaagaagctccggcatgagaagctggttcagctgtacgcagtggtgtcggaagagcccatctacatcgtcactgagtacatgagcaaggggagcgactcggaccgatg

SEQ ID NO: 7332 - DNA, 203 bp, Homo sapiens
ggcgcgccagtcctcttcacctcgacagagcccccagtaccagcctggagagaacctataggcctggagctcctcctggcaccagaggcctcgctgtggggcacaggggcctggctccgtgcagaggggccacgttttggggagcagccccagagcaggatgtggcatggtgaggtgtcgggtgctcccgactcggaccgatg

SEQ ID NO: 7333 - DNA, 203 bp, Homo sapiens
ggcgcgccagtcctcctggtgcagaggaaaaggaggtatatgggttaatcaatcaaaggaaattaatgagacagagccgttcagctttactgcgaactgtacagctagtaatttgggtaatgtcagcggatgttgtggaaaaacgaccacgattctcccatcaggggcgtggatcgacagcacacaagcgactcggaccgatg

SEQ ID NO: 7334 - DNA, 203 bp, Homo sapiens
ggcgcgccagtcctaaagcggggtctcggttgtaacgcgcttaggaagtcccctcgaggtatggcagatatgctcttgcacgggtcaggtataatgtgcagtttgactgaggggaccatgatgtgtataggcgtcaagcggggcttcggttgtacgcggataggaatcccctcaggacaattctgcttcgactcggaccgatg

SEQ ID NO: 7335 - DNA, 203 bp, Homo sapiens
ggcgcgccagtcctggaatatgatggcgtcttccctgttttgcccttagactattcaggttgcctctgtggattagggctggaggcagcacggatagtctgatggccaaataaggcaggcaagacagctatttgtaactgcgaaatacgcttttgcatagggagggggaaatgtagtcttatgcaatacgactcggaccgatg

SEQ ID NO: 7336 - DNA, 203 bp, Homo sapiens
ggcgcgccagtcctgaaagcgggtgcatgcatggccattttccagcacaggttcagctggtatggcatgcatgcatcgactgcttgggggtgtccctgacccccttaattcaacgtctagcccacgatacgggcaccctacccaatttgtatccctttacctcccatggattgacttgtatggacttgcgactcggaccgatg

SEQ ID NO: 7337 - DNA, 203 bp, Homo sapiens
ggcgcgccagtcctgatctaaattggattatcctttacttgtggtggttagccaaccatgctctggtgtaatgattccatgtgttcatctggctaagtaccgacctaggaggtggtgctgaaatattgcaagccactagcgtcgttatgcttagcctctggatacatgggattaattgcattctgtaccgactcggaccgatg

SEQ ID NO: 7338 - DNA, 203 bp, Homo sapiens
ggcgcgccagtcctaagcaatttcaggcctaggggcagtggaaagtgtggcatccactaattcagccattgccactgccaatgcaacaactacacagacaataccagacccaacggagggttccactgatgatttctactcctgttcttatgaagtaggagctcaaggggataacatttctagattggcgactcggaccgatg

SEQ ID NO: 7339 - DNA, 203 bp, Homo sapiens
ggcgcgccagtcctgaaagagaaaaccacgcaggaggcccattcacaaacccaagaatccaccacaggagccaagagtcatcattcaaccaggacctggggcagcaaacctttcaaactctagtgttatagcaatggctgaaagcacagcacttgccaatgaagggacagctgttgactattccacagcgactcggaccgatg

SEQ ID NO: 7340 - DNA, 203 bp, Homo sapiens
ggcgcgccagtccttggacctccaagttccagacagaggacatgcctctctcattcggttctttgcctatttttctggagagatcattctcactattgttaacaatggcactacaccagcaatggtagcacattcctactctatggatgatctcagttcagaatatgctgttacagcaatgggaggtgcgactcggaccgatg

SEQ ID NO: 7341 - DNA, 203 bp, Homo sapiens
ggcgcgccagtcctaactgtcaccacgttcagttacaatggttcatcaggttgagacaattgacgttgaggggaagaaggtgacgatagtggattcacctgaaacaccaaattatgatggccccatttctgcctttttttacttgattgaggcaggcaggttcacagctgaagacaaggagtacatcccgactcggaccgatg

SEQ ID NO: 7342 - DNA, 203 bp, Homo sapiens
ggcgcgccagtcctaaatgatgagaaaacgctttccaggctttgagaaatccactattttgattttgaaccgagcagatgaattgaaaactgatgatgatataagaaattgggttaagacatctggagagttggactctctagtgagagcctgtggggggcgtatagctaaatttcaccggcacaaaacgactcggaccgatg

SEQ ID NO: 7343 - DNA, 203 bp, Homo sapiens
ggcgcgccagtccttaaacagggctaagttattagagaaagcagccacccttcctgagtttgtctctcatttgccaagacttgtctacaaggatagaaaaatgtaccgccattatggtgtgcagtgtggttccacagtcttccacatggactcagagaacatccttgagtcagcattaaatggtgaagcgactcggaccgatg

SEQ ID NO: 7344 - DNA, 203 bp, Homo sapiens
ggcgcgccagtcctgccctggtgttgggaagagttttttatcaaattacattgttaaagaaatagccaaattaaagcattggaagagttatgccaacccaactggaagtaagcatatggatgggtatgtgtcacaggagattcatgtttttgatgattttggtcaaaatcgggaagaagaggactattcgactcggaccgatg

SEQ ID NO: 7345 - DNA, 203 bp, Homo sapiens
ggcgcgccagtcctctttaatctgtaatcttatttctagtgttccatttattactccaaaagcaagtgtagaggctaagggcacccaatacagaggacgccttgttgtcgtcacaaccaatagacgggattttacttcctgtaagttgactgacccagatgcactggaaaggcgctttcctattcgcccgactcggaccgatg

SEQ ID NO: 7346 - DNA, 203 bp, Homo sapiens
ggcgcgccagtcctttaatatccggccattgcaaaagtataatcacaagggccgtttggatgtggcaacagccatgagagatggaagcttgcagggaggaacttgctgggaaagggatataggccaattaggtcttgaatgttggaatcccataaatggccaaatcttaattgatgaaattatgagtgcgactcggaccgatg

SEQ ID NO: 7347 - DNA, 203 bp, Homo sapiens
ggcgcgccagtcctaaacactccctaaagattttaaggtagctgttaagaaacacattgaaaaactagaaactgaattggaagatcagagcgggcgggtgaattttagacatatttgtaacagactcgtcaatgtgagtaatgaggatgaagtagccactggtttagccattggtgggaaaaatgtttcgactcggaccgatg

SEQ ID NO: 7348 - DNA, 203 bp, Homo sapiens
ggcgcgccagtcctactatcgcggcaatggctggttggtttggaaagatcaggaccagtatatggtgcaagatgtgacaaagattaggccttttggttccacaacaactgcatcaggcacgacatcatgtcaaacatacatatataattgcaagactgggcctggttcctgtggtggtgtgcttgtagcgactcggaccgatg

SEQ ID NO: 7349 - DNA, 203 bp, Homo sapiens
ggcgcgccagtcctgagtattgggatgccatgatactatctcatatgagtcagctgtgagtagtgatgttatacctatgaactgggacacttcacctggcattaagtataagggggagactaaacgacaactggtgctgaagtcctcattcagacaggatgttctgaagcaactacagagtccatccacgactcggaccgatg

SEQ ID NO: 7350 - DNA, 203 bp, Homo sapiens
ggcgcgccagtcctttggaattaatcctttttgtgagtgggacaatttgttggcaaacctccaaccttataatttgtgtcttgacttttctggattcgatggctctctgagtgcccaaattcttgaagaagcagttgatgtattgtcttattttcacaatgacccagccttagtgaaaagaattcatgcgactcggaccgatg

SEQ ID NO: 7351 - DNA, 203 bp, Homo sapiens
ggcgcgccagtcctcaccaactatctattcaactcattatgtaactgatgagatatggcaggtagaaggagggatgtgttcaggatctccatgtaccactgtggtcaattctattgtgaatcagcttgcatgttacaccattttagctgtcttgggctatgacatcaaccaatgttatgtcgttagttcgactcggaccgatg

SEQ ID NO: 7352 - DNA, 203 bp, Homo sapiens
ggcgcgccagtcctggacccgcaaaattattggtgtccttgacaaagaagtcttggaagggaagatacagtggtgcaagggaccagaagcattcaaacagcaacttgactctttcttgctggaagcagctctgcatggagaagaatactaccatgaggtgacatctaagcttaaggcccggtgccccgcgactcggaccgatg

SEQ ID NO: 7353 - DNA, 203 bp, Homo sapiens
ggcgcgccagtcctgaaggaggagaaaaagaagaaggagaagaggggtgtgcggagcacatctcagccggtctccggcggtgcgcagcaccgccgcggaggcggaacaggtcctagggccggaggtctactaggacgtttgggagctggctggggatcgattctccaggaggacattgtgcacgcactcgactcggaccgatg

SEQ ID NO: 7354 - DNA, 203 bp, Homo sapiens
ggcgcgccagtcctcatgcacttagtgctggtgctacactctgttttcatcgcaattgatcgacgcttgcgctcactgacacggcgcgtgactgctcttgaggctaaacgctctgcgaagaacgctgtacggatcgcattcatgctcaccggcgtgatgatggtgctgggcgccgtcgtcattgatatcgactcggaccgatg

SEQ ID NO: 7355 - DNA, 203 bp, Homo sapiens
ggcgcgccagtccttgagtttcgcaccggagcagccgagatatatggcggccaatggatgcgtgaattgctcgctgattgtcacgtgaacgcgtcattctcgactgacgtgtgtcctggaggatctcagctgaacatgggtgagatcaatggtaaagaacgtgtttgctcaacccagccctacaatcgcgactcggaccgatg

SEQ ID NO: 7356 - DNA, 203 bp, Homo sapiens
ggcgcgccagtccttttggaacggattgtggtctggggagacgccagggctaatgaagttttggtgaaaaacattttggaaccccagctcgtctgggataatgccattgccacgcaggacggttttcgtgatgttggctattcttgtcagatcatgcttgacaaactggttagcggtagttttaaggacgactcggaccgatg

SEQ ID NO: 7357 - DNA, 203 bp, Homo sapiens
ggcgcgccagtcctctgcccggggatcaagtcttcagtcttcgtccaaagcggtttcggatacgacggagtggtgatgacaagcttgtccaaagcaactaatgagagctgctctgtggggctgacgtgccacggatgctacctccttgcgacgaagatggtgttcggacctggaacttcgaccgcaagcgactcggaccgatg

SEQ ID NO: 7358 - DNA, 203 bp, Homo sapiens
ggcgcgccagtcctcggatcaggagggttcgtctggaaaagcttgtcacaatggccgacccgggaacattcagttgaactcgatgaccaacacttgatcacggctcttgttacggaacagttgaagaagacgaacaaggtgtgtatcatttgtgaggacgtcttgcaatgcgccgccgctcgtagtgccgactcggaccgatg

SEQ ID NO: 7359 - DNA, 203 bp, Homo sapiens
ggcgcgccagtcctcaagcccgtggcaaaaccaacagattactgccccacgtacctggccggatcgtttgtgaaaaatgacataggcgcgtacaccgatgggatgatgtggatgaaaagcaggaaggtgaacggaacgtggacattggtcgacctggaactgacgcagagccatcaatgcatttggcccgactcggaccgatg

SEQ ID NO: 7360 - DNA, 203 bp, Homo sapiens
ggcgcgccagtcctagaggtgaccattgacgctgacggcgaagacatggacgagatgacatcaatgttcgggacaatgaaggcagtcgtaccgccagtggaagggtcctatccggatttccggctcagcccatctgtggagggagtttctcccctactggtgggcgcgcttttgcacctgctgaccatcgactcggaccgatg

SEQ ID NO: 7361 - DNA, 203 bp, Homo sapiens
ggcgcgccagtcctgttcaatctgaaatcacagttcgtacctgtggactcgatggtactgctgaactatgttgtgacgcatcctgcagttgcgacggccatggtaacaggaggtgccctggtgatctattccattcgcgtgtacaagagctggggatgctctccgaacttgtggaggagtggacttcgcgactcggaccgatg

SEQ ID NO: 7362 - DNA, 203 bp, Homo sapiens
ggcgcgccagtcctcgcttcgaggcgctcattagtggctggaatgtgcttggcggggttgtacgtgctctcaacgtgtctcgagttgtatcagatgccgacgacggcatcggtggtgttcctaggaggactactgatcgggatagtgaccaggatggctcctccagcgcacttggagttggttccggtcgactcggaccgatg

SEQ ID NO: 7363 - DNA, 203 bp, Homo sapiens
ggcgcgccagtcctggctggaatgggagtgccgttggattgcgaggaagagcccacaacacttccgtctggattagaaggaacttagggaccggatggagtggaattcacgaacttgacggacaacagtagagtgtcaacggggttgctggtttacgtcggctgcatgggaatcatggccatcaataccgactcggaccgatg

SEQ ID NO: 7364 - DNA, 203 bp, Homo sapiens
ggcgcgccagtcctctacgtcggggtcatcctgatgtgtgcttgttggtggacaaacgcgcccgagtggctacctctctacgtggctggagtatcggtctttcgatccaatgaggtgaatgatgtcctcatcacccctccagagtatgagcaggaagcacagctaagcaacgacttcgggcacctgcccgactcggaccgatg

SEQ ID NO: 7365 - DNA, 203 bp, Homo sapiens
ggcgcgccagtcctttgccacgcgacactaacgcagtatctgatggagaaaggcattgacagcattcgattctccaccatcataatggacgaatgtcacttcctggaccccctgtccatcgcctgtcgtggggtcatggattactacaatggaaaaggggttgccgtggtgtacatgagtgcgactcccgactcggaccgatg

SEQ ID NO: 7366 - DNA, 203 bp, Homo sapiens
ggcgcgccagtcctactgacccgcgaatcgtttgacgttgcgatcggaaaggcccgcaagcaggagacacagttcatcgtgtcgacagacatcagcgaaatgggagcaaatctcggtgtgcagacggtcattgacacgcgtgtggcagtgaagcctgtcattagcgaaggttccgtcatgctggagaacgactcggaccgatg

SEQ ID NO: 7367 - DNA, 203 bp, Homo sapiens
ggcgcgccagtcctggaaatcgagaacttccagccacagggcagatacctcttggcgcctgaaagtcgaccccggttcatcaacttcatcaagaaggatgttccagtctggcttgcgtggcactgggcgaatgcgtttgaacacaagcactcagtgctgtttcaaggacagaatgcgacgagcttgaacgactcggaccgatg

SEQ ID NO: 7368 - DNA, 203 bp, Homo sapiens
ggcgcgccagtcctcacgaacctagagcggcttggtacatcctaccgctcggcgattgagattctccatgaaatctctaacgttgatgatccaatggtttcaaacgtggtgatgggaaagtcgctacaagcttgggcggctgtcatcattgggatggtcactgggattgtgctactcgtcatgtttgtcgactcggaccgatg

SEQ ID NO: 7369 - DNA, 203 bp, Homo sapiens
ggcgcgccagtcctagtggtttgtcggatcgtgaagtggctgttcggtggaaagacaactgcacaacaaagccccccgtactcaagcttcccaacgttacaaacagcaggattttgtcaattcggctcaatggtgatggctatcggaccactatgtgcggtggttgctggcattcctcccgctttcgtcgactcggaccgatg

SEQ ID NO: 7370 - DNA, 203 bp, Homo sapiens
ggcgcgccagtcctttttgttgcggtgttgggattgttcgtgataatgtgctgtagcgctaataacgtgcaccgggcttacactactgacaccgtcacgctcgttgtcatcggtgtttgcgtgtgtgtcatgggagttgttgcgtgggaaatggatctacttcccaacatccgacgggatctaggttacgactcggaccgatg

SEQ ID NO: 7371 - DNA, 203 bp, Homo sapiens
ggcgcgccagtcctgcgcaagttgttttcgaacgaagaacagtccgcaacggtaatcggaggcatccagctcgctttgatttcctgggagacgatggtgccaatcgcttttgctgggttcttcgcaactacgttcgtgacgaagatctatgggtgcatggtaggaggaatctacctggttttagctcacgactcggaccgatg

SEQ ID NO: 7372 - DNA, 203 bp, Homo sapiens
ggcgcgccagtcctcgtggcgcatcagtctcgcatggcgctacggtcgctggtgaagacagacgcttgcggactgggatacagatggaaggaaatgcttaacgcgcttgacaaaaatgcgtttgacaagtaccgatcccgaggagtgaacgagacagacaagggtgatttcgtctcgcggggcggtttcgactcggaccgatg

SEQ ID NO: 7373 - DNA, 203 bp, Homo sapiens
ggcgcgccagtcctgaaaggacacaacctagccgtgctaaaagccggtgttgacgtgtacgcgactgagccgcgagactgcaacacgattgtgtgtgacataggcgagagtgacccccggcctgaggtggagaagacaagaacgctgaaagtgctgacgatgctcgagaaatggttagtccacaatcccgactcggaccgatg

SEQ ID NO: 7374 - DNA, 203 bp, Homo sapiens
ggcgcgccagtcctttatcacgtcttaggggctctaattgggcgcctcaagcgtaatgacccggtgcagcaggatgctcctccaaagctcgagatgggcactcgaagtgacccccgggcaaaagtgaagctgcaggaccagacaatcgttgcaggtcgcgtgaagaggttgcgagaggaaaacgccagcgactcggaccgatg

SEQ ID NO: 7375 - DNA, 203 bp, Homo sapiens
ggcgcgccagtcctcacatggttcgtggaccgtgaacacccttaccaatcgttcaactaccacgggtcatttgtcactgacgacatctctcccggagggcagactgtcaacccgatgatgcgccgaataatgtggccgtgggatttcctctcccgtgtgacgacgttcatgatgacagatgtgtcaaccgactcggaccgatg

SEQ ID NO: 7376 - DNA, 203 bp, Homo sapiens
ggcgcgccagtcctgatgatcgatgggtggttaggttcccatctggaagagattttgagtggaatggtcgtggccggggatgatgtggttgtggcaaccaacaatgaaaacttccacaccagtctaaggtacatcaccgccgcgtcaaaaacgcgcaagaacttgcaaccaaccgagccttccccgagcgactcggaccgatg

SEQ ID NO: 7377 - DNA, 203 bp, Homo sapiens
ggcgcgccagtcctgtacacaaactgggaacatgttgaattctgttcccatcactaccatcctctcgtgctgcaagacggtcgtgagatcattgctccgtgtcgtgaccaacacgagatcattggccgagcacggatccagaaaggggggatcgtggacatgtcagctgccgggtgcttagcaaaggccgactcggaccgatg

SEQ ID NO: 7378 - DNA, 203 bp, Homo sapiens
ggcgcgccagtcctcgtgtggattgtcaacaacccatggatggcagtgaaagacccagtgaagacatggtcagagataccatacctcccgaagacgaaggacataaattgtggaagtttgattggtgagcgggacagggcagcgtggtcgaagaatatcgtggccacagttagcacaactcgacgaatcgactcggaccgatg

SEQ ID NO: 7379 - DNA, 203 bp, Homo sapiens
ggcgcgccagtcctcatcgagcaagaagctggaagtcagaagttcacggaagggttgcggatacttgggcgataccgagctccaaccgacgacgtgttctggtgagaatcacgcgaatcgtagagaaccacatctctagaaaaggttaacgttgcgaagcaacgggaaccccgtaaggaaggacaaggcgactcggaccgatg

SEQ ID NO: 7380 - DNA, 203 bp, Homo sapiens
ggcgcgccagtcctcaagctttgagcattgacaacgctccggccccagtcccccaggttatgggagaataaccccgacgtgctggaagggcacgaatcaccgcaaggtgagggcgcacaggatagaatccaggtgactgacgccacctcccgaaatgtgtatagtaacagagcatgcctgcagcagcacgactcggaccgatg

SEQ ID NO: 7381 - DNA, 203 bp, Homo sapiens
ggcgcgccagtcctgcgtgtacgtgacatacgggaagtgcaaggccgacggggccccgcgacgctcgagaaggtcagtcgagatcacgagccacataacggaagggttgaacacccgccaggaaacgtgggccattgaccgttatggaaaactccagctagaaaaagtggaaagatgggtaatacgcacgactcggaccgatg

SEQ ID NO: 7382 - DNA, 203 bp, Homo sapiens
ggcgcgccagtccttcatcaaactccaactacatacctctgagagggattccacttcagctgactggaagagaagcatagagttcaacatgctttccggacaacaggtggttgtgttcactggatatggaactgtgacactcagttgcaacctgaaaaccaccatggacttgggcaattattacattgcgactcggaccgatg

SEQ ID NO: 7383 - DNA, 203 bp, Homo sapiens
ggcgcgccagtcctccatcctgggctctgataggtttcttgttaacaaaaactgggccactgacctgccactgccttggacgccggcttctgctgatgcttggcgtgaaaaacactacctggtacacttcgaggagccacatgcaacctcagtggcagtgacaactctgggggaccaggaaggggctgcgactcggaccgatg

SEQ ID NO: 7384 - DNA, 203 bp, Homo sapiens
ggcgcgccagtcctgtcacataattattggtaatggagaggacaggctcacacaccgatggcaccagcctgggagcaccataggcaaggcgtttagagtgacaatgaggggcatggaaagaatgaccatcattggagatgacgcctgggactttggttccactggcggaatcttcaataccataggcacgactcggaccgatg

SEQ ID NO: 7385 - DNA, 203 bp, Homo sapiens
ggcgcgccagtcctaggccattcacactgtgtttggaggtgcgttctcggcaatattcggaggggttaattggattgtgaaaatcctcataggcaccatctttttgtggctgggagtgaacgccagaaatggcacgttgacccttgtgctgctcataactggtggtgttttggtctttcttggaacagcgactcggaccgatg

SEQ ID NO: 7386 - DNA, 203 bp, Homo sapiens
ggcgcgccagtcctgagtgggggctgagactggctgcgccgtgtctttagagcagaaggagctgaaatgcggtgatggcgtgttcatcttccgcgacacgaatgactttttgtcaaaataccgtctgtgtccattgtcaccccaggagcttgctagcataatacaggcaacgagtgagcgtggggcctcgactcggaccgatg

SEQ ID NO: 7387 - DNA, 203 bp, Homo sapiens
ggcgcgccagtccttggttgccttgtccatatcccaagtggtactgtctgacaaaatcggattcctagactggatggacgctgttgggctagtggctgccgtggtgcaggccttgattgagttgaaatcagaaaattgggcaatgctcggactactagctctgaaccccatggggtcgaagttggttgcgactcggaccgatg

SEQ ID NO: 7388 - DNA, 203 bp, Homo sapiens
ggcgcgccagtcctcaaagacaaccatcgtcacgctcctaggacttgcagggctcgcaattttgcaaaagcgggacacgagtgcaagaaggacatatcccaagttgataggggcagcaatggttctgttggggttcacccgtgggtggatcctaggattgctcacaatgctgagccagcagagcttgacgactcggaccgatg

SEQ ID NO: 7389 - DNA, 203 bp, Homo sapiens
ggcgcgccagtccttgcagataatcgcatgtgtccctcgccaaaaagtcaagaacgtgacaacaacgcctggagtgttcgccctgaaaacgggagaagaaattggagcggtatcactggattaccctgcaggaacctcaggttctcccatcatcaacaagaaaggtgatatcattggcttatatggaacgactcggaccgatg

SEQ ID NO: 7390 - DNA, 203 bp, Homo sapiens
ggcgcgccagtcctatggaatcctgactgagaataaggactttgtgtctgccatcgctcaggctgactcatgtgacctgcgtaccccagaagttgatgttgagtttagaaaaggagagatcaaggtgctggatctgcaccccggagcggggaagacccggaaggttctgccagagttgttacggaaatcgactcggaccgatg

SEQ ID NO: 7391 - DNA, 203 bp, Homo sapiens
ggcgcgccagtcctgccttgagcggcggctgcggaccttagtgctggctccgaccaaggtggtgctgacagagatgtatgaagcactcaaggacatgcctatccggtatcatacaagtgctgcaatcgagacaaagaaatcaggagctctcattgacatcatgtgccatgctacgctggcaaatcggtcgactcggaccgatg

SEQ ID NO: 7392 - DNA, 203 bp, Homo sapiens
ggcgcgccagtcctggtcgatgacaacaatactggaaagggttgtgcaggtgccagggctcatgaaggacaacttgcaagaggcctgggacacataccacaccctgctgagagcagatgaaaattctagtagacacagaatggcgctggataacatccccgaacccatgctcagtactatgtgtgtggcgactcggaccgatg

SEQ ID NO: 7393 - DNA, 203 bp, Homo sapiens
ggcgcgccagtcctcgtcagtcgcgtccatgaccatgggaatttttctgtacatgctcgctccaaagggaacgtcacgaaagacgctcgcctttgtgacaatggttgccgcttcagtgggactatgggatggagatgtctcagttgtcaagattgctagcatgatgctggttttcttcatactgtgtgcgactcggaccgatg

SEQ ID NO: 7394 - DNA, 203 bp, Homo sapiens
ggcgcgccagtccttcattctaattccagacgcaggactgcagagatcaacgcaggataactacttggcatattttgtgattgtgctcctgatgcttgtggggctcgttgcagccaatgagaatggatacctcgaaaaaaccaaagcggatattttcggtcacaagcaaatgaggacaatgccagtgacgactcggaccgatg

SEQ ID NO: 7395 - DNA, 203 bp, Homo sapiens
ggcgcgccagtcctacggctcatggatgtcttttgacctgcgaccaggtagtgcatgggcagtttatgcctttgtggtggggatattctctccgctttatcatcatgcagagagcatcaactatggagccatttccttgcaaggcatcacccagagcgcagcagctttcttccaaatggacaaaggctcgactcggaccgatg

SEQ ID NO: 7396 - DNA, 203 bp, Homo sapiens
ggcgcgccagtccttcacctcttccctgcctcagttggtgaacggcgttccctcgccggtttggaacacgcaagtggcggtaggtgtggctgggcttcttagaggaaactacttggctctcatcagcactggccatgctctatggagtgtgcgaggcaatcgccgaggtggtggaggaacatccacaacgactcggaccgatg

SEQ ID NO: 7397 - DNA, 203 bp, Homo sapiens
ggcgcgccagtcctctttgggagagctttggaaaaaacagctcaacaagatgactaaaaaacagtttgagtcctacaagaaatcagggatcattgaagtggatcgcacggcagcgcaagatgccataaggagaaacatcctagacggatccgctgtgtcaaggggcagtgcaaagatgaggtggatggcgactcggaccgatg

SEQ ID NO: 7398 - DNA, 203 bp, Homo sapiens
ggcgcgccagtcctggagccgagccatatggtacatgtggctgggggcacgcttcctggagtttgaagccctaggtttcttgaatgaggaccactggattgccagacgccactctagagcaggagtggaaggcattggactgcagtacctagggtatgtgctggaagaactggaggggaagaaaggagcgactcggaccgatg

SEQ ID NO: 7399 - DNA, 203 bp, Homo sapiens
ggcgcgccagtcctatgcaaacatgtggaaactgttttatttccaccgaagggacctgaggctcatggcaaacgccatcagttcagctgtccccgttgactgggtcccgacaggaagaacgacatggtccttgcatggaaaaggtgaatggatgacgtctgaggacatgttggaagtctggaatagggcgactcggaccgatg

SEQ ID NO: 7400 - DNA, 203 bp, Homo sapiens
ggcgcgccagtccttgaagaaactgcgaaacatagtgacaaacttgatgaagggattgtccggacgcaggaaaagaagaagcccaccagcctcaatcattttgctactgctccccctaatggcatactcagctagtgtgacacgtcagcatggagctggattgttattgaatgtgacctttgctgatgcgactcggaccgatg

SEQ ID NO: 7401 - DNA, 203 bp, Homo sapiens
ggcgcgccagtccttcggaaagacctttgaggtacaagggggtaactgttcagtcaataccttggaagccggaaaatggtgtgatgactatgtggaatacgcttgtgtcactctgactgagggtgaggaacctgatgacctagactgttggtgctatggggtggacaatgtgagagtgacatatgggacgactcggaccgatg

SEQ ID NO: 7402 - DNA, 203 bp, Homo sapiens
ggcgcgccagtccttagctctggcatatttcattggaacatcagtagtccagaaagtagtcatcgccatactgctgctaggaattggaccagcttattccacacattgccttggtatccccaaaagagacttcatacggggacttgatggaaacacatgggtctcagttgtgttggagcaaggaggctcgactcggaccgatg

SEQ ID NO: 7403 - DNA, 203 bp, Homo sapiens
ggcgcgccagtcctgtgtgaccctgattgcagacaacaaaccatcagttgacgtgtggctcagttcaattgtggtcgacacgccaacacttgtccggaaaatctgctatgaaagttcagtcacaggttcaaaagctgaaggagcttgtcctactatgggtgatgcgcacttgactgaggaaggaaatgcgactcggaccgatg

SEQ ID NO: 7404 - DNA, 203 bp, Homo sapiens
ggcgcgccagtcctaagaatgggaatgcaaaagatccttctctgacagaggttggggcaacggctgtggtctttttggtaaaggcagcatagttgcttgcgcaaagttctcatgcaccaaagagatggaagtgtaccaaattgactctacaaaaatagaatacactatcagtgctcaagttcattctgcgactcggaccgatg

SEQ ID NO: 7405 - DNA, 203 bp, Homo sapiens
ggcgcgccagtcctgagccaaaaaagaggattgggttaaccacaccaaactcatcaagtttgttcccacaacaggaacatccacagtgacttttacaggttatggtaactttggccttgaatgtcatgttcaaatgatggtagatcttggtaactcttacctagtcaaagtgggtacagacgcatggccgactcggaccgatg

SEQ ID NO: 7406 - DNA, 203 bp, Homo sapiens
ggcgcgccagtcctaggtgacaaatggagctccatgcaggattccagtcatagcatcagattcgatggctggcactgaaaatcgtggcagcgtcatcacaactaatccaatagctgcattgaacaatgatgaagtgctggttgagatcagtcccccttttggggaaagctacatcatagttggttcagcgactcggaccgatg

SEQ ID NO: 7407 - DNA, 203 bp, Homo sapiens
ggcgcgccagtcctgttcactcaattggaaacagcgtgaggtgaaatgtggagatggaatgtttgtcttcaaagacacagatgattggttcacgaaataccagtatattccagaagatcccaagacaatggccgggttaattgcccaggcccacgaggaaggactatgtggactcaactcagttggagcgactcggaccgatg

SEQ ID NO: 7408 - DNA, 203 bp, Homo sapiens
ggcgcgccagtcctaaaacatcatttttagtccatccagaaagaacggcacctttataattgacggaaagagcaaatcagaatgtcctttcaataagagggtctggaactcaatcaaagtggaagaatttggcacaggaatctatcaaacaagagtgtttatgcgccctgactatgattactccaagtcgactcggaccgatg

SEQ ID NO: 7409 - DNA, 203 bp, Homo sapiens
ggcgcgccagtcctgagtgatagaatctgacatgttcatgccacgcagtctagccgggcccgttagccgccacaatcacatacccggatacaaagtgcagtctagtggtccatggcacaacactccattggaagtaaaaagagaagaatgccctggaactcacgtcactgtggaagaaacatgtgatgcgactcggaccgatg

SEQ ID NO: 7410 - DNA, 203 bp, Homo sapiens
ggcgcgccagtccttggcctccaagggcgatgttgatcctttctctttgggactcctcatgctttttctttgtagtgacatgttcctgatgaagaggttttcgatgcgtgctctcattgctgggagcatcatcatgctgggagccatgacattaggaagcttgacatatcttgacctcttacgctatgcgactcggaccgatg

SEQ ID NO: 7411 - DNA, 203 bp, Homo sapiens
ggcgcgccagtccttggtcacggttgggatgtacatggctgaagccaatagtggaggagatgtgacacacctggctctcatagcggtttttcgggtgcgggctggctttgttagcgtgctggccctaaaacaaatgtggagccctagagagagatttgtcgcagcttgtggaatagttatggttcagacgactcggaccgatg

SEQ ID NO: 7412 - DNA, 203 bp, Homo sapiens
ggcgcgccagtccttagcactgggagacatcatgaatactaatctcatggagtggctgaatgcagctggcatgtcaatactcgtcatcaagtcaatagtcgatccgagaaagtgcaatgtggtgctccctttactctgtcttctcacaccacttacgacgacagaaattcaaagggctgtgatgctatcgactcggaccgatg

SEQ ID NO: 7413 - DNA, 203 bp, Homo sapiens
ggcgcgccagtccttctgttctgtggtcatttccgtgaccgtactgcaaaccgacagcgtctcaacaagaaagtctatccctcttatagccttgaccatttgttcattctttaaatggacaagccctttccttggcctggtgtgttacttagcttttacacgcattccccagcgctcatggccattggcgactcggaccgatg

SEQ ID NO: 7414 - DNA, 203 bp, Homo sapiens
ggcgcgccagtcctcccttgtgttggcccccacccgggtagtcctcagtgaaatgaaggaagccatgcctaaaatgagcatcaaattccacacccaagcattttcaaacactgctacaggaaaagaaatcattgatgcaatgtgtcatgctacgttaacccatagaatgttggagcctactcgggtgacgactcggaccgatg

SEQ ID NO: 7415 - DNA, 203 bp, Homo sapiens
ggcgcgccagtcctctaactgggaagtagttatcatggatgaagcccactttatggacccagctagcattgccgcaagaggatgggcagcacatagatcaagagcgagggaatgtgccaccatcttcatgtctgctacacctcctggaaccagcaatgaattccctgagtccaatggaaccatagaggcgactcggaccgatg

SEQ ID NO: 7416 - DNA, 203 bp, Homo sapiens
ggcgcgccagtcctcctcaggcattgtcatgttctttttggcacccaaagggctcagccgcatgtcgatggcaatgatgaccatgttggtgtctgcttacttgatgtctttgggaggtatgaacccagtgcaggtgtcctgtgtaatgctggtattcttcatattcatggtggtgttgatacctgaaccgactcggaccgatg

SEQ ID NO: 7417 - DNA, 203 bp, Homo sapiens
ggcgcgccagtcctcagggacacagcgatcaacatatgacaaccagctcatctatctgcttgttggagtgatgagtgtcatcctcatggtcacagccaatgagatgggtatgctggaaaaaaccaagagagacatctttggcacaaccgtcgtggaagagggaaagaagtggacctttccagaactagcgactcggaccgatg

SEQ ID NO: 7418 - DNA, 203 bp, Homo sapiens
ggcgcgccagtccttgtctgtcgtcatactcttgctgagtgcttggaatggaataacactgcttcccctgtttgcaggaatgggagctgcagccctgcactggggatttatcctaccaggactgcgtgcccaagctgccaaggccgctcaaaaaagagtgtaccatggagtggcgaagaatcctgtggcgactcggaccgatg

SEQ ID NO: 7419 - DNA, 203 bp, Homo sapiens
ggcgcgccagtccttgttggaaggaaatacaaatgcatactggaatgggccgattgctgtagcattcactgggctgatgagaggcaattattatgcgaccattggcttgatgtacaatggatggctagcaaaacagaccaggagaggaagggctgcaggagttactcttggtgaagtgtggaaaaggccgactcggaccgatg

SEQ ID NO: 7420 - DNA, 203 bp, Homo sapiens
ggcgcgccagtccttgtcaggaagagtaattgacctggggtgtggacgaggtggctggagctattattcggctgcgcaaaaagaagtcatgagcgtcaaaggttacacgctgggaatcaatggacatgaaaaacccgtgcacatgcaaaccctaggctggaacattatcaaattcaaggataaatctgcgactcggaccgatg

SEQ ID NO: 7421 - DNA, 203 bp, Homo sapiens
ggcgcgccagtcctatgtcttcaccatgccagctgaaccatgtgagacacttctttgtgacataggggaatcatcatcaaattttcttattgaaaaagatagaactctcaaagtcctggaaaattttgaaaggtggaaacacgtcaatactgagaacttctgtgttaaagtcttgtgcccttaccatccgactcggaccgatg

SEQ ID NO: 7422 - DNA, 203 bp, Homo sapiens
ggcgcgccagtcctattacttgggtagctacttgtgtaaagccactggcagttcttcatccatgctgaatggcattgttaaaatgctatccatgccttgggacaagtttgaatccgtgacattactggctatgactgatacaaccccctttggacaacagcgcgtcttcaaagagaaggttgacacaacgactcggaccgatg

SEQ ID NO: 7423 - DNA, 203 bp, Homo sapiens
ggcgcgccagtcctgagccccttctccaccacctggcaccagagccatcatgagagttgtcaactcctggctgtttaaacacctggctagagagatgcgacctaggatctgcacaaaagaagagttcatttccaaggtcaggagtcatgctgcaattggtgcatacttggaagaacatgaaaattggacgactcggaccgatg

SEQ ID NO: 7424 - DNA, 203 bp, Homo sapiens
ggcgcgccagtcctgaagcgctagcgaagctgtccaagacccacggttttggaagcttgtggatgaagaacggaaactccacctacaaggcaaatgcaggacctgtgtttacaacatgatgggcaagagagagaaaaaacctgctgagttcggaaaagccaaaggaagtagagccatctggtacatgtcgactcggaccgatg

SEQ ID NO: 7425 - DNA, 203 bp, Homo sapiens
ggcgcgccagtcctggtatacaaaccaaaacagacaggaccggacctgcctgatgtcagcccgtcataatgacgccatggctaagctgtgaggccatgctggctgggatagccgcgaccacccgcgtaatggggttcctggattgctcgatccggggtaaaaaatttttagggagcctccgcctgctgcgactcggaccgatg

SEQ ID NO: 7426 - DNA, 203 bp, Homo sapiens
ggcgcgccagtccttgtggaccaaaattgatttctttatattacatcaagatatcaattgtaccggttttacattaactatagtagataaggatgaaagaacaaaggacctcgagtattttgaccttaattgtgagtattatgagaatttgtatgatgcattaatggattctgagttttctaaaacttcgactcggaccgatg

SEQ ID NO: 7427 - DNA, 203 bp, Homo sapiens
ggcgcgccagtcctggtttacattgttgctaaaatatattgattatgctccaattagtacgaacagtcgaggaatgccccgcccggagaccatctgtgtttcaaaacattggtggtatgagttatataggattggattcttgaataagttgtaccgatgtggagactgggatagtattttacttctcccgactcggaccgatg

SEQ ID NO: 7428 - DNA, 203 bp, Homo sapiens
ggcgcgccagtcctatgcaaagtgtgaagcgaaattctttggatcaataagtgttattgatgtctgcatagatatcattagtgctttgttgcaagtgagcttcgctaaacctggactcaagttagcttctattgcagtagaagtgttcagacttattaagaaatatgtctcaggaattaagattaacacgactcggaccgatg

SEQ ID NO: 7429 - DNA, 203 bp, Homo sapiens
ggcgcgccagtcctgacgcagagttgatctgtgtgctgaagtacgtaataaggttgagtttacgaaggaaggatattcaaagactaaaggatgcatggtaagacgcttggataaggatttagttaagaagaagactggagacatatgttcaacagaatgttatttagtagacttggttaatcccgagacgactcggaccgatg

SEQ ID NO: 7430 - DNA, 203 bp, Homo sapiens
ggcgcgccagtcctctggagagaaataccaaactgatttagaatatgaagattttttagatatgtgtttggagaaaactcaggagtgtagagataattctgctaagttgaacgaatttctgatgaactatgctgaaagtcgatcaaaacgacccgaacaaaaacacgataagtgccctgaattggaatcgactcggaccgatg

SEQ ID NO: 7431 - DNA, 203 bp, Homo sapiens
ggcgcgccagtcctttggtaagcatgtttccatggtctcttatggagatgacaatgtcataaacttcagtgatgaagtatgtgaatggtataacatggaaactattgctaaagcatttgaaacccttggattcacctatactgatgagcttaagggcgtaaatggcgaagtaccaaaatggcgatcaacgactcggaccgatg

SEQ ID NO: 7432 - DNA, 203 bp, Homo sapiens
ggcgcgccagtccttgcctggcgattcacaacaagaaagcaatactcccaacgtacacaatacggaactcgcttcgtccactagtgaaaactcggttgagacccaagaaatcacaacctttcatgatgtggaaactccaaataggatcgatacccccatggctcaggatacttcatcggctaggaacacgactcggaccgatg

SEQ ID NO: 7433 - DNA, 203 bp, Homo sapiens
ggcgcgccagtcctaggctggcggaaaagctcaaaagcttgccaattttaagtacctgcgatgtgatgttcaggtgaagttagtacttaatgcgaatccctttgtagcaggaagaatgtatctagcatatagtccttacgatgataaagttgacacggcccgtagtgttttacaaacatcgcgagctgcgactcggaccgatg

SEQ ID NO: 7434 - DNA, 203 bp, Homo sapiens
ggcgcgccagtcctaagttcagaaaaataatccttctgggtataaatatattatgcatgtcttgactggctatgaacctgaagtaaagaatgtaacaatgcaagtgaacgctccaaaaacgaaaacaagtcaaaaatctacctcagaaaatcccaaagttggaccaatatctgaagtggcttctggagcgactcggaccgatg

SEQ ID NO: 7435 - DNA, 203 bp, Homo sapiens
ggcgcgccagtcctccagagcaggaaacgatgactttacctttggttggatgataggtccaccccagctacaaggcgaatcacgctccgtagccccctagatgtgcactgggagacagacaaatctccctatgtatggctatagtctaaatttttcacaaaatttcagtttagaccgaaaaccgacaccgactcggaccgatg

SEQ ID NO: 7436 - DNA, 203 bp, Homo sapiens
ggcgcgccagtcctatgtggtgctggagcatggaggctgcgtcacagtacgggttgaagggaaacccacactagactttgaattggtacaaacaaaggccacgggactagcggctgtgagggcttattgttaccaggcaaaggtcagtgatatccaaatctcagcggcatgtccagcggtacagctgacgactcggaccgatg

SEQ ID NO: 7437 - DNA, 203 bp, Homo sapiens
ggcgcgccagtcctggaccatgcttgaggtggaacccccttacggagacagctacatcgtcattggggtcggagacggaaggctcaagcagcattggttcaagaaagggagtgtaattggaggagctttcagcaccaccatgaaaggggcgaaacgcctagcagttttgggagacgcggcatgggactcgactcggaccgatg

SEQ ID NO: 7438 - DNA, 203 bp, Homo sapiens
ggcgcgccagtccttggaaatcaggcctgtgagtgagagagaagaaaccctgataaggtcaaaagtctccgctggagacgggaatgagatagacaccttctcactaggactactggttgcaatgttggtgacacaggaaggcctgaggaaacgctgggctactcgccatatcatggtggcttcactgacgactcggaccgatg

SEQ ID NO: 7439 - DNA, 203 bp, Homo sapiens
ggcgcgccagtcctggcgctggacgccacgagagtcaatgctactggccatatcggcttgtttcttacacctcgtgttttcagagctaagtactgacatcacaacgctggctcataatttttccctagccttgctgatactacgagccatcatccaaacagacgtcagctctgtgacacttccagtgtcgactcggaccgatg

SEQ ID NO: 7440 - DNA, 203 bp, Homo sapiens
ggcgcgccagtccttgtctatgatggctccttcattccagctctcagtcctaggaactttcagaatggcagtggcagtttatgttatcgtcaatctgatgatgtcaaaacggaatgatgccgtaaagaaagcggcccccagcgtggtggcagcagctctgggacaattcggaatggtgaatgcaacggcgactcggaccgatg

SEQ ID NO: 7441 - DNA, 203 bp, Homo sapiens
ggcgcgccagtcctgactctttggaaaaactcaggtaggagtcggagtgatgcatgaaggggtgtttcacaccatgtggcacgtcactagaggggccgctttgaaaagcggagaaggaagattagacccttactggggagacgtgaagaaggacctgatttcatatggagggccatggaagttggaagcgactcggaccgatg

SEQ ID NO: 7442 - DNA, 203 bp, Homo sapiens
ggcgcgccagtcctcgcctggcagcgacaatccctttccagcttccaacgcccccataacagacacagaagctcagattcctgacaaggcctggagcacaggcttcgattggatcacagaatatggaggaaagacagtctggttcgttcctagtgtccgcatgggaaacgagattgccgcttgcttgacgactcggaccgatg

SEQ ID NO: 7443 - DNA, 203 bp, Homo sapiens
ggcgcgccagtcctgcatgctccttgataacatccatatgcaaaatggtctcatagctcaattgtatggccctgaacaagacaaatgtttcgccactgatggagaatttaaattgagagagaaggaaagagccactttcctggagttcctgaaggcggacttgccagtgtggctgtcatttaaggcagcgactcggaccgatg

SEQ ID NO: 7444 - DNA, 203 bp, Homo sapiens
ggcgcgccagtcctctagttctggggttcagtaccatgacaggaaatggtgctttgatggaccagacaacaatttggtcttggaagacaatgttccagttgagatctggacgaagtcaggggaaaggaagaagctaaaacccagatggagtgacgccaggacgtattgtgaccatggtgctctcaccgcgactcggaccgatg

SEQ ID NO: 7445 - DNA, 203 bp, Homo sapiens
ggcgcgccagtcctctttcaaagagtttgctgggggaagaaggagtgtgacgacaggccttctagaaggagttgggagactgccagaacatcttggccaacgcctgaaagaatccattgacaccctgtacttagctttcacagctgaagttggctcgcgcccccatcgagaggctatgcaagaaatgccgactcggaccgatg

SEQ ID NO: 7446 - DNA, 203 bp, Homo sapiens
ggcgcgccagtcctgagtctttcacaagaccgagaggaaatccacagaattcacactcctgactcctccggatttaaggccagccacggcatggagcatatatgccattggaaccaccctcatcactccactgatccaccacatgattactactcactatgcaaacttctctttgatggccatggcaacgactcggaccgatg

SEQ ID NO: 7447 - DNA, 203 bp, Homo sapiens
ggcgcgccagtcctatcaagcaggcagtctcttcggcatgcagacaggagctccattctcaaaaatggactgggcagtgccggccattgtggtcggatgctggcaacaactaactcctgccacactgatgacggctttggtcttgctagctgtccactatatctacatgattccgggatggcaggctgcgactcggaccgatg

SEQ ID NO: 7448 - DNA, 203 bp, Homo sapiens
ggcgcgccagtcctaagaccttcaaagttggagtgagtgcgccaccctatcagccgctgcagccgccacgctttgggaaggatccccaggaaagatttggaatgcgtcaacggcttgttcactggtgaacatcttcagaggccacacgctagcagccgtacctttcatgttcaccatactgcggaacacgactcggaccgatg

SEQ ID NO: 7449 - DNA, 203 bp, Homo sapiens
ggcgcgccagtcctctggaaatacagggaaaagaggaggtgttgagggggaaactctaggggagaaatggaaacaccttctcaatgccatggacaagtatgagttctccaggtacaaggtaaatggcatctttgaggtggatcgtgaaccagcccgtatggccctggccaacggtcttgtgacgagtgcgactcggaccgatg

SEQ ID NO: 7450 - DNA, 203 bp, Homo sapiens
ggcgcgccagtccttggagccgtggcttaagaacaaacctgaattctgcataaaagtgttgtgcccgtacagaccaaaagtcattgagcgcctaagcgccttgcagagaacctatggagggggactcgtaagggtcccgctttcaaggaacagcacacatgaaatgtactggacttctgggacggcagcgactcggaccgatg

SEQ ID NO: 7451 - DNA, 203 bp, Homo sapiens
ggcgcgccagtcctaggcaaaggtgaacaaccatgcagcaatgggttccatctttgaggaggagcatcaatggcagacggccaaggaagcagtggaagatccagggttctgggctctggttgacagagagagagaagctcatttggctggacggtgtgaaacctgtgtctacaacatgatgggaaaaccgactcggaccgatg

SEQ ID NO: 7452 - DNA, 203 bp, Homo sapiens
ggcgcgccagtcctgttacgtcttgagagacatatccagaaggcctggaggaaagatgtacgctgatgacacagccggctgggatacccgcataacagaaaaagacttggacaatgaggcaaaaattatagaccagatggaaggtgaacacaagcagttggccaaggccatcatggaactcacgtacacgactcggaccgatg

SEQ ID NO: 7453 - DNA, 203 bp, Homo sapiens
ggcgcgccagtcctggcacaaagtggtgaaagtcatgcgcccaggccctgggggaaaaacatacatggacatcatttcccgggaggaccagagaggtagtgggcaagtggtcacatatgctttgaacaccttcacaaatatgattgtgcaactcactcgatgtgcagaggcagaaggtgtcctgatcccgactcggaccgatg

SEQ ID NO: 7454 - DNA, 203 bp, Homo sapiens
ggcgcgccagtcctcgtcaatgagagaaaggaaattgacgccagcggagcatagagctcttctcctatggttggatactgaaggagtgaaaagactgaaaaagatggccatcagtggagatgattgtgtggtgaagggagaggatgaaagattcgccactgcactgtacttcctcaatgccatggcaacgactcggaccgatg

SEQ ID NO: 7455 - DNA, 203 bp, Homo sapiens
ggcgcgccagtcctccgcatggaccgtcagagaatcggctgggctggccaaagcttatgcgcaaatgtggaagttgatgtacttccacagacgcgacttacggctcatggccaatgcaatctgctcggccgtccccaaagactgggtccccacgggcagaaccacgtggtcaatacatggaaaaggagcgactcggaccgatg

SEQ ID NO: 7456 - DNA, 203 bp, Homo sapiens
ggcgcgccagtcctcaccggataaaggtagacggtgctgcctgcaacctttctgcggaaggaataaccgcagtcaataaaaccaaaaagagggagttgagaaccctttgggccgcccaggcctgggattgaaccgttgatcccaggcgaagggactagaggttagaggagacccagcctttctcaccacgactcggaccgatg

SEQ ID NO: 7457 - DNA, 203 bp, Homo sapiens
ggcgcgccagtcctacccaaggcccaaccttgctgaacctttaggcaggtaaaaggactagaggttagaggagaccccttggcaaaacagttaacgcaccaaaagaaacagcatattgacacctgggatagaccggagaatttgctgcctcgcaacacctcccacccggcacagaacgccgacatggtcgactcggaccgatg

SEQ ID NO: 7458 - DNA, 203 bp, Homo sapiens
ggcgcgccagtcctcctcagtgaaaggaaccaacatgtgcacgatcagggctttggacgtaggctacacttgcgcttatgacacaacttacgagtgccctcacctggaagtgaccatggatccggaagacatagattgttggtgcacacttgaatctgtttatgttaactacggactctgcaagcaaacgactcggaccgatg

SEQ ID NO: 7459 - DNA, 203 bp, Homo sapiens
ggcgcgccagtcctttatggccaaggacaaaccaacactagacatcaagttgataagaatggaagccaaggacctggccacggttcgtagttactgctaccaggccactgtcaccgactcgtcaactgaggccagatgccctaccatgggtgaagcccacaactccaaatctcttgacgccagctacgcgactcggaccgatg

SEQ ID NO: 7460 - DNA, 203 bp, Homo sapiens
ggcgcgccagtcctacaacaaacattggcttgtcaaccgtgactggttccatgatctggatctaccctggactggacccgccactgagtcgtggaagaaccgtgagagcctcatcgagtttgaggagccccatgctactcgacaaacagtagttgctttgggtaaccaagagggcgctctgcatacggcgactcggaccgatg

SEQ ID NO: 7461 - DNA, 203 bp, Homo sapiens
ggcgcgccagtccttcaatgtgcatgctgacaccggttgtgctattgacatggcacgtcgtgagctgaaatgtggaagtggtatcttcatccacaacgatgttgagacatggaggaacaattacaaataccacccactcacgccacgcggctttgccaaggtcattcagatgtcaaaggataaaggtgcgactcggaccgatg

SEQ ID NO: 7462 - DNA, 203 bp, Homo sapiens
ggcgcgccagtcctgctttggatggaagaattggggaaagagctttatcttttcaaccgaaacagccaactccacattcattgtcgatggaccagaaagtaaagagtgcccaacatcagaccgggcttggaactccctagaattggaggatttcgggttcggaatcatctcaaccaagattttcctaacgactcggaccgatg

SEQ ID NO: 7463 - DNA, 203 bp, Homo sapiens
ggcgcgccagtcctaggtcaacgagcaacggggaaactcatgcgactcagcggtgattggaacagccgtcaagggcaatgaagctgtccatagtgacttgggattctggatccagagcacaaagaatgaatcctggcaactggagagagcagtccttggggaggtcaagtcgtgcacatggccggaaacgactcggaccgatg

SEQ ID NO: 7464 - DNA, 203 bp, Homo sapiens
ggcgcgccagtcctgccacacattgtggggcgacggagttgaggagagtgacttgattattccaatcacgctggccggaccaaaaagccaccacaacatgcgcccagggtacaagactcaaaccaaagggccctggcatgaggagacacctctcgtcatcgagtttgctgaatgtccagggaccacagcgactcggaccgatg

SEQ ID NO: 7465 - DNA, 203 bp, Homo sapiens
ggcgcgccagtccttgacccaggaagagagttgtggcggtagaggaccatcaattaggacaacaacagcaagtggaaggaccatacgcaattggtgttgcaagaactgcacccttcctccactccgatttatggccggggaaaactgctggtatggcgtggaagtcagacccaagcgcgagaatgaggcgactcggaccgatg

SEQ ID NO: 7466 - DNA, 203 bp, Homo sapiens
ggcgcgccagtcctaaaccctaatcaagtcaaaagtctcagcggggaatggccagaccattgagcccttccaactcgggatcctaatggcatttgtgttcacccaagaagtcctgaggaggaggtggacggcgaacctagcgttgcccacctcagccttgctaatggcttgtttcatctttggcggctcgactcggaccgatg

SEQ ID NO: 7467 - DNA, 203 bp, Homo sapiens
ggcgcgccagtcctgtttgggaaaacggggatggcctgccagtgaagtactaacagccgtgggcatgactttcgctcttgcggggagtgttgccagactggacggagggactatggccatcccattggccaccatggccatactggctgttgcctatgtcctctcaggaaaatccactgacatgtggtcgactcggaccgatg

SEQ ID NO: 7468 - DNA, 203 bp, Homo sapiens
ggcgcgccagtccttgaaagcccgcctccgaacggtcatactggttcccaccagagtcgtcgccgctgaaatggcagaggcacttcgtggtctccccatcaggtatcaaacatcagccgtcaaggcagaacactctgggaatgagatagtggatgccatgcgccacgcaacactgacacagcgcctgccgactcggaccgatg

SEQ ID NO: 7469 - DNA, 203 bp, Homo sapiens
ggcgcgccagtccttaacaccagcaaaagtgccgaactacaacgtgtttgtgatggatgaagcccacttcactgacccagcaagtatagcggcaagggggtacatttcaaccaaggtggaacttggggaggctgcggccatcttcatgactgcaacaccgccgggaacgactgacccctttccagactcgactcggaccgatg

SEQ ID NO: 7470 - DNA, 203 bp, Homo sapiens
ggcgcgccagtcctataggaagagctacgactctgagtaccagaagtgcaaaggcaatgactgggacttcgtcataacaactgacatttccgaaatgggggccaattttggcgctcatagggtcattgacagtaggaagtgcgtgaaaccagtcattctggacggagatgacagagtcctcatgaatgcgactcggaccgatg

SEQ ID NO: 7471 - DNA, 203 bp, Homo sapiens
ggcgcgccagtccttgatgtgtgtggcatcactgggaatgttcactctgatggttcaccggaggggtctgggcaagactggactgggaaccctagtgctcgcgacggtcacggtcctcctatggatctcagatgtgccagccccaaagatagctggagttctcctaattgcattcctgctgatgatcgcgactcggaccgatg

SEQ ID NO: 7472 - DNA, 203 bp, Homo sapiens
ggcgcgccagtccttcctcatcccagaacccgaaaagcaaaggagccagacagataaccatttggcaatctttctcgtgtgcgttcttctgttgattggggccgtttccgccaacgaaatggggtggcttgagacaaccaaaaaagacatcggaaagctgttccgctcaagtggagacacacaagagccgactcggaccgatg

SEQ ID NO: 7473 - DNA, 203 bp, Homo sapiens
ggcgcgccagtcctagtcgacctggcaatcttgggcacccgaggtgagagcagccactgcatgggcaggttatgctgggctcacagtgttcttaacaccacttttccggcatctcatcaccacccagtatgtgagcttttccctgaccgcaattacagcccaggcctcggctttgtttggtctgagcgcgactcggaccgatg

SEQ ID NO: 7474 - DNA, 203 bp, Homo sapiens
ggcgcgccagtcctggcacatcgaccttgaacatccgtaccggacatggcactaccacggaagctacgaggttcagcccactggatcagccaactcaatggtcaatggcgtggtgcgcctgttgtctaagccatgggacgcaattaccagcgtggtaaccatggcaatgactgacacgaccccctttgcgactcggaccgatg

SEQ ID NO: 7475 - DNA, 203 bp, Homo sapiens
ggcgcgccagtcctgccaacaaagggtgtttaaagagaaggtggatacacgggccccagacccagcggtgggagttgctcaggcactggacatcacaacaggctggctatggaccttcctggctagaagcaagaaacccaggatgtgcacgcgtgaggagtttatcgcgaaggtcaatagcaacgcggcgactcggaccgatg

SEQ ID NO: 7476 - DNA, 203 bp, Homo sapiens
ggcgcgccagtcctcattgggcgcggtgtttgatgagcagaaccagtggtcaacggctagagaagcagtggaagacccagccttctggaacctagttgatgaggagcgcaaagcccacctggcaggacgctgtgaaacatgcatctacaacatgatgggaaagcgagagaaaaaactaggagagttcgcgactcggaccgatg

SEQ ID NO: 7477 - DNA, 203 bp, Homo sapiens
ggcgcgccagtcctacctggagggtggaaacatgtttgctgatgacactgcaggctgggataccagaatcacgagggctgatcttgaaaacgaagccaaagtgatgaacatgatggatggagaacataaacaactcgccaaggctataatcgaattgacctacaggcataaagtagtcaaggtcatgccgactcggaccgatg

SEQ ID NO: 7478 - DNA, 203 bp, Homo sapiens
ggcgcgccagtcctggcctgcgcggggagggaagacagtcatggacatcatctccagggaggaccagagagggagtggccaagtagtcacctatgcacttaacaccttcaccaacctggcggctcaactagtgagatgcatggagggggaggaactgttgacggagagtgacgtgcacggcttgagcccgactcggaccgatg

SEQ ID NO: 7479 - DNA, 203 bp, Homo sapiens
ggcgcgccagtcctcgaagaagaagcaagcagtccggaactggttgatccaaaatggaagagagaggctttcgcgcatggctgtcagtggagatgactgcgtggtgaaacccattgatgaccgattcgcgagcgcccttcatttcctcaatggcatggcaaagatcaggaaagatacccaggaatggacgactcggaccgatg

SEQ ID NO: 7480 - DNA, 203 bp, Homo sapiens
ggcgcgccagtcctaaatccgcaacttgatcggggatgagaagtatgtggactgcatggtgtcccagcacaggttcgaaacaccttcgcccgtgctgttcaccggcgccatctaaacccaaaagaccaaaaaaggacaattgtgtcaggccatggaaacatgccacccaaagcttgtagagggtgcagcgactcggaccgatg

SEQ ID NO: 7481 - DNA, 203 bp, Homo sapiens
ggcgcgccagtcctcctgcgccaagccccaggaggactgggttaccaaagccgttaggcccccacggcccatttcaggagacagcgcgactcctggaggaaggactagaggttagaggagacccgtggaacatcgctgaggcccaaaccagcccgaagctgtaggactggtggaaggactagaggttacgactcggaccgatg

SEQ ID NO: 7482 - DNA, 203 bp, Homo sapiens
ggcgcgccagtccttggcttccatgaccgacttcgtgcaccttcccaaaaagaagagtggggtttccataattgggaggatgctggttttttcattcacagcagcggtcagagtcaccctagaaaacggcatgtctttgatgaaaattcaaaaggctgacgttggaaaggtcatcaccatacgcactgcgactcggaccgatg

SEQ ID NO: 7483 - DNA, 203 bp, Homo sapiens
ggcgcgccagtcctaccgaggtgaaaacaggtgcatagtgcaagcaatggatgtgggcgaggattgtgaggacacgatgaagtatctctgcccagccatcgaaaacccttcagaacctgatgacattgactgttggtgtgacaaggcagacgccatggtgacctacgggagatgttcaaaaactcgaccgactcggaccgatg

SEQ ID NO: 7484 - DNA, 203 bp, Homo sapiens
ggcgcgccagtcctccccagacaagcccacaatagatttggaactaacatcaacgatagccaaatcgatggcagtgactagaacttactgtgtgcaagctcaagtttcggaactgtccgtggaaactagatgtccaaccatgggcgaagcgcacaattccaagtcaagcgacgctgcctacgtgtgcacgactcggaccgatg

SEQ ID NO: 7485 - DNA, 203 bp, Homo sapiens
ggcgcgccagtcctagaaaggattcagtgacagaggctggggaaatggatgtgggctctttgggaaaggtagcatggagacatgtgcaaagttttcatgtcagaccaaagcggaagggaggattattcaacgggagaacttggaatataccatccacatgaacgtccacgcctcacaggagaccggcccgactcggaccgatg

SEQ ID NO: 7486 - DNA, 203 bp, Homo sapiens
ggcgcgccagtcctacagctggcttgtcaatagagactggtttcacgatgtaaaccttccatggataggaggagcagaaggtcattggaaaaacagagagtccttggtggagttcggaaaaacccatgccaccaagcgagaagtgctagccctaggttcacaagaagggacattgcaagtggctctagcgactcggaccgatg

SEQ ID NO: 7487 - DNA, 203 bp, Homo sapiens
ggcgcgccagtcctcgggcgccatgatagcgaaatttggttcaaatgtggcaactataaatagtggacatctaaagtgcaggctgaaattggacaaactcaaaataaaaggcaccacgtaccacatgtgtaagggctcgtttgctttcacaaaaacgccttctgacacaggccacggcacggtgctgccgactcggaccgatg

SEQ ID NO: 7488 - DNA, 203 bp, Homo sapiens
ggcgcgccagtccttagaattgacttattctggatcagatgggccatgcagggtgcccatatcaatgtctgtgagcctgagcaacatagagcccgttggtaggatggtaactgtaaaccccatagtgctatcctcttccccccagaaaacaatcatgatcgaagtggaaccaccatttggagactcctcgactcggaccgatg

SEQ ID NO: 7489 - DNA, 203 bp, Homo sapiens
ggcgcgccagtccttcatcatcgctggaacaggcgaaccaagggcgcactaccactggaggaaatcaggaagcagcattggggcagcgtttgctaccaccatcaagggagccaggcgacttgccgtgatcggtgatgacgcatgggacttcggctctgtgggaggaatattaaactcagttgggaaagcgactcggaccgatg

SEQ ID NO: 7490 - DNA, 203 bp, Homo sapiens
ggcgcgccagtcctgagtcagatcagttggcaggttggaacatgaaatgtggagagccaatgctagggagataaacgccatccttcttgagaatgaaaagaacctgagtgttgtcgtcttggaaagtgaatactacagaaaggccaagaacctgatgcccataggcgacgaaatgccatttggatggacgactcggaccgatg

SEQ ID NO: 7491 - DNA, 203 bp, Homo sapiens
ggcgcgccagtcctaatacactgaggactgtgatcagaaagtgattggagccgcggtcaaaggagaattagccgctcatagtgatctaggctattggattgagagcaggtcaaaaaacggtagctgggaacttgaacgtgcttatctactagaatcaaaatcatgcagctggcccgcgacccacacaccgactcggaccgatg

SEQ ID NO: 7492 - DNA, 203 bp, Homo sapiens
ggcgcgccagtccttttggaatggaggagtggaggaatcagagttgataatacccaagagtagagcaggcccagtgtcacaccacaacaccagaaaaggctaccataaccaaattaaaggaccatggcaccttaccccattggagatcaggtttgaaagttgcccaggaacgaccgttgtgactaccgcgactcggaccgatg

SEQ ID NO: 7493 - DNA, 203 bp, Homo sapiens
ggcgcgccagtcctctctccatgaggccatggctgcagttggcattctatgtgccctctttggagccctggcggaaactgaggttgacttggctggaccgttggccgcggctgggctcatcgtcatggcttatgttatctcaggcagaagcaatgatctgagtatcaaaaaagttgaggatgtgaaatcgactcggaccgatg

SEQ ID NO: 7494 - DNA, 203 bp, Homo sapiens
ggcgcgccagtcctggagtgatgaagcagaagtcactggagagagtgtcagctaccacgtgagcctagatgttcgaggagacccaacattaacggaggactcaggacctggactggaaaaggtgctgctgaaggttggattaatggcaattagcgggatttaccccgtggccattcccttcgccttggcgactcggaccgatg

SEQ ID NO: 7495 - DNA, 203 bp, Homo sapiens
ggcgcgccagtcctgagcttggttctttctagaaaagaggtgcaagcgcgcgggagctctttgggacatcccttccccgcgggaagcaaagccagccaaggttgaggacggagtctaccgcatcttttctaggaagctgtttggcgaaagccaaattggagcaggcgttatggtaaagggcactttcccgactcggaccgatg

SEQ ID NO: 7496 - DNA, 203 bp, Homo sapiens
ggcgcgccagtcctaagtaaggcacattcaaacgaaacctggaatcttcaaaaccagtgagggagaaatcggggctctcgaccttgactgcatggctggaacttctgggtctccaatcgtgaacaagaacggggaagtggttggactgtatggaaatggtgttctcattaaaggggatcgctacgtgacgactcggaccgatg

SEQ ID NO: 7497 - DNA, 203 bp, Homo sapiens
ggcgcgccagtccttcttggcccctacccgtgtggtggcttcagaaatgtatgaagccttaagaggagagcctattagatacatgactccagcggtgcagagtgagagaactggaaatgaaatagtcgatttcatgtgtcactcgactttcaccatgaaactgttccaaggagtcagagttcccaattcgactcggaccgatg

SEQ ID NO: 7498 - DNA, 203 bp, Homo sapiens
ggcgcgccagtcctcacaaagaagaggaaggattggtagaaaccctgaaaagcttggagacatctatgcttacagtggaaatgtgagctcagacaacgaaggacacgtgagctggacagaagctagaatgttgttggacaacgtccatgttcaaggaggagtggtggcccaactgtatacgcctgaaacgactcggaccgatg

SEQ ID NO: 7499 - DNA, 203 bp, Homo sapiens
ggcgcgccagtccttgttattggaaaacaaccaggaaatagaagtgtggactaggcaaggacaaaggagagtgttgaaaccacggtggttagacggtagaattacttctgaccacttgaacttgaaaagctttaaggaatttgcatccgggaaaaggtcagccttgagcatccttgacttgattgcggcgactcggaccgatg

SEQ ID NO: 7500 - DNA, 203 bp, Homo sapiens
ggcgcgccagtccttagttctggttagaggaaaaggaccagggaagttggcgtttgggatggtttccatcggcgtgatgacctggctgttgtggtctgcaggagtcgacccagggaagatcgcagctgccgttatcctggtctttctgctgctcgtggtgctgattcctgaacctgaaaagcagaggtcgactcggaccgatg

SEQ ID NO: 7501 - DNA, 203 bp, Homo sapiens
ggcgcgccagtcctctgtgcaggacaaccagttagctatgctcatgttactcatagcgaccatcctaggaggggtggcagcaaatgaaatgggatggctggaaaaaacaaaagcagatctgtcatgggttgtgagagggaggagctcgaccaccaccccggtggttgaattggacatgaaacctgccacgactcggaccgatg

SEQ ID NO: 7502 - DNA, 203 bp, Homo sapiens
ggcgcgccagtcctctgcttggacactgtacgcgttggcaacaacgcttctcactcccctttttcagcatttgattgtcactaaatatgccaatatttctttgatggctattgcttcacaagctggaaccctctttagcatggacagtggtatccccttctcctccattgagttgagtgtgcctttgccgactcggaccgatg

SEQ ID NO: 7503 - DNA, 203 bp, Homo sapiens
ggcgcgccagtccttcgcccttgggtgctggacccagataacaccctgtagtcttattctcgcatgcgtgctcttgtcaacgcactatgcgattttgctccccggcatgcaggcacaggcagctcgagatgcccagagaaggacagcagccggcataatgaagaacgcagtggttgatggcatcgtggcgactcggaccgatg

SEQ ID NO: 7504 - DNA, 203 bp, Homo sapiens
ggcgcgccagtcctagatgaataccttggaattccaccgatacagacggagccacatcatggaagttgaccgagagccagcgagagctgccctcaagtcaggggactttactagaggagctgccgtatcaagagggagtgccaaattaaggtggatgcatgagcgaggatacatccgactgcatgatacgactcggaccgatg

SEQ ID NO: 7505 - DNA, 203 bp, Homo sapiens
ggcgcgccagtcctatggcagttatgtcgtgaagccttcaggaagcgcctcctcccaggtgaacggcgtggtcaagctgttgtcgaaaccatgggatgtgagctcagaagtcacgggaatgtccatgaccgacacaaccccctttggccaacagagagtgttcaaggaaaaagttgacaccaaggcgccgactcggaccgatg

SEQ ID NO: 7506 - DNA, 203 bp, Homo sapiens
ggcgcgccagtcctacacccgaatcaccgagtgtgacttgaggaatgaagcgcacatcatggaatacatggaaaatgaacatcgaaagctagcgcgtgccatctttgaacttacctacaaacacaaagttgtgaaagtgatgagaccaggaaaaggagtaccccttatggacatcatttcacgagaagcgactcggaccgatg

SEQ ID NO: 7507 - DNA, 203 bp, Homo sapiens
ggcgcgccagtcctaccacttccacagacttcaaatgaaagatggtagagagctagtggtaccatgtcgttctcaagatgagctaattggaagggccagggtgacgcagggtcctggagacctcatgagctcagcatgtctggccaaggcctatgcccagatgtggcagctgctgtatttccacagaacgactcggaccgatg

SEQ ID NO: 7508 - DNA, 203 bp, Homo sapiens
ggcgcgccagtcctggagccaagcccggaggggatccggcccccgacttccggaggttgccacaccttgtaaatatgtacatacagagtcagatccgaaaggccaccagtttggtgcagaactggtgctatctgtgaacactcccaggaggactgggtaaacaaagccattagggaccatcacggccccgactcggaccgatg

SEQ ID NO: 7509 - DNA, 203 bp, Homo sapiens
ggcgcgccagtcctgagggggagaagaacgcgaactcccccaaaggactagaggttagaggagacccgtgattagggagatgagggagcccatctcagggaaagctgtaaccctgggggaaggactagaggttagaggagaccctcccacaaagaagcgcaaacacaaaacagcatattgacacctggcgactcggaccgatg

SEQ ID NO: 7510 - DNA, 203 bp, Homo sapiens
ggcgcgccagtcctgcgagcagacgtgttcggggggctcaccgcccggtaatcctgggagacgtcccaggatcaggggaggaccagggacgcctggtggacccctcggcagaggatcattgtgttctgatcccaccgccgcgtctagagaggcgcgctctgccatctgactctttctcttgcctctaccgactcggaccgatg

SEQ ID NO: 7511 - DNA, 203 bp, Homo sapiens
ggcgcgccagtcctgacctcgcccagagtcccccaccatgggtgccgccctccgccaagatcgctgttgtctctagtccagagaacactcaaggaccatctgcggggaggccatccgctcctccccgaccccccatctacccggcaacagacgacttgctccttctctctgagcccccgccctatccgcgactcggaccgatg

SEQ ID NO: 7512 - DNA, 203 bp, Homo sapiens
ggcgcgccagtcctgcggccctgccacctcctctggcccctccggcggtgggaccggcgccgggccaggcgcccgatagttccgatcctgagggaccagccgcggggaccaggagtcgccgtgcccgcagtccggcagacgactcgggtcctgactccactgtgattttgcccctccgagccataggacgactcggaccgatg

SEQ ID NO: 7513 - DNA, 203 bp, Homo sapiens
ggcgcgccagtcctgcgtactgtaaagagaagggtcactgggacgaggagatcgccccggcgtgtactgggaggtagacttcacagaagtgaagcctggccggtatggaaacaggtatctgctggtattcatagatactttttccggatgggtagaagcttttcctaccaaaactgaaacggccctgacgactcggaccgatg

SEQ ID NO: 7514 - DNA, 203 bp, Homo sapiens
ggcgcgccagtccttgggtcccgatgataattttctccctgtcttatttactcatttaaaggctttagaagttgtgaggacccagatctgggaccagatcaaggaggtgtacaagcccggtaccgtggcaatcccccacccgttccaggtcggggaccaagtgcttgtcagacgccatcgacccggcacgactcggaccgatg

SEQ ID NO: 7515 - DNA, 203 bp, Homo sapiens
ggcgcgccagtcctgctgagctggacctgaacatgacccgctcccattctggtggcgagctggagagcttggctcgtgggaaaaggagcctgggttccctgagcgttgccgagccagccatgattgccgagtgcaagacacgaaccgaggtgttcgagatctcccggcgcctcatcgaccgcaccaatcgactcggaccgatg

SEQ ID NO: 7516 - DNA, 203 bp, Homo sapiens
ggcgcgccagtcctaagacggcactgaaggagaccctcggagcctaagggcatcggcaggagaatatgggcagcgggtctcctgccagcggcctccagcatcttgcccagcagctcaagaagagaaaaaaggactgaactccaccaccatcttcttcccttaactccaaaaacttgaaataagagtgtcgactcggaccgatg

SEQ ID NO: 7517 - DNA, 203 bp, Homo sapiens
ggcgcgccagtcctgaaagagactgatagggtcgctgtttgaaaaaaactggctccttcctctgcacctggcctgggccacacccaagtgctgtggactggcccgaggggccctgcacgtggccctgagcacctctcagcgtagcctgcctagtccctagacccctagccagctccaaggggaggcaccgactcggaccgatg

SEQ ID NO: 7518 - DNA, 203 bp, Homo sapiens
ggcgcgccagtcctctccaagcaggccaggctacctcgggggtctagagcgccagaagaaccaaaactggtatgaagggtggttcaatagctccccttggttcactaccctactatcaaccatcgccgggcccctattactcctccttctgttgctcattctcgggccctgcatcatcaataggttagcgactcggaccgatg

SEQ ID NO: 7519 - DNA, 203 bp, Homo sapiens
ggcgcgccagtcctgcaaggcacggaaattaccctggtaaaaagcccaaagcataggggaagtacagctaaaggtcaagtcgagaaaaacaaggagaacagggccaaacaggatatctgtggtcatgcctgggccggcccagggccaaagacagatggttcccagaaatagatgagtcaacagcagttcgactcggaccgatg

SEQ ID NO: 7520 - DNA, 203 bp, Homo sapiens
ggcgcgccagtccttctagggtgcccctcaactgtttcaagaactcccacatgaccggagctcacccctggccttatttgaactgaccaattaccttgcttctcgcttctgtacccgcgctttttgctataaaatgagctcagaaactccactccgcgcgccagtcctccgagagactgagtcgcccgcgactcggaccgatg

SEQ ID NO: 7521 - DNA, 203 bp, Homo sapiens
ggcgcgccagtccttataaaatgagctcagaaactccactccgcgcgccagtcctccgagagactgagtcgcccgggtacctgtgtgttcaataaaacctcttgctatttgcatccgaagccgtggtctcgttgttccttgggagggtctctcctaactgattgactgcccacctcgggggtctctcacgactcggaccgatg

SEQ ID NO: 7522 - DNA, 203 bp, Homo sapiens
ggcgcgccagtccttttcaaagggggccctggggtctttgtcgcggagatgcgctagcatcttcgcggtaaagaacaccccaggggtaacccctttgaacgcgggactgcgatagtgccaccccacgtctttcccactcctaacccgactcccacctcgggtccaatgaaaggaccaaataattcatccgactcggaccgatg

SEQ ID NO: 7523 - DNA, 203 bp, Homo sapiens
ggcgcgccagtccttggaatatgacagggttattttctttatcttatttctactttcacgggttctatccgtgaaaagggtacgtgttgccccttccttcttcggagaattcacacggcggtctttccgtctctcgacaagtgtgaatgcaacatgccggaaacggtgaagaaaacagttttctgcggcgactcggaccgatg

SEQ ID NO: 7524 - DNA, 203 bp, Homo sapiens
ggcgcgccagtcctaagtctagagtgcgcatcgaaacagctgtagcgacctcacagtagcagcggactcccctcttggcgacaagagcctctgcggccaaaagccccgtggataagatccactgctgtgagcggtgcaaccccagcaccctgattcgatgaacgttctttacggaaccagaggatggtcgactcggaccgatg

SEQ ID NO: 7525 - DNA, 203 bp, Homo sapiens
ggcgcgccagtccttaccattgattcaagatgtgttgatggaaccacaaggcaactccaactcctcggacaaaaacaattctcagtcgtcaggtaatgaaggtgtcattattaacaattattactcaaaccaatatcaaaattcaattgacctttccgctaatgctaacggcgttggcaaagaaaacacgactcggaccgatg

SEQ ID NO: 7526 - DNA, 203 bp, Homo sapiens
ggcgcgccagtcctaagtaccatacgtgaacatttgcccaacatcatcctggacacagcatgcaaattggaccattgtggtggctgttctttcccctttgcagtacgctgcaggctcagccacggaagtggacattactctgtccatacaacctgtgaaaccagtattcaatggcttaagacactcagcgactcggaccgatg

SEQ ID NO: 7527 - DNA, 203 bp, Homo sapiens
ggcgcgccagtcctttgtctttacgggtagtgctatgacaaaaggaaaattcttgatatcgtacacaccacctggtgcagggaaaccaacgactagagaccaagccatgcaagccacctatgctatttgggatctaggattgaattctagttacaacttcactgtccctttcatttcccccacacattcgactcggaccgatg

SEQ ID NO: 7528 - DNA, 203 bp, Homo sapiens
ggcgcgccagtcctataactctttttctttggaatctgcttcaggagttatgaacaatattctcttgacaccattgcctagtgacagactcaaggaaaacgagtttggtttagatgagcaacatagatggttaagctttcaatcagcaactagctcaacccccccttatagaactaaacaagactggacgactcggaccgatg

SEQ ID NO: 7529 - DNA, 203 bp, Homo sapiens
ggcgcgccagtcctcacacatgtggctggttggagctggttctacgaatcaaatttcgtttgttctgccttatacttctccactatctgtcctacctgctgtttggtttaacggattctctgacttttctaacacctcacgctttggtgttgctccaacatctgacttcggaagattgtttgtacaggcgactcggaccgatg

SEQ ID NO: 7530 - DNA, 203 bp, Homo sapiens
ggcgcgccagtccttttacgcaatgcactcggctggtggtggcggtatggctgctgctacgataatcactcaggaaatggttgaagctgctgagaaggccttagattgtctaactcctcaaggtgcaatagttgaaattggtattgatacggttgtgcacgttccgcgaaaaaccaaactacgcaggacgactcggaccgatg

SEQ ID NO: 7531 - DNA, 203 bp, Homo sapiens
ggcgcgccagtcctcagtagcgcacccctgcttccaaccaaagtttgaacctgccgtcctttcacgttacgaccctaggactacaaaagacgtagaccaggtcgctttctctaagcacacaactaatttggaagagcttccatctgttttctccatggttgcaaaagaatatgctaatagagtgtttacgactcggaccgatg

SEQ ID NO: 7532 - DNA, 203 bp, Homo sapiens
ggcgcgccagtcctgatcggatcgcaacgtgttacccaggaatccacttgggtgtacgcggccgttctgacgttggaattctgtagatgaaagttagctaggagcttttaattggaaatgagaacaaaaaaaaaaaaaaaaaaaaaaaaaaaaaaaaaaaaaaaaaaaaaaaaaaaaaaaaaaaaaaacgactcggaccgatg

SEQ ID NO: 7533 - DNA, 203 bp, Homo sapiens
ggcgcgccagtcctggtgttccagactagttcctgaggtaccaagttgtgaggggctatgggaaaacccctttgatccacactgcctgatagggtcgcggctggtcgagtcccatacactataataccagttgactttcatgcaatggacactctaactaaaaacattgaagatgaaactgtcaagatcgactcggaccgatg

SEQ ID NO: 7534 - DNA, 203 bp, Homo sapiens
ggcgcgccagtcctacaatgtcctcggcccttcaacgaccagggtaagaagaaaccacggcggaggccaatccataaaccaaagagccctcctcaggaatctcgcatcatcatccagcctgggccaggagctgcaaatctatccaattccagtgtggtcaccatggctgagagtgtggctctagctaacgactcggaccgatg

SEQ ID NO: 7535 - DNA, 203 bp, Homo sapiens
ggcgcgccagtccttgaaggtactgcagttgactattcaacagctgggtgtgcatcatctgtggatgatatagtcatggtgcttagacgctggcagattgtgggtgattttcagtgggctaacacagtgacccctggcaacaggattagtaggtttcaggtggtttttaatcgaatgccaacttttgccgactcggaccgatg

SEQ ID NO: 7536 - DNA, 203 bp, Homo sapiens
ggcgcgccagtccttacgccagccaccctcatcttgcccttcactaataccacatggcgaaaaagcacacgtgaaaattatggctatataacctggcatgttgtgaatcgcctgacagtcaactcaacatccccatccacaattagctgtgtcattttgatgcgagttggtaaggattttcagtttaccgactcggaccgatg

SEQ ID NO: 7537 - DNA, 203 bp, Homo sapiens
ggcgcgccagtcctagctcccctgtatgggaacctgcagatggccgccaatgatcagggtgattccaatcagcttggtgacgatgaaccagtgtgttttctcaattttgagactgcaaatgtgccaatacaaggggagtcgcacaccttggtgaaacatttttttggccgtcaatggctggttcgtaccgactcggaccgatg

SEQ ID NO: 7538 - DNA, 203 bp, Homo sapiens
ggcgcgccagtccttgttcaacatactggtgaggtacaagagatggatttgccagtgcctgaccggggtcatgcatctctactgcgcttctttgcctatttctctggagaagtgattctgaccattgtcaataatggaacaacaccctgcatggttgcacactcttatacaacagacaatctcacttccgactcggaccgatg

SEQ ID NO: 7539 - DNA, 203 bp, Homo sapiens
ggcgcgccagtccttgaatatgctgtcactgccatggggggtattcttatcccagcgaactctgccaagaatattagtatcccattttattctgtcacacctctacgccccacccgacccatgccagcatctcaggggggtggcttgacttttggcaggttgtatatctggacacaatctgggagcatcgactcggaccgatg

SEQ ID NO: 7540 - DNA, 203 bp, Homo sapiens
ggcgcgccagtcctccttcgcccatttcgcttctgtttgagacttaaaacacttgcctttgagctccatttggaaattgaatcagaccaatttcgaaatgtcagagacctcactactgagggagttgaacccaatccaggccctattatggttgttggtaaatcaggatccggcaaaagtgtattgtgcgactcggaccgatg

SEQ ID NO: 7541 - DNA, 203 bp, Homo sapiens
ggcgcgccagtcctctatatttgtgaacataccactcgtcctaagcaccaaaaattggttgagatggtctctggcaccttgaatcaattaaatggcatctccagtgctaaagatttgtgcttgagattgcagcatgtcttgaataagcttcaccaggtcaattttgagccagaattggaatggacacacgactcggaccgatg

SEQ ID NO: 7542 - DNA, 203 bp, Homo sapiens
ggcgcgccagtcctccgacccgaacctcttggtatttggatttcaggtgggccaggtgttgggaagagttttttatccaactatatagttaaacaaatagcaaagaaaaggcattggaagtcttatgcaaatccaacagggtcaaagcatatggatgggtatgtttcacaggaaatccatgtttttgacgactcggaccgatg

SEQ ID NO: 7543 - DNA, 203 bp, Homo sapiens
ggcgcgccagtccttcctgacgcactagagcgtaggtttccaatccgactcaatattaggccccttcagaaatacaatcataaaggtaggttggatgttgctactgcaatgagggatggcagtctacagaatggcacctgctgggaacgtgacattggtgggttgggccttgaacactggaatccaatcgactcggaccgatg

SEQ ID NO: 7544 - DNA, 203 bp, Homo sapiens
ggcgcgccagtcctcaatggagacatacttgtagatgagatcctctcagagctgcaggttagacatgaagtggccaattttatgaatcagggcaaggtgcgtaggctaagtgatttggacacaatgtttgaagaattggatgaattaaaacttgattttgattttgaccgcctggaagaacaggctagcgactcggaccgatg

SEQ ID NO: 7545 - DNA, 203 bp, Homo sapiens
ggcgcgccagtccttgccacaggattggcagttggtggcaagtatgtcttaacttttggacattctaagtttactcaattggactccatcagggatatggtctttaattcacctgccaaaggaacaccaattacttatgatgggctaccaacagatctccaactcttggattgtgacataccccaccacgactcggaccgatg

SEQ ID NO: 7546 - DNA, 203 bp, Homo sapiens
ggcgcgccagtcctatttaaagatgtgtctaagctcatagccacagatgattaccgaggtaatggctggttggtgtggaaagatgatgatcaatatatgattcaagaggtcactaaaatcagaccctttggacaaactacaactgcttctggcacaacatcatgccaaacatacatttataattgtaacgactcggaccgatg

SEQ ID NO: 7547 - DNA, 203 bp, Homo sapiens
ggcgcgccagtcctctacatttgttccaagctgaaagctcgctgtcctgtcttggaaatacaaccatggggtgttgccaggatgcgagcatatactgcctgcatgattatataacctgcaggcatagcagttccagggatctgctgtagtcaattaaaacctgggctcttcgtggttacggggttttccgactcggaccgatg

SEQ ID NO: 7548 - DNA, 203 bp, Homo sapiens
ggcgcgccagtcctacttttagaatagttttgctaatcaattccccgtctaggttgatttagttagtatttagtataagaccaatggtgatataaagaccacacctaatctccactttcggtgtgtgaccctaagccattggacttctttactttactattcctccccaccctaaaaaaaaaaaaaaacgactcggaccgatg

SEQ ID NO: 7549 - DNA, 203 bp, Homo sapiens
ggcgcgccagtcctgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcaccgactcggaccgatg

SEQ ID NO: 7550 - DNA, 203 bp, Homo sapiens
ggcgcgccagtcctaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaagcgactcggaccgatg

SEQ ID NO: 7551 - DNA, 203 bp, Homo sapiens
ggcgcgccagtcctgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcgactcggaccgatg

SEQ ID NO: 7552 - DNA, 203 bp, Homo sapiens
ggcgcgccagtcctatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtcgactcggaccgatg

SEQ ID NO: 7553 - DNA, 203 bp, Homo sapiens
ggcgcgccagtcctctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggccgactcggaccgatg

SEQ ID NO: 7554 - DNA, 203 bp, Homo sapiens
ggcgcgccagtcctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgacgactcggaccgatg

SEQ ID NO: 7555 - DNA, 203 bp, Homo sapiens
ggcgcgccagtcctgcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacgactcggaccgatg

SEQ ID NO: 7556 - DNA, 203 bp, Homo sapiens
ggcgcgccagtcctcatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcgactcggaccgatg

SEQ ID NO: 7557 - DNA, 203 bp, Homo sapiens
ggcgcgccagtcctcgcatctgtgcatggccagataggagcggctctgctggtaatgatcactctctttactctcacccccgggtataagacccttctcagccggtttttgtggtggttgtgctatcttctgaccctgggggaagctatggtccaggagtgggcaccacctatgcaggtgcgcggtggcgactcggaccgatg

SEQ ID NO: 7558 - DNA, 203 bp, Homo sapiens
ggcgcgccagtcctccgtgatggcatcatatgggccgtcgccatattctacccaggtgtggtgtttgacataaccaagtggctcttggcggtgcttgggcctgcttacctcctaaaaggtgctttgacgcgcgtgccgtacttcgtcagggctcacgctctactgaggatgtgcaccatggcaaggcacgactcggaccgatg

SEQ ID NO: 7559 - DNA, 203 bp, Homo sapiens
ggcgcgccagtcctctccagtgctgagggggacttagtagggtggcccagcccccctgggactaaatctttggagccgtgcacgtgtggagcggtcgacctgtacctggtcacgcggaacgctgatgtcatcccggctcgaagacgcggggacaaacggggagcgctactctccccgagacctctttccgactcggaccgatg

SEQ ID NO: 7560 - DNA, 203 bp, Homo sapiens
ggcgcgccagtcctcaccttgaaggggtcctcaggaggcccggtgctatgccccaggggccacgctgtcggagtcttccgggcagctgtgtgctctcggggcgtggctaagtccatagatttcatccccgttgagacactcgacatcgtcacgcggtcccccacctttagtgacaacagcacaccacccgactcggaccgatg

SEQ ID NO: 7561 - DNA, 203 bp, Homo sapiens
ggcgcgccagtccttgatcaagcagagacagctggggtcagactaactgtgctggctacagctacgccccctgggtcagtgacaaccccccaccccaacatagaggaggtggcccttgggcaggagggcgagatccccttctatgggagggcgattcccctgtcttacatcaagggaggaagacatctcgactcggaccgatg

SEQ ID NO: 7562 - DNA, 203 bp, Homo sapiens
ggcgcgccagtcctgatcttctgccattcaaagaaaaagtgtgacgagctcgcggcggcccttcggggtatgggcttgaactcagtggcatactacagagggttggacgtctccgtaataccaactcagggagacgtagtggtcgtcgccaccgacgccctcatgacagggtatactggggactttgacgactcggaccgatg

SEQ ID NO: 7563 - DNA, 203 bp, Homo sapiens
ggcgcgccagtcctagcctcaggaatgtttgacagtgtagtgctctgtgagtgctacgacgcaggggccgcatggtatgagctcacaccatcggagaccaccgtcaggctcagggcgtatttcaacacgcccggtttgcctgtgtgccaagaccatcttgagttttgggaggcagttttcaccggcctcgactcggaccgatg

SEQ ID NO: 7564 - DNA, 203 bp, Homo sapiens
ggcgcgccagtcctcacacacatagatgcccacttcctttcccaaacaaagcaatcgggggaaaatttcgcatacttaacagcctaccaggctacagtgtgcgctagggccaaagccccccccccgtcctgggacgtcatgtggaagtgtttgactcgactcaagcccacactcgtgggccccacacccgactcggaccgatg

SEQ ID NO: 7565 - DNA, 203 bp, Homo sapiens
ggcgcgccagtcctcatcatcggccgcttgcacattaaccagcgagccgtcgttgcgccggacaaggaggtcctctatgaggcttttgatgagatggaggaatgtgcctctagggcggctctcattgaagaggggcagcggatagccgagatgctgaagtccaagatccaaggcttattgcagcaagccgactcggaccgatg

SEQ ID NO: 7566 - DNA, 203 bp, Homo sapiens
ggcgcgccagtcctcaccagtccgctgtcaacaagcaccactatccttctcaacattttggggggctggctagcatcccaaattgcaccacccgcgggggccactggcttcgttgtcagtggcctagtgggagctgccgtaggcagtataggcttaggtaaggtgctagtggacatcctggcagggtacgactcggaccgatg

SEQ ID NO: 7567 - DNA, 203 bp, Homo sapiens
ggcgcgccagtccttggtgcgggcatttcgggggctctcgtcgcattcaagatcatgtctggcgagaagccctccatggaggatgtcgtcaacttgctgcctggaattctgtctccgggtgccttggtagtgggagtcatctgcgcggccattctgcgccgacacgtgggaccgggggaaggcgccgtcgactcggaccgatg

SEQ ID NO: 7568 - DNA, 203 bp, Homo sapiens
ggcgcgccagtcctccaatggatgaatagactcattgcctttgcttccagaggaaatcacgtcgcccccacccactacgtgacggagtcggatgcgtcgcagcgtgtgacccaactacttggctcccttaccataaccagcctgctcagaagactccacaactggattactgaggactgccccatccccgactcggaccgatg

SEQ ID NO: 7569 - DNA, 203 bp, Homo sapiens
ggcgcgccagtcctatgcggcggctcgtggctccgcgatgtgtgggactgggtttgcaccatcctaacagactttaaaaattggctgacctccaaattattcccaaagatgcccggcctcccctttgtctcctgtcaaaaggggtacaagggcgtgtgggccggcactggcatcatgaccacacggtgcgactcggaccgatg

SEQ ID NO: 7570 - DNA, 203 bp, Homo sapiens
ggcgcgccagtcctctcagagtacgcggaggtgacgcagcacgggtcataccactacataacaggactcaccactgataacttgaaagtcccctgccaactaccctctcccgagttcttttcctgggtggacggagtgcagatccataggtttgcccccacaccgaagccgtttttccgggatgaggtcgactcggaccgatg

SEQ ID NO: 7571 - DNA, 203 bp, Homo sapiens
ggcgcgccagtcctgagccagctatcggcaccatcgctgcgagccacctgcaccacccacggcaaagcctatgatgtggacatggtggatgctaacctgttcatggggggcgatgtgactcggatagagtctgggtccaaagtggtcgttctggactctctcgacccaatggtcgaagaaaggagcgacgactcggaccgatg

SEQ ID NO: 7572 - DNA, 203 bp, Homo sapiens
ggcgcgccagtcctccttgagccttcgataccatcagaatacatgctccccaagaagaggttcccaccagctttaccggcctgggcacggcctgattacaacccaccgcttgtggaatcgtggaaaaggccagattaccaaccggccactgttgcgggctgtgctctccctcctcctaggaaaacccccgactcggaccgatg

SEQ ID NO: 7573 - DNA, 203 bp, Homo sapiens
ggcgcgccagtcctggccctttcggagacaggttccatctcttccatgccccccctcgagggggagcttggagatccagacctggagcctgagcaggtagagccccaaccccccccccaggggggggtggcagctcccggctcggactcggggtcctggtctacttgctccgaggaggacgactccgtcgactcggaccgatg

SEQ ID NO: 7574 - DNA, 203 bp, Homo sapiens
ggcgcgccagtcctgaagatggccctttatgacattacacaaaaacttcctcaggcggtgatgggggcttcttatggattccagtattcccccgctcagcgggtagagtttctcttgaaagcatgggcggaaaagaaggaccctatgggtttttcgtatgatacccgatgctttgactcaaccgtcaccgactcggaccgatg

SEQ ID NO: 7575 - DNA, 203 bp, Homo sapiens
ggcgcgccagtccttagcatggggaacaccatcacatgctacgtgaaagccttagcggcttgtaaagctgcagggataatcgcgcccacaatgctggtatgcggcgatgacttggttgtcatctcagaaagccaggggaccgaggaggacgagcggaacctgagagccttcacggaggctatgaccagcgactcggaccgatg

SEQ ID NO: 7576 - DNA, 203 bp, Homo sapiens
ggcgcgccagtcctcgtttgcggtcgatatctcttcaattgggcggtgaagaccaagctcaaactcactccattgccggaagcgcgcctcctggatttatccagctggttcaccgtcggcgccggcgggggcgacatttatcacagcgtgtcgcgtgcccgaccccgcttattgctctttggcctactcgactcggaccgatg

SEQ ID NO: 7577 - DNA, 203 bp, Homo sapiens
ggcgcgccagtcctctggggtgaccgggtcctttcttggagcaacccgctcaatacccagaaatttgggcgtgcccccgcgagatcactagccgagtagtgttgggtcgcgaaaggccttgtggtactgcctgatagggtgcttgcgagtgccccgggaggtctcgtagaccgtgcaacatgagcacacgactcggaccgatg

SEQ ID NO: 7578 - DNA, 203 bp, Homo sapiens
ggcgcgccagtcctggtaaagtcatcgataccctaacgtgcggattcgccgacctcatggggtacatcccgctcgtcggcgctcctgtaggaggcgtcgcaagagccctcgcgcatggcgtgagggcccttgaagacgggataaatttcgcaacagggaacttgcccggttgctccttttctatcttccgactcggaccgatg

SEQ ID NO: 7579 - DNA, 203 bp, Homo sapiens
ggcgcgccagtcctcttcttgctctgttctcttgcttaattcatccagcagccagtctagagtggcggaatacgtctggcctctacgtccttaccaacgactgttccaatagcagtattgtgtatgaggccgatgatgtcattctgcacacacccggctgtgtaccttgtgtccaggacggcaatacacgactcggaccgatg

SEQ ID NO: 7580 - DNA, 203 bp, Homo sapiens
ggcgcgccagtcctagacctcgacgccatcaaacggtccagacctgtaactgctcgctgtacccaggccatctttcaggacatcgaatggcttgggatatgatgatgaattggtcccccgctgtgggtatggtggtggcgcatgtcctgcgtttaccccagaccttgttcgacataatggccggggcccgactcggaccgatg

SEQ ID NO: 7581 - DNA, 203 bp, Homo sapiens
ggcgcgccagtcctggatggggccccttaacagatgctaacatcaccggtccttctgatgacagaccatactgctggcactacgcacctagaccttgtgacattgtcccggcatcaagtgtctgcggccctgtgtactgcttcacaccatcgccagtggtcgtaggcactactgatgccaggggcgtgcgactcggaccgatg

SEQ ID NO: 7582 - DNA, 203 bp, Homo sapiens
ggcgcgccagtcctgatcttttctgccccactgactgcttcaggaaacatcccgagaccacgtacagccggtgtggtgcagggccctggttgacacctcgttgcatggttgactacccataccggctttggcattacccatgtacagtcgatttcagattgttcaaggtgaggatgtttgtgggtgggcgactcggaccgatg

SEQ ID NO: 7583 - DNA, 203 bp, Homo sapiens
ggcgcgccagtcctgtcacgctgaacgccgtcgctgctgctgggacacatggtatcggctggtacctggtagctttttgcgcggcgtggtacgtgcggggtaaactcgtcccgctggtgacctacagcctgacgggtctttggtccctagcattgctcgtcctcttgctcccccaacgtgcgtatgctcgactcggaccgatg

SEQ ID NO: 7584 - DNA, 203 bp, Homo sapiens
ggcgcgccagtcctgggagtagggatggtgtcatcctgctaacaagcctgctttatccatccttaatttttgacatcactaagctgctgatggcagtattgggcccattatacttaatacaggctaccattactaccaccccctactttgtgcgtgcgcatgtactggtccgcctttgcatgctcgtgcgactcggaccgatg

SEQ ID NO: 7585 - DNA, 203 bp, Homo sapiens
ggcgcgccagtcctcgctccgtgataggggggaaatacttccagatgatcatactgagcattggcagatggttcaacacctacctatacgaccacctagcgccaatgcaacactgggccgctgctggtctcaaagacctagcagtggccactgaacctgtaatatttagtcccatggaaatcaaggtccgactcggaccgatg

SEQ ID NO: 7586 - DNA, 203 bp, Homo sapiens
ggcgcgccagtcctatcacctggggtgcggatacagcggcttgcggagatattctttgcgggctgcccgtctctgcacgattaggccgtgaggtgttgttgggacctgctgatgactatcgggagatgggctggcgtctgttggccccgattacagcatacgcccagcaaactaggggccttcttgggcgactcggaccgatg

SEQ ID NO: 7587 - DNA, 203 bp, Homo sapiens
ggcgcgccagtcctactattgtgactagcttgactggcagagacaagaacgtggtgaccggtgaagtgcaggtgctttctacggctacccagaccttcctaggtacaacagtagggggggttatatggactgtttatcatggagcaggttcgagaacgctcgcgggcgccaaacatcccgcgctccaacgactcggaccgatg

SEQ ID NO: 7588 - DNA, 203 bp, Homo sapiens
ggcgcgccagtcctctcgcctgtctcaagggttcctctggaggtcccgttatgtgcccttcggggcatgttgcggggatctttagggctgctgtgtgcaccagaggtgtagcaaaatccctacagttcataccagtggaaacccttagcacgcaggctaggtctccatctttctctgacaattcaactcgactcggaccgatg

SEQ ID NO: 7589 - DNA, 203 bp, Homo sapiens
ggcgcgccagtcctcctcctgctgttccacagagctatcaagtaggatacctccatgccccgaccggcagcggtaagagcacaaaggtcccggccgcttatgtagcacaaggatataatgtcctcgtactaaatccatcggtggcggccacattaggcttcggctccttcatgtcgcgtgcctatgggcgactcggaccgatg

SEQ ID NO: 7590 - DNA, 203 bp, Homo sapiens
ggcgcgccagtcctttcgattctgtcatagattgcaacgtggctgttgaacagtacgttgacttcagcctggaccccaccttttccattgagacccgcactgctccccaagatgcggtttcccgcagccaacgtcgcggccgaacgggtcgaggtagactcggtacgtaccgatatgtcgcctccggtcgactcggaccgatg

SEQ ID NO: 7591 - DNA, 203 bp, Homo sapiens
ggcgcgccagtcctacgccccttctatatcggctggggcctgtccaaaatgaaacctgcttgacacaccccatcacaaaatacctcatggcatgcatgtcagccgatctggaagtaaccaccagcacctgggtgttgctcggaggggtcctcgcagccctagcggcctactgcttgtcagtcggctgccgactcggaccgatg

SEQ ID NO: 7592 - DNA, 203 bp, Homo sapiens
ggcgcgccagtccttcagtcaccagtcccctgacgaccaaccaaactatgttttttaacatactcggggggtgggttgccacccatttggcagggccccagagctcctccgcgttcgtggtaagcggcttggcaggcgctgccatagggggtataggcctgggcagggtcttgcttgacatcctggcacgactcggaccgatg

SEQ ID NO: 7593 - DNA, 203 bp, Homo sapiens
ggcgcgccagtcctggatacggagctggtgtctcaggcgccttggtagcttttaagatcatgggaggagaatgccccactgctgaggacatggtcaacctgttgcccgccatactatctccgggtgctctcgtcgtcggtgtgatatgcgcagccatactgcgccgacacgtaggacctggggagggacgactcggaccgatg

SEQ ID NO: 7594 - DNA, 203 bp, Homo sapiens
ggcgcgccagtcctgcggtacagtggatgaacaggctcatcgcgttcgcatcccggggcaaccacgtctcaccgacgcactatgttcccgagagcgatgctgcggcaagggtcaccgcattgctgagttctctaactgtcacaagtctgctccggcggttacaccagtggatcaatgaagactacccacgactcggaccgatg

SEQ ID NO: 7595 - DNA, 203 bp, Homo sapiens
ggcgcgccagtcctagcccttgtagcgacgattggctacgtaccatctgggactgggtttgctcggtgttggccgacttcaaggcatggctctctgctaagattatgccagcgctccctgggctgcccttcatttcctgtcaaaagggatacaagggcgtgtggcggggggacggtgtgatgtcaacacgactcggaccgatg

SEQ ID NO: 7596 - DNA, 203 bp, Homo sapiens
ggcgcgccagtcctgctgccaacagctacgttgaggtgcgtcgggtgggggacttccattacatcacgggggccacagaagatgagctcaagtgtccgtgccaagtgccggctgctgagttctttactgaagtggatggagtgagacttcaccgctacgcccctccatgtaagcccctgttgagagatcgactcggaccgatg

SEQ ID NO: 7597 - DNA, 203 bp, Homo sapiens
ggcgcgccagtccttccgccagccaactatcagctccgtcgttgaaggccacttgccagacgcataggcctcatccagacgctgagctagtggacgccaacttgttatggcggcaagagatgggcagcaacattacacgggtggagtctgagacaaaggttgtggttcttgattcgttcgagcctctgcgactcggaccgatg

SEQ ID NO: 7598 - DNA, 203 bp, Homo sapiens
ggcgcgccagtcctccacggggcgctccaccggtgcctccccctcggaggaaaaggacaattcagctggacggctctaatgtgtccgcggcgctagccgcgctagctgaaaaatcattcccgtcctcgaaaccacaggaagagaatagctcatcctccggggtcgacacacagtccagcactacttcccgactcggaccgatg

SEQ ID NO: 7599 - DNA, 203 bp, Homo sapiens
ggcgcgccagtcctaaggtgcccccttctccgggaggggagtccgactcagagtcatgctcgtctatgcctcctctcgagggagagccgggcgacccggacttgagttgcgactcttggtccaccgttagtgacagcgaggagcagagcgtggtctgctgctctatgtcgtattcttggaccggcgcccgactcggaccgatg

SEQ ID NO: 7600 - DNA, 203 bp, Homo sapiens
ggcgcgccagtcctttaaaggaggtaaaggagcgagcgtctagggtaaaggctcgcatgctcaccatcgaggaagcgtgcgcgctcgtccctcctcactctgcccgatcgaagttcgggtatagtgcgaaggacgttcgctccttgtccagcagggccattaaccagatccgctccgtctgggaggaccgactcggaccgatg

SEQ ID NO: 7601 - DNA, 203 bp, Homo sapiens
ggcgcgccagtcctttgctggaagacaccacaactccaattccaaccaccatcatggcgaagaacgaggtgttttgcgtggaccccgctaaagggggccgcaagcccgctcgcctcattgtgtaccctgacctgggggtgcgtgtctgtgagaaacgcgccctgtatgacgtgatacagaagttgtcacgactcggaccgatg

SEQ ID NO: 7602 - DNA, 203 bp, Homo sapiens
ggcgcgccagtcctacagcggctgcaaaggccgcaaacctccggaacccggactttcttgtctgcggagatgatttggtcgtggtggctgagagtgatggcgtcgatgaggatagagcagccctgagagccttcacggaggctatgaccaggtattctgctccacccggagatgctccacaggccactcgactcggaccgatg

SEQ ID NO: 7603 - DNA, 203 bp, Homo sapiens
ggcgcgccagtcctaccaagaccaacctcactccattgccagccgctggccagttggatttgtccagctggtttacggttggtgtcggcgggaacgacatttatcacagcgtgtcgcgtgcccgaacccgccatttgctgctttgcctactcctactaacagtaggggtaggcatctttctcttgccacgactcggaccgatg

SEQ ID NO: 7604 - DNA, 203 bp, Homo sapiens
ggcgcgccagtcctacggttggtgtcggcgggaacgacatttatcacagcgtgtcgcgtgcccgaacccgccatttgctgctttgcctactcctactaacagtaggggtaggcatctttctcttgccagctcgatgagctggtaagataacactccatttcttttttgttttttttttttttttttttcgactcggaccgatg

SEQ ID NO: 7605 - DNA, 203 bp, Homo sapiens
ggcgcgccagtcctttcccgggtggtggccagatcgttggcggagtttacttgttgccgcgcaggggccccagattgggtgtgcgcgcgactcggaagacttcggagcggtcgcaacctcgtggaagacgccaacctatccccaaggcgcgtcgacccgagggaaggtcctgggcacaaccaggatatcgactcggaccgatg

SEQ ID NO: 7606 - DNA, 203 bp, Homo sapiens
ggcgcgccagtcctgtaggcgcccccgtgggtagcgtcgccagggccctggcacatggtgtcagggctttggaggacgggatcaattatgcaacagggaatctccccggttgctccttttctatcttcctcttggcacttctttcgtgcctgactgtccccgcttcggccgttaactatcgcaatgtccgactcggaccgatg

SEQ ID NO: 7607 - DNA, 203 bp, Homo sapiens
ggcgcgccagtccttcaggcatctaccatgtcaccaatgactgcccgaattcaagcatagtgtatgaggccgaccatcacatcatgcaccttccaggttgcgtgccctgcgtgagagaggggaatcagtcacgctgctgggtggcccttactcctaccgtcgcagcgccatacatcggcgcaccgcttcgactcggaccgatg

SEQ ID NO: 7608 - DNA, 203 bp, Homo sapiens
ggcgcgccagtcctacaggccacagaatggcctgggacatgatgatgaactggagtccaacaaccaccttagttctcgcccaggtcatgaggatcccaaccactctggtagacttactctctggaggccactggggtgtcctcgtgggggtggcctatttcagcatgcaggccaattgggccaaagtccgactcggaccgatg

SEQ ID NO: 7609 - DNA, 203 bp, Homo sapiens
ggcgcgccagtcctaatgacagcttaaacactgggttcttggctagcttgttctacacccacaagtttaacagctcagggtgttccgaacggctcgcgtgctgcaagagccttgacagctacggccaaggctggggcccactcggggtcgctaacatcagcggctcgtctgatgacaggccttattgccgactcggaccgatg

SEQ ID NO: 7610 - DNA, 203 bp, Homo sapiens
ggcgcgccagtccttggcactacgcgcctcggccatgcgggattgtgccagcatccagtgtgtgtggccccgtgtattgtttcactcccagccctgtcgtggtcggtactactgatcacgtcggggtccctacttacacctggggggagaacgagactgatgtcttccttttgaactcgaccagaccgcgactcggaccgatg

SEQ ID NO: 7611 - DNA, 203 bp, Homo sapiens
ggcgcgccagtcctccgcatggtgcgtggtttggatgcgtgtggatgaacagtaccgggttcaccaaaacctgtggcgcccctccatgcgaggttaacaccaataatgggacctggcactgccccaccgattgcttcaggaagcatccggagactacctacgccaagtgcggatcagggccttggatccgactcggaccgatg

SEQ ID NO: 7612 - DNA, 203 bp, Homo sapiens
ggcgcgccagtcctgtgctcgcgttcctgcttctcgcggacgcgagagtctctgcctacctatggatgatgtttatggtaagtcaagttgaggcggctctgtccaacctaattaacatcaatgctgcttcagccgctggtgcccaaggcttctggtacgccatcctcttcatctgcattgtctggcatcgactcggaccgatg

SEQ ID NO: 7613 - DNA, 203 bp, Homo sapiens
ggcgcgccagtcctgtcaagggccggttcccagctgctgctgcctacgcagcctgcgggctgtggccctgttttctcctgcttctgatgctgcctgagagggcttatgcatacgaccaggaagtggcagggtcccttggcggcgccatcgttgtcatgctgaccattctgacactgtctccgcactaccgactcggaccgatg

SEQ ID NO: 7614 - DNA, 203 bp, Homo sapiens
ggcgcgccagtccttccttcctgggtactgcggttaacggcgtgatgtggaccgtctaccacggggcgggtgccaagaccatcagcggcccgaagggacctgtcaatcaaatgtacactaatgttgaccaagacttggtggggtggccagcaccccccggagtcagatctcttgctccgtgcacctgccgactcggaccgatg

SEQ ID NO: 7615 - DNA, 203 bp, Homo sapiens
ggcgcgccagtcctcctgctgaaaccacaacaaggctgaaagcttacttcgacacaccaggccttcctgtgtgccaagaccatctggaattctgggagagcgtctttacagggttaacccacatagacggtcatttcctatcccagaccaagcaatcgggtgagaatttcccgtatcttgttgcttaccgactcggaccgatg

SEQ ID NO: 7616 - DNA, 203 bp, Homo sapiens
ggcgcgccagtccttgcatgtcagctgatctcgaggtagtgacaagtacgtgggtcttggtgggcggcgtcctggcagctctggctgcttactgtctttcagtgggcagcgtagtgattgttgggagagtcgtcctgtcgggccaacctgctgtcattcctgatcgcgaagtgctctaccaacagttccgactcggaccgatg

SEQ ID NO: 7617 - DNA, 203 bp, Homo sapiens
ggcgcgccagtcctgacgaaatggaggagtgttccaaacacctcccactagtcgagcacgggttacaactggctgagcagttcaagcagaaggccttaggtctcctaaatttcgctggcaagcaagcccaagaggcaacaccagtgatccagtctaacttcgctaaacttgagcagttttgggcgaaccgactcggaccgatg

SEQ ID NO: 7618 - DNA, 203 bp, Homo sapiens
ggcgcgccagtcctgtgctaacatccatgctgacagacccatcacacataacggcggaatcggcgcgtcggagattggctcgagggtcacgaccctcgctagctagttcctcggcgagtcagctttcgccccgtcttcttcaggccacgtgtaccgctccccatgactcccctggtactgatctcctccgactcggaccgatg

SEQ ID NO: 7619 - DNA, 203 bp, Homo sapiens
ggcgcgccagtcctctggccgcaaagacctttggccagtcagagccgagctcagaccgtgatacagaccttaccaccccaactgagaccacagactcgggccccatcgtcgtggatgatgcatccgatgacggatcttattcgtcaatgcctccactagagggggagcccggtgacccggacttgacacgactcggaccgatg

SEQ ID NO: 7620 - DNA, 203 bp, Homo sapiens
ggcgcgccagtcctctgatcgtgtatccggatctcggatcccgggtttgcgagaagagagcgcttcacgacgtcatcaaaaaaactgccttagccgtgatgggagccgcttatggcttccaatactccccagcgcagcgggtggaatttcttctgactgcttggaagtcgaagaacgacccaatggggcgactcggaccgatg

SEQ ID NO: 7621 - DNA, 203 bp, Homo sapiens
ggcgcgccagtcctgggtatcggagatgtcgcgcaaccggcgtctacaccaccagcttcgggaacacgctgacgtgctatctcaaagccacggccgccatcagggcggcggcgctgagagactgcactatgttggtttgcggtgatgacttagtcgtcatcgctgagagcgacggcgtagaggaggaccgactcggaccgatg

SEQ ID NO: 7622 - DNA, 203 bp, Homo sapiens
ggcgcgccagtcctggagtcacctactctatcactccgctggatttaccggcaatcattcaaagactccatggcttaagcgcgttcacgctgcacggatactctccacacgaactcaaccgggtggccggagccctcagaaaacttggggtacccccgctgagagcgtggagacatcgggcccgagcacgactcggaccgatg

SEQ ID NO: 7623 - DNA, 203 bp, Homo sapiens
ggcgcgccagtcctgtccgcgctaagcttatcgcccagggaggtagagccaaaatatgtggcatatacctctttaactgggcggtaaaaaccaaactcaaactcactccattgcctgccgctgccaaactcgatttatcgggttggtttacggtaggcgccggcgggggagacatttatcacagcatgcgactcggaccgatg

SEQ ID NO: 7624 - DNA, 203 bp, Homo sapiens
ggcgcgccagtcctttacggtaggcgccggcgggggagacatttatcacagcatgtctcatgcccgaccccgctatttactcctgtgcctactcatacttacagtaggggtaggcatcttcctgctgcctgctcggtaggcagcttaacactccgaccttagggtcccctttttttttttttttttggcgactcggaccgatg

SEQ ID NO: 7625 - DNA, 203 bp, Homo sapiens
ggcgcgccagtcctccttggcccctttacgccaatgaaggcctcgggtgggcagggtggttgctctccccccgaagctctcggcctaattggggccccaatgacccccggcggaaatcccccaatttgggtagggtcatccataccctaacgtgcggattcccccacctcatggggtacatcccgctccgactcggaccgatg

SEQ ID NO: 7626 - DNA, 203 bp, Homo sapiens
ggcgcgccagtcctgtaggcggccccgttgggggcgtctcaagggctctcgcacacggtgtgaaggttcttgaagacgggataaactatgcaacagggaatctacccggttgccctttctctatctttgtccttgcacttctttggtgcctgaccgtccccgcttccgcagttccttaccgtaatgctcgactcggaccgatg

SEQ ID NO: 7627 - DNA, 203 bp, Homo sapiens
ggcgcgccagtccttggcactatcccccacgaccgtgcggggtggtgccagcccgggatgtctgcggtccagtctactgtttcacacctagcccagtggtcgttggcactactgaccgcagagggtgtcccacttataactggggcagcaacgagactgacatccttctcttgaataacattaggccccgactcggaccgatg

SEQ ID NO: 7628 - DNA, 203 bp, Homo sapiens
ggcgcgccagtcctctcaccccccggtgtttggtgcactacccttaccggttgtggcattacccgtgcaccgtaaattacaccatctttaaggtgcgcatgttcatcggaggcctagagcacaggcttgaagcggcatgcaattggacctatggtgagcggtgtgaccttgaagacagagatagggcccgactcggaccgatg

SEQ ID NO: 7629 - DNA, 203 bp, Homo sapiens
ggcgcgccagtcctcatgtcaagggcaggttggtccctggggccacctacctttgcttgggcgtttggccactactcttagtccgtctcctccggccccacagggccctggccctggactcaagcgatggcgggactgtgggttgtcttgtgctaattgttcttacaatctttacacttacccctgggcgactcggaccgatg

SEQ ID NO: 7630 - DNA, 203 bp, Homo sapiens
ggcgcgccagtccttacaaaaagaaggtagtgctggtcatgtggtggcttcagtatttcatagcccgagtggaggccatcatccacgtgtgggtgcccccgttgcaggttaagggtggtcgtgacgctgtcatcatgctcacatgcctcttccaccctgccttggggtttgagatcacaaaaatcctccgactcggaccgatg

SEQ ID NO: 7631 - DNA, 203 bp, Homo sapiens
ggcgcgccagtcctgaccatcttgcccccatgaaggattgggcagcgtctgggctccgcgaattaacggtggccacagaacccatcgtattctccgcgatggagacgaaggtcatcacgtggggggctgacacggccgcgtgtgggaacatacttgctgttcttccggtatcagctagacggggccgccgactcggaccgatg

SEQ ID NO: 7632 - DNA, 203 bp, Homo sapiens
ggcgcgccagtcctgaaattttcctggggccggccgacgacatcaagacgtcgggttggcgactcctcgcccctatcaccgcgtatgcgcagcagacgcgaggggtactgggcgccatagttctcagcctgaccggccgggacaaaaatgaagccgagggtgaggtgcagttcttatccacggcaacacgactcggaccgatg

SEQ ID NO: 7633 - DNA, 203 bp, Homo sapiens
ggcgcgccagtcctttcttcgccgacggggggtgctcgggcggcgcgtatgacgtaatcatatgcgacgagtgccattcccaggacgctaccaccatccttgggataggcacagtccttgaccaggcagagacggctggagctaggctcgttgtcttggcgacggccattccccccggcagtgtaacgcgactcggaccgatg

SEQ ID NO: 7634 - DNA, 203 bp, Homo sapiens
ggcgcgccagtcctgagactactacagtgccccaggacgcagtgtccagaagccagcgtaggggccgtacagggagaggtaggcacggcatataccggtatgtttcgtctggggagagaccgtccggcattttcgactctgtggtgctctgtgagtgctacgatgccgggtgtgcatggtatgatctgcgactcggaccgatg

SEQ ID NO: 7635 - DNA, 203 bp, Homo sapiens
ggcgcgccagtcctactcctgctgagactaccgtgaggttgcgtgcttacctgaacacccccgggctccctgtctgtcaagaacatctggaattctgggaaggggtgttcacagggcttactaacatcgacgcccacatgctgtcacaggcaaagcagggtggggaaaacttcccataccttgtggcacgactcggaccgatg

SEQ ID NO: 7636 - DNA, 203 bp, Homo sapiens
ggcgcgccagtccttttgatgagatggaggagtgctcagcctccttgccctatgtggacgaggcacgtgccatcgccgggcaatttaaggagaaagtgcttggcctcattggcacggctggccagaaagctgaaactctgaaaccggcagctacgtccatgtggagcaaggccgagcagttctgggcacgactcggaccgatg

SEQ ID NO: 7637 - DNA, 203 bp, Homo sapiens
ggcgcgccagtcctaagcatatgtggaactttgtcagtgggatccaataccttgctggcctttcgaccttgccgggtaatcccgccgtggccacgttgatgtctttcaccgccgcggtgacctcccctcttacaacacatcagaccctcctttttaatattctaggagggtgggtggcctcacagatccgactcggaccgatg

SEQ ID NO: 7638 - DNA, 203 bp, Homo sapiens
ggcgcgccagtcctctgcaggcaaaactcctcccgcaactccccggagtgcccttcttctcatgccagaaggggtacaagggtgtatggcgcggggatggagtgaactccaccaagtgtccttgcggagcgacgatatctggtcacgtgaagaacggaaccatgagaatcgtcggcccgaagctgtgccgactcggaccgatg

SEQ ID NO: 7639 - DNA, 203 bp, Homo sapiens
ggcgcgccagtcctagtaacacctggcaaggcaccttcccaatcaacgccacaacaacagggcccagcgtacctgccccggcccccaactacaagttcgccttgtggagggtgggcgccgcggactacgcggaggtgcgccgtgtaggggactaccactacataacgggggtgacacaagacaatctgcgactcggaccgatg

SEQ ID NO: 7640 - DNA, 203 bp, Homo sapiens
ggcgcgccagtcctaccgtcttaacatcaatgctgtcagatcccgcccacatcacggcggaaacggccaagcgcaggctaaatcgagggtctccaccctctctggcaaactcctcggccagtcagctctcagccccctctctcaaggccacctgcactatacaaggccaccacccagatgcagacctccgactcggaccgatg

SEQ ID NO: 7641 - DNA, 203 bp, Homo sapiens
ggcgcgccagtcctggggaccctgacctttcgtcagggtcatggtcaaccgtcagcggtgaggacaacgtggtgtgttgctccatgtcatacacctggactggggcgctcatcaccccttgctctgctgaagaggaaaaattacccatcaatcccttaagcaacaccttattacgccaccacaatcttcgactcggaccgatg

SEQ ID NO: 7642 - DNA, 203 bp, Homo sapiens
ggcgcgccagtcctgggaagaagcctgcacggctgatagtctaccccgaccttggagtccgcgtctgcgagaagcgggctttgtacgacgtagctcaaaaactgccgacagcccttatggggccctcgtatgggtttcagtactccccagcgcagcgggttgacttcttactgaaggcgtggaaatctcgactcggaccgatg

SEQ ID NO: 7643 - DNA, 203 bp, Homo sapiens
ggcgcgccagtcctcaggggacacacgaagatgaagcgagcctgagagccttcactgaggctatgaccaggtactccgctcccccgggtgatcccccggttccagcttatgacctggagctcgtaacatcttgctcctcgaacgtgtccgtcgcccgcgatgcttcaggcaacagaatttactatctccgactcggaccgatg

SEQ ID NO: 7644 - DNA, 203 bp, Homo sapiens
ggcgcgccagtcctctagcatttgaaatgtatgggtcagtttattctgttactccgctggatcttccagctatcattcaaagactccatggacttagcgcgttttcactccattcatactctccgagcgagatcaatagggtggctagttgcctcaggaagcttggggtaccccctttgagagcttggcgactcggaccgatg

SEQ ID NO: 7645 - DNA, 203 bp, Homo sapiens
ggcgcgccagtcctacgctgaccggctggacttgtccagctggttcaccgttggcgctggcgggggggacatttatcacagcatgtcccgtgcccgaccccgcaacttactcctgtgcctactcctacttagcgtaggggtaggcatctttttactccccgctcggtgagctgggagctaaacactcccgactcggaccgatg

SEQ ID NO: 7646 - DNA, 203 bp, Homo sapiens
ggcgcgccagtcctgccagccccttaacggggcgacactccaccatgatcactcccctgtgaggaactactgtcttcacgcagaaagcgtctagccatggcgttagtatgagtgtcgtgcagcctccaggcccccccctcccgggagagccatagtagtctgcggaaccggtgagtacaccggaattgcgactcggaccgatg

SEQ ID NO: 7647 - DNA, 203 bp, Homo sapiens
ggcgcgccagtcctccaggacgaccgggtcctttccattggatcaaacccgctcaatgcctggagatttgggcgtgcccccgcaagactgctagccgagtagcgttgggttgcgaaaggccttgtggtactgcctgatagggtgcttgcgagtgccccgggaggtctcgtagaccgtgcaacatgagccgactcggaccgatg

SEQ ID NO: 7648 - DNA, 203 bp, Homo sapiens
ggcgcgccagtcctggtcactggggtgtcctgatcgccatcgcctacttcggcatgtcaggcaattggttgaaggtaatcgctgtgttattcctgtttgcaggggtagaggcaaccaccaccgtcggcagagcggccggccgttctgcttatctcttcacctccattttctcgtctggtccaaatcagcgactcggaccgatg

SEQ ID NO: 7649 - DNA, 203 bp, Homo sapiens
ggcgcgccagtcctaagatacagcttattaacaccaatggtagctggcacataaataggaccgctctaaactgtatcgacagtctccaaactgggtttcttagcgcgttgttctaccgcagcaatttcaactccacgggttgctcagaacggcttggcgcatgcaagcccttggaacacttccagcagcgactcggaccgatg

SEQ ID NO: 7650 - DNA, 203 bp, Homo sapiens
ggcgcgccagtcctggatggggccctataacccacaagtccaacatcacagggccgtctgaggaccggccctactgctggcactatgctcctagggagtgtagtgtagtgccggcgtcatcagtgtgtggtcctgtttactgcttcacacctagccctgtcgtggtgggcaccaccgacaggctgggccgactcggaccgatg

SEQ ID NO: 7651 - DNA, 203 bp, Homo sapiens
ggcgcgccagtcctcagctcctgtgccctactgactgcttccggaaacatccggaggccacatatcagaagtgtgggtcggggccctggctgacccccaggtgtctggtggactatccctacagattgtggcactatccatgcactgtcaactacacaatacacaaggttcgcatgttcattgggggccgactcggaccgatg

SEQ ID NO: 7652 - DNA, 203 bp, Homo sapiens
ggcgcgccagtccttgggacaatagtcaggctgcatcacttggggtcgttgcccttctggtgttgacaatctttaccctcagccctatgtacaaacagctgctcacacacgctatctggtggaaccaatacatgttggctcgggctgaagctatgatacatgattgggtgccagatttgcgggtcaggcgactcggaccgatg

SEQ ID NO: 7653 - DNA, 203 bp, Homo sapiens
ggcgcgccagtcctggcggtagggatgccatcattctgctcacctgcttgttacacccacatctcgggtttgaggtcacaaagattttgttagccatcttagcccctctgtatatcctccagcacagtctgctcaaggtgccctactttgtgcgcgcccacatcctcctgcgggcttgtatgttcttccgactcggaccgatg

SEQ ID NO: 7654 - DNA, 203 bp, Homo sapiens
ggcgcgccagtcctcgcaaagtggcggccggtaaatatgtgcaagcttgcctcttgaggttgggcgcctggactggcacatacatatacgatcatctagctcctctcagtgagtgggcgagcgacggcttgcgtgatctagccgtagctgttgagccagtcatcttttcccccatggagaaaaagatccgactcggaccgatg

SEQ ID NO: 7655 - DNA, 203 bp, Homo sapiens
ggcgcgccagtcctattacgtggggtgcagacaccgctgcgtgtggcgacatcttgaggggtctccctgtgtccgcgagactaggggacttggtgctgctgggacccgcggatgacatgcgtcacggaggttggaagcttctggctcccatcaccgcatacgcccaacagacgcggggactggttggccgactcggaccgatg

SEQ ID NO: 7656 - DNA, 203 bp, Homo sapiens
ggcgcgccagtcctccgcctgcggtgcctcagacctaccaggtggggtacctgcacgctccgacgggtagcggtaaaagtactcgtgtcccggcagcttacgccacccagggatacaaggtgctagttctgaatccgtctgtagcggcaacgctgagcttcggggcatacatgagcaaagctcatggtcgactcggaccgatg

SEQ ID NO: 7657 - DNA, 203 bp, Homo sapiens
ggcgcgccagtcctcatctcatcttctgtcactcaaagaagaaatgcgacgaactgtctaaacaactaacctcattaggtctcaatgctgtcgcattctatagaggtgtcgatgtggctgtgatccccacctcaggcgacgtcgtcgtctgcgcgacggacgcccttatgaccggctacacgggcgaccgactcggaccgatg

SEQ ID NO: 7658 - DNA, 203 bp, Homo sapiens
ggcgcgccagtcctggattgactcacatagatgcccacttcttgtcccagacgaagcaggggggcgagaactttgcctacctcgtggcctatcaggccacggtgtgtgccagagccaaagcccccccgccgtcatgggacgtgatgtggaaatgtctcaccagacttaagccgaccctcacaggtcctcgactcggaccgatg

SEQ ID NO: 7659 - DNA, 203 bp, Homo sapiens
ggcgcgccagtcctacccccctcctatatcgtctgggggctgtccaaaatgagatagtaacaacacatccaatcacaaagtacatcatgacctgcatgtctgcagacctggaagtcatcacaagtacgtgggtaatcgtaggtggagtccttgccgcattagcagcctactgtttgacagtgggctgtcgactcggaccgatg

SEQ ID NO: 7660 - DNA, 203 bp, Homo sapiens
ggcgcgccagtcctgttgtcatctgtggcaggatcgtgacaagcggcaagcctgcggttgtccctgatcgggaggtcctgtaccagcagtttgatgagatggaggagtgctctaagcacatcccctacctagttgagggtcagcagattgctgagcagttcaagcaaaaggtccttgggctgctccagcgactcggaccgatg

SEQ ID NO: 7661 - DNA, 203 bp, Homo sapiens
ggcgcgccagtcctacttgctcatgcggggctcaaattgctggacacgtgaagaacgggtctatgaagatcacaggaccccggatgtgcagcaacacttggcatggaacgtttccgatcaacgccacaactaccagccctagtgtgccggtaccggcccccaactacaaacgcgctctctggcgagttcgactcggaccgatg

SEQ ID NO: 7662 - DNA, 203 bp, Homo sapiens
ggcgcgccagtcctgaggtgagcttctctgtgggcctcctagagtttgttgtggggtctcagctcccttgtgagccagagcctgacgtgaccgtagtcacgtcaatgctcactgacccctcacacatcaccgcagagacagcctctcggcgcttgaagaggggatctcccccctccctggcgagttcacgactcggaccgatg

SEQ ID NO: 7663 - DNA, 203 bp, Homo sapiens
ggcgcgccagtccttccgccagccagttgtcagcgccatcacttaaagccacttgcacggcgaacggagaccacccggacgccgagctgatcgaggccaatctcctatggagacaggagatgggaagcaacatcacccgggttgagtcggagaccaaagttgtcatcctcgactcgtttgatcctctgcgactcggaccgatg

SEQ ID NO: 7664 - DNA, 203 bp, Homo sapiens
ggcgcgccagtcctgttgcagagtatgacgacagggagatatcagtgtcagcagagtgccatagaccacctaggcctaagttccctcctgctctcccgatttgggccagacctgactacaatccacctctcctacagaaatggcaaatgcccggatacgagccccccgtcgtgtctggatgtgcgttgcgactcggaccgatg

SEQ ID NO: 7665 - DNA, 203 bp, Homo sapiens
ggcgcgccagtcctcctccagctaaaccaacacctatcccgccaccaaggcggaagaggctcatacagctggacgagtctgctgtatcgcaagctctacaacagctggctgataaggtgtttgtggaggacactagcacctcagagccgagctccggcctcggagggtcaatagccggcccatcatctcgactcggaccgatg

SEQ ID NO: 7666 - DNA, 203 bp, Homo sapiens
ggcgcgccagtcctcctgacccgacaacagcagatgacacgtgttctgacgcgggatcctttagctcaatgccccccctcgagggggaacctggagacccagacttgagcactggttcctggtccactgttagtgaagaggacgatgtcgtctgttgctctatgtcatacacttggacgggggccttgcgactcggaccgatg

SEQ ID NO: 7667 - DNA, 203 bp, Homo sapiens
ggcgcgccagtcctaccgtgatgggatctgcatacggtttccagtactccccctcccaacgggtagagtacttgctcaaaatgtggcgctcgaagaaaacgccaatggggttttcatatgacaccaggtgcttcgattcgaccgtcaccgagcgggatatccgaactgaagaggacatctaccaatctcgactcggaccgatg

SEQ ID NO: 7668 - DNA, 203 bp, Homo sapiens
ggcgcgccagtccttgccaactagaccctaccgcgaggaaagcaatatcatccctcacagaacgcctctattgtggtggcccgatgtttaactccaaaggggaatcatgtggctatcgcagatgccgtgccagtggggtgctcactaccagtttggggaacaccctcacttgttatcttaaggcacagcgactcggaccgatg

SEQ ID NO: 7669 - DNA, 203 bp, Homo sapiens
ggcgcgccagtcctgaccttgagctgataacatcatgctcgtccaacgtctccgtagcccacgatggcaccggacagagatattactacctcacccgtgactgtaccactccacttgcgcgagctgcttgggagacagctcgccatacccctgtcaattcgtggttgggcaacatcatcatgtacgcccgactcggaccgatg

SEQ ID NO: 7670 - DNA, 203 bp, Homo sapiens
ggcgcgccagtcctcatgggtactctccaactgaactcaacagggtgggagcgagcctcaggaagcttggggcgccacccttaagagcttggagacatcgagccagagctgtcagagccaaactcattgcccaaggtgggaaagcagcgatatgcggcaagtacctctttaactgggcagtgaagacccgactcggaccgatg

SEQ ID NO: 7671 - DNA, 203 bp, Homo sapiens
ggcgcgccagtcctaagctcaaactcactccattggctgcggcaagccagcttgatttgtcaggctggtttgtcgcaggctacgacgggggggacatttatcacagcgtgtcccgggctcgaccccgtctgttactccttggcctactcctactcactgtaggggtaggcatctttttactccccgctcgactcggaccgatg

SEQ ID NO: 7672 - DNA, 203 bp, Homo sapiens
ggcgcgccagtcctcgggcaactccgcagcggaaccgactactttgggtgtccgtgtttccttttattcctatattggctgcttatggtgacaattgaaagattgttaccatatagctattggattggccatccggtgtcaaacagagcaatcatttatttgtttgttggttttatacctctgaacttcgactcggaccgatg

SEQ ID NO: 7673 - DNA, 203 bp, Homo sapiens
ggcgcgccagtcctcggcaggatttctcgcaagatcccagtaagtttaccgaaccggtaaaggatatcatgttaaaaactctaccagcgctgaattcaccaaaagcagaggagtgtgggtatagtgacagagttcgatcaataaccttaggcaactccacaatcaccactcaggaatgtgcaaatgtgcgactcggaccgatg

SEQ ID NO: 7674 - DNA, 203 bp, Homo sapiens
ggcgcgccagtcctggcctgttcgggcagaatatgcactaccattatctcggcagatcagggtatacaatacacgtacaatgcaatgcttcaaagttccaccagggatgcgtgctggtggtgtgtgtacctgaggctgagatggggtgtgctcaaacggattccacattcgagcacacagagttgacccgactcggaccgatg

SEQ ID NO: 7675 - DNA, 203 bp, Homo sapiens
ggcgcgccagtccttgcaacactattagagcatatcagattcccgtgcaagccaacaatgctaacacaaccacaccgattttcagcttccaagtggacccaggttatagttctgtgctaaataggacactactaggtgagatgctgaattattacgcacattggtctggcagcatcaagttgacatttcgactcggaccgatg

SEQ ID NO: 7676 - DNA, 203 bp, Homo sapiens
ggcgcgccagtcctttgttctgtggttcagccatggccaccgggaaattgctattggcatattccccaccaggtgcatcagtcccagaaagtagaaaagacgccatgcttggcacacacataatatgggacctgggcttgcagtcaagctgtgtcttgtgtgtgccatggatcagtcaatcacattatcgactcggaccgatg

SEQ ID NO: 7677 - DNA, 203 bp, Homo sapiens
ggcgcgccagtcctactgacctgcaaggcgacaccgatcaacgaaacggacaggtggtggataccaaagctactaacccaacgaactcaactgcggtaccggcgcttactgcagtggaaactgggcacacatcgcaggttgtgcctggcgatactattcagaccagacacgttgtgaacttccactcacgactcggaccgatg

SEQ ID NO: 7678 - DNA, 203 bp, Homo sapiens
ggcgcgccagtcctctaagatgtgaacacggggtcattggcgtcgtgactatgggtggtgagggcgttgttggtttcgctgacgtgcgcgacctcttgtggttagaggatgatgcaatggaacagggtgttaaagactatgttgagcaattgggaaacgcctttggctcaggtttcaccaaccagatacgactcggaccgatg

SEQ ID NO: 7679 - DNA, 203 bp, Homo sapiens
ggcgcgccagtccttactccttaccaccagaccctgatcattttgacggttacaaacagcaggctgtcgtgatcatggacgacttgtgccaaaatccagatggcaaggatgtgtccttattttgccagatggtgtcgagtgtcgactttgtgccgccaatggcagcacttgaggaaaagggcattctacgactcggaccgatg

SEQ ID NO: 7680 - DNA, 203 bp, Homo sapiens
ggcgcgccagtcctgtgagtagggctttcatctgcctgcaagcactaactacatttgtctctgtggcggggataatatacattatctacaagttatttgctggtttccagggagcttacactggtttgcctaaccagaaacccaaagtgccgaccctgagacaggctaaagttcaaggaccagcttttcgactcggaccgatg

SEQ ID NO: 7681 - DNA, 203 bp, Homo sapiens
ggcgcgccagtcctgaatttgcagtggccatgatgaaaagaaacgccagtactgtaaaaaccgagtacggcgagttcacaatgctcggcatctacgacaggtgggcagtgttgccccgtcatgctaagcctgggcccaccattttgatgaatgatcaagaagtgggcgtggttgatgccaaagagctgcgactcggaccgatg

SEQ ID NO: 7682 - DNA, 203 bp, Homo sapiens
ggcgcgccagtcctaagggcaaatccaggcttattgaggcatcgagtctaaatgactcagtggccatgaggcagacctttgggaacctgtacaagacattccacttgaacccaggtatagtaacaggcagtgcagttggctgcgatcctgatttattctggagcaagattccagtcatgctcgacggccgactcggaccgatg

SEQ ID NO: 7683 - DNA, 203 bp, Homo sapiens
ggcgcgccagtcctttcaaaggtggcgggagagttggcctcacgctgtttagcgtgagagctggctctcctgccccttcccctgagccggggatcttggctcattcccctcttttctatcctccctcattggactttacggatgacccggcataaacttgacaaccgatgttggatttcccttgtggccgactcggaccgatg

SEQ ID NO: 7684 - DNA, 203 bp, Homo sapiens
ggcgcgccagtcctacgccacatacaccacctccagtgatgtttcgtttggaccaagacctcctcttggctcagacatagctctctcaaatgccgctgctgctaatacgggtgcattaaatcagttgaaatttgtagaagtgcaacagtttgtattgagaaataacaccaacccattcacaggcattgcgactcggaccgatg

SEQ ID NO: 7685 - DNA, 203 bp, Homo sapiens
ggcgcgccagtcctatgctccatctctcgcccttgctggtgagggacatttgattgacacacacacccctggagggtatgcacctattagtgatttgattgacctgtctcacataccatccatggttacaaatgacacaacagattaccattactttgattggactgatacaactaataaggatgaaacgactcggaccgatg

SEQ ID NO: 7686 - DNA, 203 bp, Homo sapiens
ggcgcgccagtcctttataggtaaatttaattttaagctaaacagtgtccccaattcggcaattttagcgaattcatattctttttttagagggcctataatttttcatgttatcgctgctgcatcaacgatgcatagaggtaggctcagagtttgctttagaccaaattctaatcaggaatatagtgcgactcggaccgatg

SEQ ID NO: 7687 - DNA, 203 bp, Homo sapiens
ggcgcgccagtcctctcctcagtcaatggctgtatattattctcttttagacatttcccagagtaattgctgtactcttgctgtcccttttaattcggaaacgtggatgaggagcactgatgatgtgttgggaagactccagatttttgttaataaccagcttgctgctaacaggactgctgctaatccgactcggaccgatg

SEQ ID NO: 7688 - DNA, 203 bp, Homo sapiens
ggcgcgccagtcctacactcttgtcaagcatttatttggaaggttcacatatttgggctactacactcccgacagtggtggatggaagaaggtggccctcaacattccaaaacgtggtgtggttaatttgatgagagccttctgttactggtctggtgaagctgtattgtgtataacaaataatgatgcgactcggaccgatg

SEQ ID NO: 7689 - DNA, 203 bp, Homo sapiens
ggcgcgccagtcctacctgattacacttctggttgcccaaacttatgatgtgtttgttaatgccctgagtcttgtgtttggccgcttgccccgtaatgtgtatgatgttgctcgccgtgtattctcttcccgccccactcaacaaggctttgcttccttcacctctgcgctgcgcgcatgtgagtggtcgactcggaccgatg

SEQ ID NO: 7690 - DNA, 203 bp, Homo sapiens
ggcgcgccagtccttgattggtatgctttgtggcgcatctctatttacccttgccactcatgctttctcatttgtctccaattgtttttcacatggtgaggatccgccaggacctggccctgactgtgtgcgtttaccagagtcagcatatgaggggtgttccacgcggaaaacagccaggcaactggcgactcggaccgatg

SEQ ID NO: 7691 - DNA, 203 bp, Homo sapiens
ggcgcgccagtccttcatcttaggtggtagaaaaatgtactttaatacgcattatgcttcagttatcttggacaaagatgttactgtgtgtacacccaataagaagtactttacaagattaactaaggtaagttcaaattatgacacaatgattgttcaattggatattcctgagttgttgccaagcacgactcggaccgatg

SEQ ID NO: 7692 - DNA, 203 bp, Homo sapiens
ggcgcgccagtcctgtggtggtttgctcgttggaaagattgatggagcttttaaagcactaggctttcacgctgctggaagtcttgagcgtggctttgccaacgcatttaattctgtcccccctctttcaactgtgcctgatttccctgaatctattaatttatctggattattttcaaatgatgttgcgactcggaccgatg

SEQ ID NO: 7693 - DNA, 203 bp, Homo sapiens
ggcgcgccagtcctcttgcaccagtgttctaaattcaattgttaatgttttaatggctaggtacatttgtgctcttatggacattgactacccggtcatggtggcatatggagatgataatgttgtatcatttgatgaggagatagacatagagagaatggtttccttgtataagacagaattcggtgcgactcggaccgatg

SEQ ID NO: 7694 - DNA, 203 bp, Homo sapiens
ggcgcgccagtcctttgattggactgaagagggctatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttcgactcggaccgatg

SEQ ID NO: 7695 - DNA, 203 bp, Homo sapiens
ggcgcgccagtcctaagaaggaactagggaccttgaccagtgctatcaatcggcggagctcaaaacaaaagaaaagaggaggaaagaccggaattgcagtcatgattggcctgatcgccagcgtaggagcagttaccctctctaacttccaagggaaggtgatgatgacggtaaatgctactgacgtccgactcggaccgatg

SEQ ID NO: 7696 - DNA, 203 bp, Homo sapiens
ggcgcgccagtccttatggaagatgcaccaagacacgccactcaagacgcagtcggaggtcactgacagtgcagacacacggagaaagcactctagcgaacaagaagggggcttggatggacagcaccaaggccacaaggtatttggtaaaaacagaatcatggatcttgaggaaccctggatatgcccgactcggaccgatg

SEQ ID NO: 7697 - DNA, 203 bp, Homo sapiens
ggcgcgccagtcctggcgacagctgcgtgactatcatgtctaaggacaagcctaccatcgatgtgaagatgatgaatatggaggcggccaacctggcagaggtccgcagttattgctatttggctaccgtcagcgatctctccaccaaagctgcgtgcccgaccatgggagaagctcacaatgacaaacgactcggaccgatg

SEQ ID NO: 7698 - DNA, 203 bp, Homo sapiens
ggcgcgccagtcctcgtgctgacccagcttttgtgtgcagacaaggagtggtggacaggggctggggcaacggctgcggactatttggcaaaggaagcattgacacatgcgccaaatttgcctgctctaccaaggcaataggaagaaccatcttgaaagagaatatcaagtacgaagtggccatttttcgactcggaccgatg

SEQ ID NO: 7699 - DNA, 203 bp, Homo sapiens
ggcgcgccagtcctgtccatggaccaactactgtggagtcgcacggaaactactccacacaggttggagccactcaggcagggagactcagcatcactcctgcggcgccttcatacacactaaagcttggagaatatggagaggtgacagtggactgtgaaccacggtcagggattgacaccaatgcacgactcggaccgatg

SEQ ID NO: 7700 - DNA, 203 bp, Homo sapiens
ggcgcgccagtccttactacgtgatgactgttggaacaaagacgttcttggtccatcgtgagtggttcatggacctcaacctcccttggagcagtgctggaagtactgtgtggaggaacagagagacgttaatggagtttgaggaaccacacgccacgaagcagtctgtgatagcattgggctcacaacgactcggaccgatg

SEQ ID NO: 7701 - DNA, 203 bp, Homo sapiens
ggcgcgccagtcctgagggagctctgcatcaagctttggctggagccattcctgtggaattttcaagcaacactgtcaagttgacgtcgggtcatttgaagtgtagagtgaagatggaaaaattgcagttgaagggaacaacctatggcgtctgttcaaaggctttcaagtttcttgggactcccgcacgactcggaccgatg

SEQ ID NO: 7702 - DNA, 203 bp, Homo sapiens
ggcgcgccagtcctggggtgttcacctcagttgggaaggctgtccatcaagtgttcggaggagcattccgctcactgttcggaggcatgtcctggataacgcaaggattgctgggggctctcctgttgtggatgggcatcaatgctcgtgataggtccatagctctcacgtttctcgcagttggaggacgactcggaccgatg

SEQ ID NO: 7703 - DNA, 203 bp, Homo sapiens
ggcgcgccagtccttgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacgactcggaccgatg

SEQ ID NO: 7704 - DNA, 203 bp, Homo sapiens
ggcgcgccagtcctcaggagaacattttgttgatgttggcggctgttttctttcaaatggcttatcacgatgcccgccaaattctgctctgggagatccctgatgtgttgaattcactggcggtagcttggatgatactgagagccataacattcacaacgacatcaaacgtggttgttccgctgctacgactcggaccgatg

SEQ ID NO: 7705 - DNA, 203 bp, Homo sapiens
ggcgcgccagtcctgccctgctaacacccgggctgagatgcttgaatctggatgtgtacaggatactgctgttgatggtcggaataggcagcttgatcagggagaagaggagtgcagccgcaaaaaagaaaggagcaagtctgctatgcttggctctagcctcaacaggacttttcaaccccatgatccgactcggaccgatg

SEQ ID NO: 7706 - DNA, 203 bp, Homo sapiens
ggcgcgccagtcctcttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgcgactcggaccgatg

SEQ ID NO: 7707 - DNA, 203 bp, Homo sapiens
ggcgcgccagtcctctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcaccgactcggaccgatg

SEQ ID NO: 7708 - DNA, 203 bp, Homo sapiens
ggcgcgccagtcctattctgccacagatcatcaaagaggccataaacagaagactgagaacagccgtgctagcgccaaccagggttgtggctgctgagatggctgaagcactgagaggactgcccatccggtaccagacatccgcagtgcccagagaacataatggaaatgagattgttgatgtcatgcgactcggaccgatg

SEQ ID NO: 7709 - DNA, 203 bp, Homo sapiens
ggcgcgccagtccttgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccacgactcggaccgatg

SEQ ID NO: 7710 - DNA, 203 bp, Homo sapiens
ggcgcgccagtcctacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgacgactcggaccgatg

SEQ ID NO: 7711 - DNA, 203 bp, Homo sapiens
ggcgcgccagtcctgcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccacgactcggaccgatg

SEQ ID NO: 7712 - DNA, 203 bp, Homo sapiens
ggcgcgccagtcctgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctcgactcggaccgatg

SEQ ID NO: 7713 - DNA, 203 bp, Homo sapiens
ggcgcgccagtcctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaaccgactcggaccgatg

SEQ ID NO: 7714 - DNA, 203 bp, Homo sapiens
ggcgcgccagtcctggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtccccgactcggaccgatg

SEQ ID NO: 7715 - DNA, 203 bp, Homo sapiens
ggcgcgccagtcctaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgacgactcggaccgatg

SEQ ID NO: 7716 - DNA, 203 bp, Homo sapiens
ggcgcgccagtcctatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccgactcggaccgatg

SEQ ID NO: 7717 - DNA, 203 bp, Homo sapiens
ggcgcgccagtcctgtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctcgactcggaccgatg

SEQ ID NO: 7718 - DNA, 203 bp, Homo sapiens
ggcgcgccagtcctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctcgactcggaccgatg

SEQ ID NO: 7719 - DNA, 203 bp, Homo sapiens
ggcgcgccagtcctccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctcgactcggaccgatg

SEQ ID NO: 7720 - DNA, 203 bp, Homo sapiens
ggcgcgccagtcctagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatctcgactcggaccgatg

SEQ ID NO: 7721 - DNA, 203 bp, Homo sapiens
ggcgcgccagtcctttaaaactgggctcgggttgtacccacccgagctgcccatgtggcgtggtgctcttgtatcccggtacacttgcacgccagtttgcctctccttaccccgtaacatatctagaagaatgtgcataacggaccaataggtggtggcaacccatgccactgacggtcaagtacttccgactcggaccgatg

SEQ ID NO: 7722 - DNA, 203 bp, Homo sapiens
ggcgcgccagtccttgtttccccggtgtgatgtggaatagactctctcagggttgaagccataagcatcgttatccgctacgtgcctacgcaaaacctagtagcattttgaagcttacttggttggccgctcagccactaacccgtggtaggcctggcagatgaggctgggcgcaccccactggcgaccgactcggaccgatg

SEQ ID NO: 7723 - DNA, 203 bp, Homo sapiens
ggcgcgccagtcctagtggcccagcctgcgtggctgcctgcccctctttgaggggaagccatttaagtgacaaggtgtgaagagtctcgtgtgctccacgtagaatccttccggcccctgaatgtggctaatcctaaccccgcagctattgcacacaatccagtgtgttgatagtcgtaatgggcaaccgactcggaccgatg

SEQ ID NO: 7724 - DNA, 203 bp, Homo sapiens
ggcgcgccagtcctggttggtggtggaagttgcctgattgccttaaagatatgggcatcttcgggcaaaatctgtaccatcatgcattgggtaggtcagggtacataatacacacccaatgtaatgccacaaaattcaatagtggttgtctaatagtggctgttgtaccagaacaccagctagcttaccgactcggaccgatg

SEQ ID NO: 7725 - DNA, 203 bp, Homo sapiens
ggcgcgccagtcctattgtagtaccatggatgagcggcaccttccatagacggactaaagctgacaattacacccaggctggatatgtgtcactatggtaccagactgattttgtgtcaccaaatgatgggattgggacaatcgttgctacatgctccggatgtcctgatttgtctgttagaatgctgcgactcggaccgatg

SEQ ID NO: 7726 - DNA, 203 bp, Homo sapiens
ggcgcgccagtcctcgtgacacaccaatgatgaaacaggaaaaagatttgactcaaaacccagttgaggactacatagacaaggtggtcgacactgtactacaggtcccaaacacccaacccagtggtccacaacacagtattcaaccaagtgctttgggcgctatggaaattggggcatcttcaacccgactcggaccgatg

SEQ ID NO: 7727 - DNA, 203 bp, Homo sapiens
ggcgcgccagtccttttgaaatgtttacatatgctagatttgacatggaagttactgttgtcaccaacaacacaggtttggtacaaatcatgtttgtaccacctggtatagatgcaccagatagtattgactcccgtctatgggattctgcctccaacccgagtgttttctatcaaccaaaatcaggtcgactcggaccgatg

SEQ ID NO: 7728 - DNA, 203 bp, Homo sapiens
ggcgcgccagtcctagtgatctctttgtccatacagccactatgatttacaggaatgcgcacttaaccagcttgaatgacaaaaccgttctactggctctcagtgcagatctccaggtggacgcagctgaccagccaggcccagataccatcccacaatgtgactgcttggagggctgctactatagccgactcggaccgatg

SEQ ID NO: 7729 - DNA, 203 bp, Homo sapiens
ggcgcgccagtcctatcacagctggtggagacaatcatgtagctttcacagatctaagaccctattcatgtttagacactcaccaaggtcctattcaggactatgtgacacaattagggagtgcctttggtagcggtttcactgacacacttaaagaccaattgacagatgtgagtgcccatattaaacgactcggaccgatg

SEQ ID NO: 7730 - DNA, 203 bp, Homo sapiens
ggcgcgccagtcctgacaaaattacttcaaaggtagttaaatggctagtacgtatcatcagtgcacttaccataatgatacgtaacagtactgacacacccactgtacttgcaacccttgctcttttaggctgtcacaagtcaccatggtcatttctcaaggaccggttatgtcagtggttaaacatccgactcggaccgatg

SEQ ID NO: 7731 - DNA, 203 bp, Homo sapiens
ggcgcgccagtcctaaaatagatctttatcaagaacaggttaaaggattttccaaagttgatgaaccagctcagcaggaactactaattaaagttgaaaaactgaagaaaggtttagacagcctagcacctctgtatgcagttgaaaacaaaagagttacaaacatctataaagaactcaaagcattgcgactcggaccgatg

SEQ ID NO: 7732 - DNA, 203 bp, Homo sapiens
ggcgcgccagtcctgcccaaggaccatacacaggcatgcctactacacccaagaagaaacctgagttaagaagagcaaccttgcaaggtcctgaacatgaatttttgaatgcccttattagaagaaactgccatatcattaccactgacaaaggagaatttaacctactaggtatatactctaactgtcgactcggaccgatg

SEQ ID NO: 7733 - DNA, 203 bp, Homo sapiens
ggcgcgccagtcctgctgtagtaccaacacatgctgaacctggtgacgtggtagatattgatggaaggttagttagagtgcttaaacaacaagtcctcactgatatgaatgatgtggatacggaagtaactgtgttgtggcttgaccagaatgaaaagttcagagacataagaagatttatacctgaacgactcggaccgatg

SEQ ID NO: 7734 - DNA, 203 bp, Homo sapiens
ggcgcgccagtcctcaactttacatgcttgacatcaacccagaaccaatcaccatggaacaagcaatatatggttatgctaacttggaaccattggaccttaccactagccctggtttcccttatgtgtctttgggcgtgaaaaagaaagacatcttaaacaacgctactaaagacacaaggaaaatgcgactcggaccgatg

SEQ ID NO: 7735 - DNA, 203 bp, Homo sapiens
ggcgcgccagtcctcaacagatgttagatctgtatggtattgatctaccctacataactttcctaaaggatgaactccgcgccccagagaaaattaaggctggtaagaccaggattgtggaggctgctagtgtcaatgatacagtgtactttagaacaacttttggcaatctatacagtacttttcatcgactcggaccgatg

SEQ ID NO: 7736 - DNA, 203 bp, Homo sapiens
ggcgcgccagtcctgcaaacccaggtatcttaacaggctcagctgtggggtgtaatccagatgtgttttggtcacaaatgcatgctatgttagatggagaactcattgcttttgattacaccaattatgatggcagcttggaaccagtgtggtttaaagcgcttgggaaagtgttagatcagcttggccgactcggaccgatg

SEQ ID NO: 7737 - DNA, 203 bp, Homo sapiens
ggcgcgccagtcctaccaagacaacagtttcaagtgatgaacatcgaacgtctaaactggatccgtaactggacatgttagggcaaggacttcccccctggtaacaggagcctggctggccaaaagccccgctcattgagcctagcatgttgtcgaccctggactgttcagtttagttagtacatggacgactcggaccgatg

SEQ ID NO: 7738 - DNA, 203 bp, Homo sapiens
ggcgcgccagtcctattcacttgtcacggttcttctgaactcggtctctagtatgacagcctaaggatgccctccaggtaccccggggtaacaagtgacacccgggatctgaggaggggactactttacgtagtttaaaaaacgtctaagctgttatggtgaccagaggctggcacctttcacttttacgactcggaccgatg

SEQ ID NO: 7739 - DNA, 203 bp, Homo sapiens
ggcgcgccagtcctaacttggtttcaacaacactctcgtaactgctgaccttgacggaaatgaaaagatcatacacggtttgcctaatagacatgataattgttggctcaattcgcttatgcaaatgaccaactgggttggagaagggtttttcaaaaacacctatgacaaccctgatctaattcctccgactcggaccgatg

SEQ ID NO: 7740 - DNA, 203 bp, Homo sapiens
ggcgcgccagtcctatcacacagacatcactaccactcagtctaccgttggaatcacccacgggtacgcacactccgagctcgaccaagtcaatgctgccagtggtactcacgaacatgtagaccacgtgtctcgtatttacatgaaaaaactttttacttggtccatgagcgacgccacagggtattcgactcggaccgatg

SEQ ID NO: 7741 - DNA, 203 bp, Homo sapiens
ggcgcgccagtccttgcctatgacaatctccaacggtggtagtgatctcaccagtcttgatgttcgggctagtttcacaccccttaatgttaaggttgctggacctatgcccaacaaacaaggtattgtacctgtggcagccaaagctggttattcagggttttgcaccactagtcccatcaccgcggcgactcggaccgatg

SEQ ID NO: 7742 - DNA, 203 bp, Homo sapiens
ggcgcgccagtcctcccaacattgtataactctggaatgggataccggattgaattctgagacagtgtttaatataccctacatttcccagacttattacacttcaactcactccagtacagctgacattggtaatgtttcaggtagagtacagatataccaagttacagcaccttcctctacttcagcgactcggaccgatg

SEQ ID NO: 7743 - DNA, 203 bp, Homo sapiens
ggcgcgccagtcctagttattagttctgttctcttctggtagagatttccagctgcgttgcccagttgagcctgtgaaacaagtcactgacgttggagaaacaggtaggtacaagatcttggatgcaactcaacaaaacggacactcggctaacaccttccgtcttcacaccgatgtttctttcgctccgactcggaccgatg

SEQ ID NO: 7744 - DNA, 203 bp, Homo sapiens
ggcgcgccagtcctttgaccgctacgcactactcagtgttgtctctggaaacgcaagcaatacacaccagagatacaccaatcttgaccctaccaaactgcctgccgacacgttcatgaaaaagctcattgactcttgcacctactacttttctgacttggaagttacagttattgcaaaaggtgaagcgactcggaccgatg

SEQ ID NO: 7745 - DNA, 203 bp, Homo sapiens
ggcgcgccagtcctctttttacagagttctacctacgaaatacgctggtagaactctctttgtaaaacaagaacagtttgagccattcaaccacggaggttttggtgagattatcactacagggagagaggccaccaaacacagagtacttatcagaatgaaaagagcagaaatgtactgtcctcgagcgactcggaccgatg

SEQ ID NO: 7746 - DNA, 203 bp, Homo sapiens
ggcgcgccagtcctctctttacccttccgcctcagtgacacagctttccaccagacgaaaacttaggctaacgggtgaaattgttaagcaaggagccacgaatttcgaacttttacaacaagctggtgacgtggagaccaacccaggacccgcatctttcagtaaactaattgaagactttggatgttcgactcggaccgatg

SEQ ID NO: 7747 - DNA, 203 bp, Homo sapiens
ggcgcgccagtcctgattagaggtttttgacaccagagtcatgatggacaatcttgtagacaggtttaaaccatactttcatgttagtccacccaaatttgactttaagactgaagttttagacaaggtcagggacttctttgctactgacgaggaagaagaggagtttgatgctactaaccccttcacgactcggaccgatg

SEQ ID NO: 7748 - DNA, 203 bp, Homo sapiens
ggcgcgccagtccttcctggtgcctgatgagtacgctgaagcacacaactggctggaaaggaaaagagaagttctcctccaggctaatcagtatgctcttgctaagctctgtgaacccaaggttggaccaccacctgaaacaaggcctgaaccagtggttatcttgttcagaggggattccggccaggcgactcggaccgatg

SEQ ID NO: 7749 - DNA, 203 bp, Homo sapiens
ggcgcgccagtcctacaaactcaaagtaaaccctctcattacaactgagagtgggaaccctccaactgacatgcagttggtggtactcaagaacacacaaccaatttcactagttagagatggacaaattgtcgccacttgttgtgctcttggcgtttttggaaccacctatttagttccctaccacccgactcggaccgatg

SEQ ID NO: 7750 - DNA, 203 bp, Homo sapiens
ggcgcgccagtcctgcatactcgtcaaagatggttctcacacagtcatcataggcatccatagtgcaggaggtaacggaaaaggttacgctagttgtgtcactcgttccgcactcctcgcactgaggggcagagaaaggcccgagctcgaagggcttatgttaggagaacgacctggagagaaagttccgactcggaccgatg

SEQ ID NO: 7751 - DNA, 203 bp, Homo sapiens
ggcgcgccagtcctctctttaccgtctctgtgctgctgagtatgcctcacatcttcacaatgttcttggcaagaccggtgcgcctttgaccaacgttgaggccgtgctcggtattgacggactcgacgccatggagcccaatactgcccccggtctaccttgggctcttcagcacaaacgcagacatgcgactcggaccgatg

SEQ ID NO: 7752 - DNA, 203 bp, Homo sapiens
ggcgcgccagtcctcttgtcactcaacccagctcatgtcagttatggctgacgaggttttctcagacgcatacggttttgatgagagggcacgttacgctgtgaaatccttgtgcaagacagtccatgcatacgaggacaagcgtatcaccatagatggtggtttaccttcaggttgtagtgccaccacgactcggaccgatg

SEQ ID NO: 7753 - DNA, 203 bp, Homo sapiens
ggcgcgccagtcctacaccataacacctgaagacaagtctgacaatggttttactttaggtaagaacattacagatgtcacatttcttaaacgcgctttcgaacgcgattgtgtcctagggttttacaaacccgtgatgaactccaaggttttggaggccatcctgtcctttgcacggcgtggcacaccgactcggaccgatg

SEQ ID NO: 7754 - DNA, 203 bp, Homo sapiens
ggcgcgccagtccttccaggagaagctaacctcagtggcaggtcttgctttccacagtggagaagaagagtacaacagacttttctctccatttgtggggagtttcgagattccgtcatacaggtgccttcgcctgagatgggtacacaaaatgtcaaattgaattgaacataaccaaactaactccacgactcggaccgatg

SEQ ID NO: 7755 - DNA, 203 bp, Homo sapiens
ggcgcgccagtcctttccccgggagggtctgacggtaagctgtacccacggctgaagtatgacctaccgttaaccggctacctacttcgagaagtctagtaataccattgaagttttgttggcgttacgctcaacacactaccccgtgtgtagttttggctgatgagtcacggcattccccacgggcgcgactcggaccgatg

SEQ ID NO: 7756 - DNA, 203 bp, Homo sapiens
ggcgcgccagtcctgccataacaactggactctttgtgtagtgccagttgttcccctagattactcagatggagcaaccacagtagttccagtcactgtaaccttggccccaatgtgttgtgagtttgatgggttaagaaatgcagtttcacagggcttgccagttaaggcaactccaggatcttatccgactcggaccgatg

SEQ ID NO: 7757 - DNA, 203 bp, Homo sapiens
ggcgcgccagtcctgcaagatattgatagcatacacccctccaggaggtagcgcacctacagatcgaaagagtgctatgttaggcacccacataatttgggattttgggctacaatcctcagccacccttgttattccctggattagtaatacatgtatgcgaaatgttgctagcttggcctatcaggcgactcggaccgatg

SEQ ID NO: 7758 - DNA, 203 bp, Homo sapiens
ggcgcgccagtcctttgatgcagagttcaccatgctagtgtgtgcggatgaagagattaacccttataatatacagtacatgtatgttccaccaggtagcggtgttccatctgatcatgattcttacttgtggcaatcaggtaccaacccatccatatacgtaaaatccactgatccacccgctcaatcgactcggaccgatg

SEQ ID NO: 7759 - DNA, 203 bp, Homo sapiens
ggcgcgccagtcctataactacatgcggttcaagaccaaatcccgcattgaacctgtatgtttgttaatacatgggagcccaggtgcagggaagtccgttgtatccagcctggtggggcgtgccattgctgaaaagatgaacagctcagtttattcccttccaccagacccagatcattttgatggttcgactcggaccgatg

SEQ ID NO: 7760 - DNA, 203 bp, Homo sapiens
ggcgcgccagtcctctataatctgtggaaaagccctgatgttcagtgataggcggacttcagtgcgttacaccactgatatgctggtctcagagatgtttagggaatactcacacaggaactcaattggcaatgtgcttgaggcactctttcagggaccaccagtctacaaggaattgaaaatttcagcgactcggaccgatg

SEQ ID NO: 7761 - DNA, 203 bp, Homo sapiens
ggcgcgccagtccttgagaagaaatgagaaattcagggacatccgagggtttttgccaaatgaaccaggagaaattggtgatgcagtgcttgctattaatactagcaggttcccaaacatgtttattcctgtaggaaaggtgactgaatatggatttctcaatctaagtgggacaccaacacacagagcgactcggaccgatg

SEQ ID NO: 7762 - DNA, 203 bp, Homo sapiens
ggcgcgccagtccttgctcatgtacaacttccctactaaatcagggcagtgcggtggagtgctaatggcaacaggaaaagttctaggaatccatgtgggaggcaatggacaccaaggctttgctgctactcttttgaggtcttactttaatgaagaacagggtcagattgaatggattgagaccaacacgactcggaccgatg

SEQ ID NO: 7763 - DNA, 203 bp, Homo sapiens
ggcgcgccagtcctaagaatcaggctatccaataatcaatgcccccaccaagaccaaattggaacccagtgtgttccacgatatctttgagggaaagaaagaaccagcagtcctgaacccaagagacccacgtttgaagactgattttgaggaagccattttctccaagtatgtagggaatgtgaacgcgactcggaccgatg

SEQ ID NO: 7764 - DNA, 203 bp, Homo sapiens
ggcgcgccagtcctgtccagtgtggttcgctgcactaaaactggtactggaaaagttaggttacactagtgatgaaaccaagtatattgactacttgtgtaactcataccacttgtataaaaacaagcattactttgtgagaggagggatgccatcgggatgttctggcacttctatcttcaacagtacgactcggaccgatg

SEQ ID NO: 7765 - DNA, 203 bp, Homo sapiens
ggcgcgccagtccttctccccgggaggggctaatggtacgctgtgcccacggcggaaatgagccctaccgttaaccggcagtctacttcgggaagcccagtaactacattgaaactttgaggcgttacactcagcacataaccccaatgtgtagttctggtcgatgagccttggcatcccccacaggccgactcggaccgatg

SEQ ID NO: 7766 - DNA, 203 bp, Homo sapiens
ggcgcgccagtcctaacttttaccactgatcaagataaaaatgggagcgcaggtgtctactcaaaagactggtgcgcatgaaactggtaacgttgccactggaggctcaacaataaattacacctccataaattattataaggattcagcatctaattcagctaacagacaggacttctctcaagacccgactcggaccgatg

SEQ ID NO: 7767 - DNA, 203 bp, Homo sapiens
ggcgcgccagtccttgtatcattatttaggtcgagcagggtacaccttccatgtacaatgcaacgcttccaggtttcaccaagggtgtcttcttgtagtgtgcgtaccagaagcagaaatggggtgttctaacgtgaacaatcaacccagttttgaacagttggctaatggagacacggcacatgtttcgactcggaccgatg

SEQ ID NO: 7768 - DNA, 203 bp, Homo sapiens
ggcgcgccagtccttcactgaagatgccgcaactggtgaacagggagtacagacagccgtttgcaacgcagcaatgggagttggtgtggggaacctgaccatctacccccatcagtggataaatttaagaacaaacaacagtgctacaatagtcatgccatatattaattgtgtaccaatggacaatacgactcggaccgatg

SEQ ID NO: 7769 - DNA, 203 bp, Homo sapiens
ggcgcgccagtccttgcaaagacataataacttgacactgatgataataccatttgttgagttagattactctgcaggggcaactacattcgttcccattaccgtgactgttgcccctatgtgcgcagagtataacggccttcgcctagcctcaccacagggcttgccaacaatgaatacaccaggtacgactcggaccgatg

SEQ ID NO: 7770 - DNA, 203 bp, Homo sapiens
ggcgcgccagtcctcaacgggtaagttgattctggcttattcacctccaggtgctggtgccccaacaaacaggaaacaggccatgctgggcacccacgttatatgggacttaggattgcaatctagctgtgtgctgtgtgtcccatggatcagccaaacccactacaggtatgtagtggtcgacacatcgactcggaccgatg

SEQ ID NO: 7771 - DNA, 203 bp, Homo sapiens
ggcgcgccagtccttctaccctgtgtccttccaaggccctggcattgtgcagatggcggcaaatgagtactaccccgaaagagcgcaaacacatgtcttgctggctaatggcccagcacaacctggtgattgcggcgggttgctgtgttgtacgcatggagtggttggcatcctcacagcgggtggtgcgactcggaccgatg

SEQ ID NO: 7772 - DNA, 203 bp, Homo sapiens
ggcgcgccagtccttacagttcaagtccaaatgccgcattgaacctgtgtgtctgctgttgcacggagctccaggagcgggtaaatcagtagccaccaatttgattggcagagcaattgcagagaagttaaatagctcagtatattctctaccacctgatccggaccactttgatggatataaacaaccgactcggaccgatg

SEQ ID NO: 7773 - DNA, 203 bp, Homo sapiens
ggcgcgccagtcctaggcagtggttattatggacgatttatgtcaaaaccccgatggaaaggatgtgtccctgttctgtcagatggtatctagtgttgactttgttccaccaatggctgcactagaagaaaagggaattttgttcacatcaccgtttgtgttggcttcaaccaatgctagctccatcccgactcggaccgatg

SEQ ID NO: 7774 - DNA, 203 bp, Homo sapiens
ggcgcgccagtcctatgccccaactgtttcagatagtagggctcttgcaagaagattccattttgacatgaacatagagatcctagacatgtaccagcagagcgggaagttgaacatgccattggcagccaagtcatgtgatgatgagtgtattccggcgaatttcaaaaaatgttgtcccttagtgtcgactcggaccgatg

SEQ ID NO: 7775 - DNA, 203 bp, Homo sapiens
ggcgcgccagtcctatatgccgcccccacctgctattgctgatttgttgaagagcgtggatagtgaagaattgagggaatactgtaaggagaaaggttggattattccagaacaggcctctagcctagtcaccgaaaaacatataagtagggcctttatttgcctacaagccctcactacctttatttcgactcggaccgatg

SEQ ID NO: 7776 - DNA, 203 bp, Homo sapiens
ggcgcgccagtcctataggaacgaaaagttcagggacattagagggtttataccaaaggaggaatctgagattggtgacgccatcctggctatgaatactagcaagtttccaaacatgttcataccagtgggtcaggtcactgagtatggtttcttaaacctgagtggagtccccacacaccgcatgccgactcggaccgatg

SEQ ID NO: 7777 - DNA, 203 bp, Homo sapiens
ggcgcgccagtccttcatgtacaactttccaacaagagccgggcagtgtggtgggatactgatggccactggtaaagtactcggcattcatgttggcggtaatggtcaccaagggtttgctgctgcactgctcagacactacttcgctgatgaacagggtgaaattgagtggacggtgcctagtaaggcgactcggaccgatg

SEQ ID NO: 7778 - DNA, 203 bp, Homo sapiens
ggcgcgccagtcctttaataatataataatcaggacccttttgttgaaagtgtataagaacattgatcttgataaatttaggatgattgcatatggagatgacgtaattgcatcatacccatattcaatagatgcaggcctacttgctaaggcggggaaggagtacggtctgacaatgacaccagctgcgactcggaccgatg

SEQ ID NO: 7779 - DNA, 203 bp, Homo sapiens
ggcgcgccagtcctgcctgtgggaaaatgccttctactcccagcctactctacattacgtagaaagtggcttgattcattttaattaggcccatatttgactttaatttggctaattgggttaaccctgtcacgtatctggacgtgacataagcgtgacaggggtaaatttagcacaaccagagtgctcgactcggaccgatg

SEQ ID NO: 7780 - DNA, 203 bp, Homo sapiens
ggcgcgccagtcctaatcccctacgtccttgattcaggtgtcccattatctcaagctcttatatacccacatcaatggatcaatctgaggacaaacaactgcgccacgatagtgatgccatacattaatgctgtgccttatgacagtgctttaaaccactgcaattttgggttagctattatccctgtcgactcggaccgatg

SEQ ID NO: 7781 - DNA, 203 bp, Homo sapiens
ggcgcgccagtccttgccactgctgatgatggacaagcagattctacaatgatacagtatatgtacataccaccaggtgctcccaaaccaacacagagagattcatttgaatggcagtcagccaccaatccttccatctttgttaggatggctgacccaccagcccaagtttctgtccctttcatgtccgactcggaccgatg

SEQ ID NO: 7782 - DNA, 203 bp, Homo sapiens
ggcgcgccagtcctgatgaaacacattagagcttgggtgccaagaccattcagaagccagccataccttctaaagaattatccaaacatggatggtacaaatttgaagtgcgctagcaccagcagagccaagataacaaccacaggggccttcggtcaacagtccggtgctatctatgtctgcaattacgactcggaccgatg

SEQ ID NO: 7783 - DNA, 203 bp, Homo sapiens
ggcgcgccagtcctggaaaagatcctcaaaaacttggtcaagattgtgtcagcactggtcatagtaatcaggagtgactacgacctagtcacgatgactgcaacacttgctttgatcggttgccacacaagcccatgggcatggttgaaatcaaaagtgtgtagcttccttggcctaccgatagcgcacgactcggaccgatg

SEQ ID NO: 7784 - DNA, 203 bp, Homo sapiens
ggcgcgccagtcctcaagaacaaacaacggattgaacctgtatgtttgatcatccgcggcgctccaggcacaggaaagtcactcgccacaggcatcattgctagagctattgcagaaaaataccactctagtgtttactccttgccaccagacccagaccattttgatggttaccgccagcaagttgtcgactcggaccgatg

SEQ ID NO: 7785 - DNA, 203 bp, Homo sapiens
ggcgcgccagtccttgtcatctacaaattgtttgctggttttcagggtgcttattcgggtatgcctaaaactgcactgaagaagccagtgttgagaactgccacagtgcaaggaccctgccttgactttgccttgtccctacttcgtaggaatattagacaagtgcagacagacaaaggccactttaccgactcggaccgatg

SEQ ID NO: 7786 - DNA, 203 bp, Homo sapiens
ggcgcgccagtcctcatgctcggcgtgcgtgaccgcattgctgtactgcctcgccatgctgagccaagtggaaccatctggatcgaaggcaagcaggtcaaagtcttagatgctgttgagttggtagatgaacaacaagtcaatcttgaactcactcttgttactcttgacatgaacgaaaagttcagcgactcggaccgatg

SEQ ID NO: 7787 - DNA, 203 bp, Homo sapiens
ggcgcgccagtcctcaaagctgggcaatgtggtggagtggtcaccagtgttggtaaaattattggaattcatgttggaggaaatgggcgccagggcttttgtgcagccttgaagcggtgttacttcaccactgagcaaggtgagattcaatggatgaaaccaaatagtgagactggtagatacaatatcgactcggaccgatg

SEQ ID NO: 7788 - DNA, 203 bp, Homo sapiens
ggcgcgccagtccttcaagcagctcaccattacgccaaccagctcaagcagctgaacatagacacatccaaaatgtctatggttgatgcctgttatggaactgaaaacctggaagcaatagaccttagcactagtgctggttacccatacaatgcattaggcgtcaagaaaaggcagattctgaaccccgactcggaccgatg

SEQ ID NO: 7789 - DNA, 203 bp, Homo sapiens
ggcgcgccagtcctcgggcatctattcgaggctttccacgccaatccaggcactattactggatctgctgtcggctgcaacccagacactttctggagcaagattcctatactcctaccaggatcactctttgcctttgattacacaggttatgatgctagtttgagccctgcatggtttagagctctcgactcggaccgatg

SEQ ID NO: 7790 - DNA, 203 bp, Homo sapiens
ggcgcgccagtccttgttaccccgggcttagtaccaatagactgccatcgcggttgaaggggaaaacgctcgttatccggctctctactgcgagaagcctagtaacgccttagaaatgctcaagcgttgcgctcagcacaaccccagtgtagctcaggtcgatgagtcactgcattccccacgggcgacgactcggaccgatg

SEQ ID NO: 7791 - DNA, 203 bp, Homo sapiens
ggcgcgccagtccttcgatgctattaaagaatcctctgtcccactcaagtcaccatcagctgaagcgtgtgggtatagcgatcgtgttgcgcagctgacactaggaaactccacagtcacaactcaagaagcagcaaacatcactgtcgcttatggtgagtggcccgagtattgtccagatacagatgcgactcggaccgatg

SEQ ID NO: 7792 - DNA, 203 bp, Homo sapiens
ggcgcgccagtcctgtttctgcattcatgttcagtgcaatgcgagcaagttccatcagggtactctacttgttgttgctataccagaaatgacagttgcgagatctagtggtgacaccaagcccaccactgcaccccacccttcttacgcagctgcacagcctggcccaaatggcaaagagtttgcttcgactcggaccgatg

SEQ ID NO: 7793 - DNA, 203 bp, Homo sapiens
ggcgcgccagtccttgtgtgcaagctttcgagtggatcctggtcgggcagggccatgggaatcaacgttagtgggacagtactgcaagtactacacacaatggtcgggctcgctggaagtcactttcatgttcacaggctcctttatggccacaggcaaaatgttgatcgcttacacaccgccaggtgcgactcggaccgatg

SEQ ID NO: 7794 - DNA, 203 bp, Homo sapiens
ggcgcgccagtcctctcacataagcagtgcactgacagcagcagacacacgcccaagcacacatcaagtagcgactggcaacactcctgcgctgcaagctgcagagactggggcgacatcgaatgctagtgatgagagtatgatcgagactcggtgtgtagtcaacaaacacagtgttgctgaaactacgactcggaccgatg

SEQ ID NO: 7795 - DNA, 203 bp, Homo sapiens
ggcgcgccagtcctgtgtagaacattttttctcaagggcagcattagttggttatattagcatactgacatcaacaacgaccgctaatggcttcacaaattgggatattgacatcatgggttttgtccaacagcgcaggaaagtggaaggtttcacatacatgaggtttgatgctgagttcacatttgcgactcggaccgatg

SEQ ID NO: 7796 - DNA, 203 bp, Homo sapiens
ggcgcgccagtcctttgccaccgcagacgacgggcaagcagacacgacgatgctccagtatatgtacatcccacctggagctcccaaacccactcaaagggactcattcgagtggcaatctgcaaccaacccatctctgtttgttcggatgagtgaacctcctgcacaagtgtcagttcctttcatgtcgactcggaccgatg

SEQ ID NO: 7797 - DNA, 203 bp, Homo sapiens
ggcgcgccagtcctggatgaagcacattagggcatggatccccaggcccttaagaaaccagccttatgtgctaaagaattaccctaactttgatggaacaaacatcaagtgcagctccaccagcaggcagagcatcaccaccacaggagcttttggtcaacagtctggtgcagtctatgtttgcaactcgactcggaccgatg

SEQ ID NO: 7798 - DNA, 203 bp, Homo sapiens
ggcgcgccagtccttagttgggtttgctgacttgagggacctattgtggctagaagatgatgtcatggagcaaggagtcacagattacattaaaggcctgggtgatgcttttggcactggcttcaccgactccatatctagagagatttccaacttgagagaccagttactcgggtctgagggagtggcgactcggaccgatg

SEQ ID NO: 7799 - DNA, 203 bp, Homo sapiens
ggcgcgccagtccttcaagagcaaacaacgtattgaaccagtatgtttaattattagaggcccaccaggcacaggaaaatcccttgccacaggcatcatagctagagccattgctgagaaatacaactctagtgtctactctctcccaccagaccccgatcattttgacgggtacaggcaacaagtggcgactcggaccgatg

SEQ ID NO: 7800 - DNA, 203 bp, Homo sapiens
ggcgcgccagtccttgacagttatggatgatttgtgtcaaaatcctgacggaaaggacatctcccttttctgccagatggtttctactgttgagttcatcccacccatggcctcacttgaagaaaaagggctcccgtttacttccaagtttgtgattgcatctaccaactccagtaatattattgtaccgactcggaccgatg

SEQ ID NO: 7801 - DNA, 203 bp, Homo sapiens
ggcgcgccagtcctaagcaatacaactgaaagatagaaagtccaaggtgagatatagcttagattctgttgtttctgagctcattagggagtataataacaggtgtagtgttggtaacacaattgaagcactgttccaaggaccccctgttttcaaacctattaagatctctatggaccaaccggccccgactcggaccgatg

SEQ ID NO: 7802 - DNA, 203 bp, Homo sapiens
ggcgcgccagtccttagagttggtgctgagggatctaggttacgatgagcaggccatatcagtgatagagggcatcaaccattcccaccatatctatagaaacaagacatattgtgtgcttgggggtatgccatccggatgctctggtaccagtatattcaactctatgatcaataacatcattatcacgactcggaccgatg

SEQ ID NO: 7803 - DNA, 203 bp, Homo sapiens
ggcgcgccagtcctggaccttgctgatcagaaccttcaaggggattgacctggatgagttgaatatggtggcatatggtgatgatgtgcttgctagctaccctttccccatagattgtcaggaacttgctaacacagggaaagaatatggcttgatcatgacacctgcagataagagtagctgtttcacgactcggaccgatg

SEQ ID NO: 7804 - DNA, 203 bp, Homo sapiens
ggcgcgccagtcctatgaggtcaactgggaaaatgccacatttcttaagagagggtttaaaccagataaacagtttcctttcctcatacatcctaccatgcccatgaaagagatccatgagtcgatcaggtggaccagggatgcgcgcaacacacaagaccacgtgcgctcactgtgtcttcttgcttcgactcggaccgatg

SEQ ID NO: 7805 - DNA, 203 bp, Homo sapiens
ggcgcgccagtcctgggtttgccgtacatgtgcagtgcaatgccagcaagtttcaccagggggctttattagtggtagctatacctgaatggacccaaggacgcggactaacgagcagcaccaacacttacatggagtactcacagaccaaccctggaaagaatggtggcacgttcaatcacccttatcgactcggaccgatg

SEQ ID NO: 7806 - DNA, 203 bp, Homo sapiens
ggcgcgccagtcctaattatgatgcaggggccactcctcttgttccaattaccatcaccatcgctcccatggcatgcgagttttcaggtctacgaaaggcaatctcccaagggttgccagcccaactgaccccaggttccactcagtttgtaacaacggacaatgacagttcccagccattaatcccacgactcggaccgatg

SEQ ID NO: 7807 - DNA, 203 bp, Homo sapiens
ggcgcgccagtcctggcttaagcaacacatcagcatctgatgcagtcattgagactgccaacacaccagcattgcaggcagccgaaacaggagccacgtcaaacgcagatgatgcagggctgatcgaaaccagggatgtcattaacacacaacgcccaactgaaacaactgtgcaggcgttctatgctcgactcggaccgatg

SEQ ID NO: 7808 - DNA, 203 bp, Homo sapiens
ggcgcgccagtcctagggctggtttagttggaatggtagatatcattcatagtgacagcaactcacccaagtttgcatcgtggaccatcgacacgatggcttttgtccaacaacggcgaaagctcgaaatgttcacgtacatgaggtttgctgcggagttcacctttgtagtgtcaactgaatccacacgactcggaccgatg

SEQ ID NO: 7809 - DNA, 203 bp, Homo sapiens
ggcgcgccagtcctacaaagatacctaacactatgattcagtatatgtacgtaccaccaggagcaccaatacccacgactagcaatgggtacgaatggcaatctggcaccaacccatcagttattgtacgtatgaatgaggcaccagctagagtgcgagttcccttcattagcccagcaggtgcatatcgactcggaccgatg

SEQ ID NO: 7810 - DNA, 203 bp, Homo sapiens
ggcgcgccagtcctgcctggttttatgatggctacactgattttggtactcatccctcaccaaatggtaaaggagatgcaaattatggattgaatccagccaatcagtttggcacttttgcaacccgcattattggaaacggggcaatctccgcgattaggattagaatttacatgaaaccaacgcaacgactcggaccgatg

SEQ ID NO: 7811 - DNA, 203 bp, Homo sapiens
ggcgcgccagtcctagacacttggctaatgagtttgacgcccagtcaatggtgtgggagagttatgagagagatcttctagtgtccaccactacagcccatggttgtgacgtaattgcccgatgcaattgtaacactggtgtgtatttctgccgtagcaagggaaaacactacccagtctgctttcaacgactcggaccgatg

SEQ ID NO: 7812 - DNA, 203 bp, Homo sapiens
ggcgcgccagtcctaaagcgttaatcaagattgtaagtgctcttgtgattatagttaggaatcatgaagatctcatcacagtaacggccactctagccctcattggatgttctgggtcaccatggcaatggttaaagaccaaagtatgccagtacttgcaaataccagtagtggaaaaacaaggagatcgactcggaccgatg

SEQ ID NO: 7813 - DNA, 203 bp, Homo sapiens
ggcgcgccagtcctgatttatgtcagaacccagatgggaaagatgtgagcttgctatgtcagatggtttccacagtggattttattccacctatggctagcttagaggaaaagggaattctatatacttcccctttcatgattgcatctactaaccatggttccatcactgctccaaccatctcggatcgactcggaccgatg

SEQ ID NO: 7814 - DNA, 203 bp, Homo sapiens
ggcgcgccagtcctgcagacttgttgaagtcagttgattctgaggaagtgagacaatactgtcaagagaagggttggataataccagtcactgagtgtcagacagaaagacacctcagtagagctttgactattctccaagctgtttcaacatttgtggctgtagctgggtgtatctacatagtgtaccgactcggaccgatg

SEQ ID NO: 7815 - DNA, 203 bp, Homo sapiens
ggcgcgccagtcctaagctgtttgctggatttcaaggggcatacactggattgcctttcaacaaacccaaagttccaaccataaggcaggcaaaggtacaaggaccttctttcgaatttgcagtggcaatgatgaagaggaattcagccattattaaaacaggacaaggtgagttcaccatgctcggtcgactcggaccgatg

SEQ ID NO: 7816 - DNA, 203 bp, Homo sapiens
ggcgcgccagtcctcaatgtggtggagtgttgatggcaactggtaaagtcataggtattcacgttggtggtaatggacatcaaggatttgctgccacactactcagagactacttcaatgaagaacaaggtgaaattgagtggatggagacaaacaaagaatcaggttacccaattatcaatgcaccacgactcggaccgatg

SEQ ID NO: 7817 - DNA, 203 bp, Homo sapiens
ggcgcgccagtcctgaccactatgctgggcaattaatgacccttgacattgacattagtgagatgtgccttgaggatgctgtttatgggactgaagggcttgaagcacttgacctgacaactagtgcaggatacccttatgtgacaatgggaatcaaaaagagagacatattatcaaagaaaactagacgactcggaccgatg

SEQ ID NO: 7818 - DNA, 203 bp, Homo sapiens
ggcgcgccagtcctcttgaaaaattaggttatgattacaaggctggcaggtacatttcgtacttgtgtcactcataccacctttacaaaaacaagcactattttgtgcgaggtggtatgccttcagggtgttctggtacatcaatcttcaactccatgataaacaacatcataattcgaacattgttgcgactcggaccgatg

SEQ ID NO: 7819 - DNA, 203 bp, Homo sapiens
ggcgcgccagtcctctgttgggcgatgtctactgctacctgcatacacaacactcaggcgcaagtggctcgaccaattctaaaatggttttcaatttgaccttaattcggcctaattggaagaccctgtcacgtatctggacgtgacaaaagcgtgacaggggtaaatttagcacaaccagagtgcttcgactcggaccgatg

SEQ ID NO: 7820 - DNA, 203 bp, Homo sapiens
ggcgcgccagtcctaaagccccgtggataagatccactgctgtgagcggtgcaaccccagcaccctggttcgatggccattctctatggaaccagaaaatggttttctcaagccctccggtagagaagccaagaatgtcctgaaggtaccccgcgcgcgggatctgatcaggagaccaattggcagtgcgactcggaccgatg

SEQ ID NO: 7821 - DNA, 203 bp, Homo sapiens
ggcgcgccagtcctaggcgtaatcatcaacaactactattcaaatcaataccaaaactcaattgatctttcagccaatgccaacggtgttggaaaagaaaattcaaaaccgcaaggtcagttgatgaatattcttggtagcgcggcggatgcattcaagaacatcgcgcctcttctcatggaccaggacgactcggaccgatg

SEQ ID NO: 7822 - DNA, 203 bp, Homo sapiens
ggcgcgccagtcctcactgaagaaatgaccaacctttctgatagagtgtcttcggacaccgcaggcaacacggccacaaacactcaatctacagtaggccgtttgtttgcatttggtacaagacacaagggtaaacatccagcttcctgtgctgacacagccactgacaaagtactcgctgccgagagcgactcggaccgatg

SEQ ID NO: 7823 - DNA, 203 bp, Homo sapiens
ggcgcgccagtcctgtactacacctttaaaatagccacttggtccacccaaaaagcatttgatcatgtaaggattccttttccccacgtcctatcaggaagcaaaggaggcgtttttggttctactctaagacgccactacttgtgtaagtgtggttggagaatacaggtacagtgtaatgcttcacacgactcggaccgatg

SEQ ID NO: 7824 - DNA, 203 bp, Homo sapiens
ggcgcgccagtccttgccttgaatcatcagaatcattggcagtggactgtctatccacatcaaattcttaacctcaggactaacactacgtgtgacttagaagtgccttatgttaacatttgtcccacgtcctcgtggacccagcacgctaactgggttttggtagtggctgttttgtctcctcttcacgactcggaccgatg

SEQ ID NO: 7825 - DNA, 203 bp, Homo sapiens
ggcgcgccagtcctatattcttcaggttcttcccccaatgtagacattactgtgtctgttcaacccgtaaagcctgtctttaacggtctcagacatacagttttggaggaccagagccccataccagtcacaattagagagcatgctggaacattctattccaccactccggacactaccgttcccatcgactcggaccgatg

SEQ ID NO: 7826 - DNA, 203 bp, Homo sapiens
ggcgcgccagtcctagctatgcaagccacatatgcgatttgggacttgggcctcaactctagctacaatttcaccgtcccattcatctccccgacacactaccgccaaacctcttatacaactccctcaatcacttccgttgacggttggctctcaatttggcaactaaccccactcacttacccagccgactcggaccgatg

SEQ ID NO: 7827 - DNA, 203 bp, Homo sapiens
ggcgcgccagtccttaacaccccacagagtgccgatatactaactttggtttcaggtggggatgacttcactctcagaatgccggtgactcctagtaagtacacgccccatggagtggataacgcagaaaaaggcaaggttgcaaatgacaacgcttcagcagactttgtagcagtccctatagctctcgactcggaccgatg

SEQ ID NO: 7828 - DNA, 203 bp, Homo sapiens
ggcgcgccagtccttcctgaaaaccagacaaaagtggccttcttttacgacagggcggtcctagcgtccgcccttgtcaatgctcaggacctgaactcaaacttttctcttcaagacgcagcaaatgtgatgaacaatgcacttttgacaccactcccaagcaaccgtcttgatgactcaacatatggcgactcggaccgatg

SEQ ID NO: 7829 - DNA, 203 bp, Homo sapiens
ggcgcgccagtcctctacaccccatgtcgcgcgccagtggatctgtctgaacaaactatcccctacactccatcattgtcagatacccgtgatccacatatgtgggttgttggacccggtgctactaatcaaatttcttttgtcattccttacacttctcctttgtccgtattaccagctgtttggttcgactcggaccgatg

SEQ ID NO: 7830 - DNA, 203 bp, Homo sapiens
ggcgcgccagtccttaatgggttttctgattttgacaacaaaacacggtttggtgttgcaccaaacgctgactttggtcgattgttcgttcagggtgcagacaggttctcggtccactaccggtacaaaaagatgagagtgttttgtccaagaccaactgtgtttttcccgtggcccgccaactcagtcgactcggaccgatg

SEQ ID NO: 7831 - DNA, 203 bp, Homo sapiens
ggcgcgccagtccttggacgccttctcgtctgtatgggcgagaagccctgtcagcttcccgtctctactcccaagtgtttctaccacatcgtttttactggctccagaaattcctttggtgtgtccatctacaaagctagatacagaccctggaagcagccccttcacgatgagttgtacgactatggcgactcggaccgatg

SEQ ID NO: 7832 - DNA, 203 bp, Homo sapiens
ggcgcgccagtcctcctacacaatccagatttgaccactactgtctgtctgtctttgatggctggaatagatgttctcactaatgatagtgtttttaactggctgtccactaaactatccaagttcttccacacccctgcccctcccattgttcctcttttgcaacaacagtctcctgttagagaagccgactcggaccgatg

SEQ ID NO: 7833 - DNA, 203 bp, Homo sapiens
ggcgcgccagtcctaaatgataactttaatttggcaaagaacatagaatgggcaataaaaacaattaaaagaatagtagaatggattacttcatggttcaaacaggaagaaacaagtcctcaagctaagttagataaaatgttagcagactttccagaacactgttcttccattcttgctatgagaaacgactcggaccgatg

SEQ ID NO: 7834 - DNA, 203 bp, Homo sapiens
ggcgcgccagtccttgctggacaaggaaagtccgtgaccagtcaaatcatcgcccaagcagtctccaaacttttgtttggtcgtcaatcagtttattctctcccaccggattcagattacttagatggttacgagaatcaatattcagtaatcatggatgatctgggacaaaatcccgatggcgaagacgactcggaccgatg

SEQ ID NO: 7835 - DNA, 203 bp, Homo sapiens
ggcgcgccagtccttttcaaagtattttgtcaaatggtttcaagcacaaattttctcccaaacatggcccacctggaaaagaaaggaactccattcacttctaacttcataatagcaacgaccaaccttcccaagtttcggcctgtcaccgtagcacactacccagctgttgatagaagaattaccttcgactcggaccgatg

SEQ ID NO: 7836 - DNA, 203 bp, Homo sapiens
ggcgcgccagtcctcaaccttcaacaagtggttaagatggtaaagaataccatcgataacaaagtggaaaacttgaagaaaatgaacacattggttgctcaatcacctggaaatgacatggattacgtgttgacctgtttgagacaaactaatgcagctttgcaagaccaaattgatgaacttcaagacgactcggaccgatg

SEQ ID NO: 7837 - DNA, 203 bp, Homo sapiens
ggcgcgccagtccttgcttactctggaggcaagaaaggtgagaagcaaacacttcaaattttggacgtacaaggcggaggaaagatcgtagcccaggctggaaacccaattatggattatgaagtaaacattgcaaagaatatggttacccccatcaccttcttttatgcagacaaggcacaagtcaccgactcggaccgatg

SEQ ID NO: 7838 - DNA, 203 bp, Homo sapiens
ggcgcgccagtcctaggacctttgttcaaggacaattctaggaaattttgttctaaagatgatgacttcccggctagaaacgagactgttacaggaattatgaatactggagtcccttttgtcttcactggaaagtttttggttggcaatcagccggttaacacaaccactggtgcatgtttcaatcacgactcggaccgatg

SEQ ID NO: 7839 - DNA, 203 bp, Homo sapiens
ggcgcgccagtcctttgtatacactatagagctacaacacatcgaggatggtgcgggtcggcactcatctgtcatgtcaacggcaagaaggccgtgtatgcaatgcactcagctggtggtggcggcatggctgccgctacgataatcactcaggaaatgattgaagctgctgaaaaggccttggattgcgactcggaccgatg

SEQ ID NO: 7840 - DNA, 203 bp, Homo sapiens
ggcgcgccagtcctagcaaagactagaattgtagacgtacccccatttcatcactgtatatggggacgtcaactattagggcgctttgcttctagatttcaaacaaatcctggcttggatcttggttcagcgattggcacggaccctgacacagattggaccgctttcgcctttcaactcttacagtacgactcggaccgatg

SEQ ID NO: 7841 - DNA, 203 bp, Homo sapiens
ggcgcgccagtcctagttaagggtggtctcccgtcagggtgtgccgctacaagcatgttgaacacaattataaacaacatagtaatcagagcagctttacacttgacctattctaactttgaatttgatgacatcaaagttttgtcttatggtgatgatttactcattgccacaaattatcaaattaacgactcggaccgatg

SEQ ID NO: 7842 - DNA, 203 bp, Homo sapiens
ggcgcgccagtccttaccaatgttattggtgtggtctgcgagttctagcctactcgtttctcccccgaccattcactcacccacgaaaagtgtgttgtaaccataagatttaacccccgcacgggatgtgcgataaccgtaagactggctcaagcgcggaaagcgctgtaaccacatgctgttagtcccgactcggaccgatg

SEQ ID NO: 7843 - DNA, 203 bp, Homo sapiens
ggcgcgccagtcctctttatggctgcaagatggctacccacctcggatcactgaactggagctcgaccctccttagtaagggaaccgagaggccttcgtgcaacaagctccgacacagagtccacgtgactgctaccaccatgagtacatggttctcccctctcgacccaggacttctttttgaatatcgactcggaccgatg

SEQ ID NO: 7844 - DNA, 203 bp, Homo sapiens
ggcgcgccagtcctccacggctcgatccagagggtggggcatgacccctagcatagcgagctacagcgggaactgtagctaggccttagcgtgccttggatactgcctgatagggcgacggcctagtcgtgtcggttctataggtagcacatacaaatatgcagaactctcatttttctttcgatacacgactcggaccgatg

SEQ ID NO: 7845 - DNA, 203 bp, Homo sapiens
ggcgcgccagtcctcagggaggcctcaacggaggggccttcacagctaccctacatagacactttttgatgaagtgcgggtggcaggtgcaggtccaatgtaatttgacacaattccaccaaggcgctcttcttgttgccatggttcctgaaaccacccttgatgtcaagcccgacggtaaggcaaagcgactcggaccgatg

SEQ ID NO: 7846 - DNA, 203 bp, Homo sapiens
ggcgcgccagtcctagcttacaggagctgaatgaagaacagtgggtggaaatgtctgacgattacgggaccgggaaaaacatgccttttcagtctcttggcacatactatcggccccctaactggacttggggtcccaatttcatcaacccctatcaagtaacggttttcccacaccaaattctgaaccgactcggaccgatg

SEQ ID NO: 7847 - DNA, 203 bp, Homo sapiens
ggcgcgccagtcctataaccgaccttttgcaactggcccgcatacccactctcatggcatttgagcgggtgcctgaacccgtgcctgcctcagacacatatgtgccctacgttgccgttcccacccagttcgatgacaggcctctcatctccttcccgatcaccctttcagatcccgtctatcagaaccgactcggaccgatg

SEQ ID NO: 7848 - DNA, 203 bp, Homo sapiens
ggcgcgccagtcctaccctggttggcgccatcagttcaaatttcgccaattaccgtgggtgtatccaaatcactctgacattttgtggacccatgatggcgagagggaaattcctgctctcgtattctcccccaaatggaacgcaaccacagactctttccgaagctatgcagtgcacatactctattcgactcggaccgatg

SEQ ID NO: 7849 - DNA, 203 bp, Homo sapiens
ggcgcgccagtccttgggacataggcttgaactctagttggaccttcgtcgtcccctacatctcgcccagtgactaccgtgaaactcgagccattaccaactcggtttactccgctgatggttggtttagcctgcacaagttgaccaaaattactctaccacctgactgtccgcaaagtccctgcattcgactcggaccgatg

SEQ ID NO: 7850 - DNA, 203 bp, Homo sapiens
ggcgcgccagtcctaagttcctgtttgatcgatctcgattattgaatgtaatcaaggtactggagaaggacgccgttttcccccgccctttccctacacaagaaggtgcgcagcaggatgatggttacttttgtcttctgaccccccgcccaacagtcgcttcccgacccgccactcgtttcggcctgcgactcggaccgatg

SEQ ID NO: 7851 - DNA, 203 bp, Homo sapiens
ggcgcgccagtccttccagctttgtctacgaccagctgcatgtgcccttccactttactgggcgcactccccgcgctttcgctagcaagggtgggaaggtatctttcgtgctcccttggaactctgtctcgtctgtgctccccgtgcgctgggggggggcttccaagctctcttctgctacgcggggtcgactcggaccgatg

SEQ ID NO: 7852 - DNA, 203 bp, Homo sapiens
ggcgcgccagtcctggcgatatcgagaccaatcctggtcctgcttctgacaacccaattttggagtttcttgaagcagaaaatgatctagtcactctggcctctctctggaagatggtgcactctgttcaacagacctggagaaagtatgtgaagaacgatgatttttggcccaatttactcagcgagcgactcggaccgatg

SEQ ID NO: 7853 - DNA, 203 bp, Homo sapiens
ggcgcgccagtcctctagtgggggaaggctctgtcgccttggccgccacgctatccaaccaagcttcagtaaaggctcttttgggcctgcactttctctctcgggggctcaattacactgacttttactctttactgatagagaaatgctctagtttctttaccgtagaaccacctcctccaccagctcgactcggaccgatg

SEQ ID NO: 7854 - DNA, 203 bp, Homo sapiens
ggcgcgccagtcctgacacccccgtcgacgaggcgttgggtagagttctctcccccgctgcggtcgatgaggcgcttgtcgacctcactccagaggccgacccggttggccgtttggctattcttgccaagctaggtcttgccctagctgcggtcacccctggtctgataatcttggcagtgggactccgactcggaccgatg

SEQ ID NO: 7855 - DNA, 203 bp, Homo sapiens
ggcgcgccagtcctgcggtcgctaagaaagtggtcgtccccattaccttcatggttcccaacagaccttctgggcttacacagtccgctcttctggtgaccggccggaccttcctaatcaatgaacatacatggtccaatccctcctggaccagcttcacaatccgcggtgaggtacacactcgtgatcgactcggaccgatg

SEQ ID NO: 7856 - DNA, 203 bp, Homo sapiens
ggcgcgccagtcctgacattctgaccgtcaaagaagcaattctgggcatccccggactagaccccatggatccccacacagctccgggtctgccttacgccatcaacggccttcgacgtactgatctcgtcgattttgtgaacggtacagtagatgcggcgctggctgtacaaatccagaaattcttacgactcggaccgatg

SEQ ID NO: 7857 - DNA, 203 bp, Homo sapiens
ggcgcgccagtcctgacggtgactactctgaccatgtcttccaaacttttctgaaagatgagatcagaccctcagagaaagtccgagcgggaaaaacccgcattgttgatgtgccctccctggcgcattgcattgtgggcagaatgttgcttgggcgctttgctgccaagtttcaatcccatcctggccgactcggaccgatg

SEQ ID NO: 7858 - DNA, 203 bp, Homo sapiens
ggcgcgccagtccttttagccctgcgctgggaccgtatctcagatccctggctgtctcggtgcacgcttacggcgagcgtcgcatcaagattaccggtggcctcccctccggttgtgccgcgaccagcctgctgaacacagtgctcaacaatgtgatcatcaggactgctctggcattgacttacaagcgactcggaccgatg

SEQ ID NO: 7859 - DNA, 203 bp, Homo sapiens
ggcgcgccagtcctttttgcgagaaatgggacgtctgcgcacgaaacgcgccgtcgcttgaggaggacttgtacaaacacgatctacgcaggtttccccaactgacacttaccgtgcaacttgaaatcccgcctggtctttccaggtctagaggggtgacaatttgtactgtggttgactccacgctccgactcggaccgatg

SEQ ID NO: 7860 - DNA, 203 bp, Homo sapiens
ggcgcgccagtcctactgatactggtactcaaacactggtggcaggctaaggatgcccttcaggtaccccgaggtaacacgcgacacttgggatctgagaaggggactgaggcttctttaaaagcgctcggtttaaaaagcttctacgcctgaacaggtgaccggaggccggcacctttctctacaatcgactcggaccgatg

SEQ ID NO: 7861 - DNA, 203 bp, Homo sapiens
ggcgcgccagtcctcatcctccagttgtttaggtacgtcgatgaacctttcttcgactgggtctataactcgcccgagaatcttacgcttgatgctatcaagcagttggaaaacttcaccgggcttgagttgcacgagggcggaccacctgcccttgtgatctggaacatcaaacacttgctccaaaccgactcggaccgatg

SEQ ID NO: 7862 - DNA, 203 bp, Homo sapiens
ggcgcgccagtcctaattacacacgggaaggctgaaaatgacaccttggtagtgtcggctagcgccggcaaagactttgagttgcgcctcccaattgacccccggccacaaaccactgctactggggagtccgcagaccctgtcaccaccaccgtggagaactacggcggtgagacacaagtccagagcgactcggaccgatg

SEQ ID NO: 7863 - DNA, 203 bp, Homo sapiens
ggcgcgccagtcctacgccaccacacggacgtcggcttcatcatggaccgatttgtgaagataaacagcctgagccccacacatgtcattgacctcatgcacacccacaaacacgggatcgtgggtgcgttacttcgtgcagccacgtactacttctccgacttggagattgttgtgcggcacgatggcgactcggaccgatg

SEQ ID NO: 7864 - DNA, 203 bp, Homo sapiens
ggcgcgccagtcctacctgactttaaccggttggtgtccgcttttgaggaattggccactggggttaaagctatcagaaccggtctcgatgaggccaaaccctggtacaagctcatcaagctcctaagccgcctgtcgtgcatggccgctgtggcagcacggtccaaggacccagtccttgtggccatcgactcggaccgatg

SEQ ID NO: 7865 - DNA, 203 bp, Homo sapiens
ggcgcgccagtcctcatgctggccgacaccggtctcgagattctggacagcactttcgtcgtgaagaaaatctccgactcgctctccagtctctttcacgtgccggcccccgccttcagtttcggagccccgattctgttggccgggttggtcaaggtcgcctcgagtttcttccggtccacacccgacgactcggaccgatg

SEQ ID NO: 7866 - DNA, 203 bp, Homo sapiens
ggcgcgccagtcctagaccttgagagagcagagaaacagctcaaagcacgtgacattaacgacatcttcgccattctcaagaacggcgagtggctggtcaaactgatccttgccatccgcgactggattaaggcatggattgcctcagaagagaagttcgtcaccatgacggacttggtgcctggcatcgactcggaccgatg

SEQ ID NO: 7867 - DNA, 203 bp, Homo sapiens
ggcgcgccagtcctctgctgtgctactggagtgtttggcactgcttacctcgtgcctcgtcatcttttcgcagagaagtatgacaagatcatgttggaaggcagagccatgacagacagtgattacagagtgtttgagtttgagattaaagtaaaaggacaggacatgctctcagacgcggcactcatcgactcggaccgatg

SEQ ID NO: 7868 - DNA, 203 bp, Homo sapiens
ggcgcgccagtcctggtgcttcaccgtgggaaccgcgtgagagacatcacgaaacactttcgtgatacagcaagaatgaagaaaggcacccccgtcgtcggtgttgtcaacaacgccgatgttgggagactgattttctctggtgaggcccttacctacaaggacattgtagtgtgcatggatggagacgactcggaccgatg

SEQ ID NO: 7869 - DNA, 203 bp, Homo sapiens
ggcgcgccagtcctcaccatgcccggcctctttgcctacaaagccgccaccaaggctggctactgtggaggagccgttcttgccaaggacggggctgacacatttatcgtcggcactcactctgcaggtggcaatggagttggatactgctcatgcgtttccaggtccatgcttcaaaagatgaaggccgactcggaccgatg

SEQ ID NO: 7870 - DNA, 203 bp, Homo sapiens
ggcgcgccagtcctagttgttctcgatgaagtcattttctccaaacacaaaggagacgtaaagatgaccgaagaggacaaagcgctgttccgccgctgcgccgctgactacgcgtcacgcctgcacagcgtgctgggtacggcaaatgccccattgagcatctacgaggcaatcaagggcgttgatggcgactcggaccgatg

SEQ ID NO: 7871 - DNA, 203 bp, Homo sapiens
ggcgcgccagtcctactcgacgccatggagccggacactgcacctggcctcccctgggccctccagggaaaacgccgcggtgcgctcatcgacttcgagaacggcacggtcggacccgaagttgaggctgccttgaagctcatggagaaaagagaatacaagtttgcttgtcagaccttcctgaaggacgactcggaccgatg

SEQ ID NO: 7872 - DNA, 203 bp, Homo sapiens
ggcgcgccagtcctgcaaagatttggcacacatttcgcccaatacagaaacgtgtgggatgtggattactcggcctttgatgcaaaccactgcagtgacgctatgaacatcatgtttgaggaggtgttccgcacagactttggcttccacccaaacgctgaatggatcctgaagactctcgtgaacaccgactcggaccgatg

SEQ ID NO: 7873 - DNA, 203 bp, Homo sapiens
ggcgcgccagtcctactaggctcacagtcgtacctcctccaggctgacgactgtcgcccttctagggcctacgaccttcaagttacggttttggcgttcttcccgcggccggatcgcctgcgcgaacgctggctcttcacccgaaggcctacctttcaccccccccccccataaagaacgtttccgtccgactcggaccgatg

SEQ ID NO: 7874 - DNA, 203 bp, Homo sapiens
ggcgcgccagtcctttttatgaagacaactgactgtttcaacgttttgctcgagatccttcacaggttcagacacacattcaagataaatagagagatggaattcacactctacaacggagagaagaagaccttctacagcaggcccaatacgcacgggaattgctggctcaactcgttgttgcagctcgactcggaccgatg

SEQ ID NO: 7875 - DNA, 203 bp, Homo sapiens
ggcgcgccagtcctctttcgatacgtcgatgagcctctcttcgagtctgagtacctgtcacctgaaaataagacattggatatgatcaaacaactttctgattacactaaactagacttgtcagacggtgggccacccgccctcgtcctgtggctgatcaaggactgtcttcaaactggcgttggcaccgactcggaccgatg

SEQ ID NO: 7876 - DNA, 203 bp, Homo sapiens
ggcgcgccagtcctcagcactcgccctagcgagatctgtgtgatcaacggggttgtcatgaccctggctgatttccacgccggcattttcatcaagggtaccgaacacgctgtgttcgccctcaacacatctgagggctggtacgccattgatgatgaggtgttctacccttggacacctgaccctgacgactcggaccgatg

SEQ ID NO: 7877 - DNA, 203 bp, Homo sapiens
ggcgcgccagtcctacacaagctttttgattggacactcgaacagcaatttggcacaacgcacattttggaactccccacagatcataagggcatctatgggcagctggttgactcacacgcgtacatccgaaacggatgggacgtgcaagtgtcggccactgccacacagtttaacggaggctgcctcgactcggaccgatg

SEQ ID NO: 7878 - DNA, 203 bp, Homo sapiens
ggcgcgccagtcctgttggtggccatggtgcctgagctgtgtaaactggctgacagagagaaataccaactcactctcttcccacaccaattcttgaacccacgcaccaacaccaccgcacacattcaggtaccatacctgggtgttgacagacacgaccagggaactcgtcacaaggcgtggaccctcgactcggaccgatg

SEQ ID NO: 7879 - DNA, 203 bp, Homo sapiens
ggcgcgccagtcctcgtcgtgatggtggtggcaccatacactaacgaccagacaattggctcactaaaagctgaggtctacgttaacattgcaccaaccaatgtgtacgtggccggtgagaaacccgccaaacagggaattttccctgtggccgttgctgacggctacggtggttttcagaacaccgacgactcggaccgatg

SEQ ID NO: 7880 - DNA, 203 bp, Homo sapiens
ggcgcgccagtccttgaaacaccagagatggcctcacactgctatcacgctgagtgggatactgggttgaactcaacatttaccttcaccgtgccgtacatttcagcagcggattacgcctacacctactctgatgagcctgaacaggcttcagtacaaggttgggttggtgtgtatcagatcactgacgactcggaccgatg

SEQ ID NO: 7881 - DNA, 203 bp, Homo sapiens
ggcgcgccagtcctcaccgacgtcgctttccttctcgaccggttcactctggttgggaaaaccatggaaaacaaaatggttctggatttgttgaccacgaaggagaaatcactggttggcgcactcctgcgtgcggccacgtattacttctctgatttggaggtggcatgcgtcgggaacaacaaatgcgactcggaccgatg

SEQ ID NO: 7882 - DNA, 203 bp, Homo sapiens
ggcgcgccagtcctcggaaacatccgcggggacctcgccgctgtggctgggaggatcgccagtgagacccacatcccgacgacatttaatttcgggatgatttacacagaggcagaggtggacgtgtacctgaggatgaaaagggcggaactctactgtccccgacccgttctcacgcactacgaccacgactcggaccgatg

SEQ ID NO: 7883 - DNA, 203 bp, Homo sapiens
ggcgcgccagtcctcatgtccaccaagcacggacccgacttcaaccgtctggtgtccgcatttgaggaattgacaaagggagttaaggctatcaaggacggtctcgatgaggccaaaccctggtacaaagtcattaaactcctcagccgcctgtcgtgcatggccgctgtcgcagctcgctccaaggacgactcggaccgatg

SEQ ID NO: 7884 - DNA, 203 bp, Homo sapiens
ggcgcgccagtccttttccggtccacgcccgaagacttggagagagcagagaaacaactcaaggcacgtgacatcaacgacatcttcgccatcctcaagaacggcgaatggctggtcaaacttatcctggctatccgcgactggatcaaagcctggatttcctcggaggagaagtacatctccatgaccgactcggaccgatg

SEQ ID NO: 7885 - DNA, 203 bp, Homo sapiens
ggcgcgccagtcctacccgtggtcgtttgcctccgtggcaaatccggccagggcaagagcttccttgctaatgtgctcgcacaagcaatctcaacccacttcactggcagaaccgactctgtctggtactgcccacctgaccccgaccacttcgacggttacaaccaacaaactgtcgttgtcatggacgactcggaccgatg

SEQ ID NO: 7886 - DNA, 203 bp, Homo sapiens
ggcgcgccagtcctaggacagcacgaagcggcaattgaattctacgaagggatggtacatgacagcattaaagaggaacttaagcccttgttggagcaaaccagcttcgccaagcgtgctttcaagcgcctcaaggagaacttcgaggtcatcactctcgttgttgtgctgttggcaaacatcatcatcgactcggaccgatg

SEQ ID NO: 7887 - DNA, 203 bp, Homo sapiens
ggcgcgccagtcctcaaaactgacgatgaagtgaactctgagccagccaaacccgcggagaaaccacaagctgaaggaccctatgctggcccccttgaacgacaacagccgctgaaacttaaggctaagctccctcaggctgagggaccttacgtcgggccactagagagacaacaaccactgaaattcgactcggaccgatg

SEQ ID NO: 7888 - DNA, 203 bp, Homo sapiens
ggcgcgccagtcctgagagcaagactgcctgtggccaaggaagggccatatgaaggaccagtgaagaagcctgtcgctttgaaactgaaagcaaaagccccgattgtcactgaaagcggatgcccaccgactgacttgcaaaagatggtcatggcaaacgtcaagcctgttgagcttatcctcgacggcgactcggaccgatg

SEQ ID NO: 7889 - DNA, 203 bp, Homo sapiens
ggcgcgccagtcctgaagacagttgcgctctgctgcgcgactggagtgttcgggacggcttacctcgtgcctcgtcatcttttcgcagagaagtacgacaagatcatgctggacggccgagccttgacagacagtgacttcagagtgtttgagtttgaggtaaaagtaaaaggacaggacatgctctccgactcggaccgatg

SEQ ID NO: 7890 - DNA, 203 bp, Homo sapiens
ggcgcgccagtcctcctgcaaatgaaagcccacatcgaccctccccctcacaccgaggggttggtagtggacaccagagaagttgaggagcgcgtgcatgtcatgcgcaagactaaacttgcacccaccgtggctcacggtgtgtttcagcctgaatttggacccgccgccctgtcgaacaacgacaacgactcggaccgatg

SEQ ID NO: 7891 - DNA, 203 bp, Homo sapiens
ggcgcgccagtcctacgcctgaacgaaggcgtggttctggacgaggtcatcttctccaaacacaagggcgatgccacaatgtctgaggctgacaaaagactgttccgtctgtgcgctgctgattatgcctcgcatcttcacaatgtgctggggacagccaactctccactgagcgtgtttgaagccatcgactcggaccgatg

SEQ ID NO: 7892 - DNA, 203 bp, Homo sapiens
ggcgcgccagtcctccctgatgttgattggcaacgatttggcactcactttgcccagtacaaaaacgtttgggacattgattattcggcctttgatgctaaccattgcagtgacgccatgaacatcatgttcgaggaggtcttccgtgaggaatttggatttcatccgaacgctgtttggattctcaacgactcggaccgatg

SEQ ID NO: 7893 - DNA, 203 bp, Homo sapiens
ggcgcgccagtcctttcctacggggatgacattgtagttgcaagtgattacgatttggactttgaagctctcaagcctcactttaaatctcttggtcaaacaatcactccagccgacaaaagcgacaaaggttttgttcttggtcagtccatcaccgatgtcactttcctcaagaggcattttcatttcgactcggaccgatg

SEQ ID NO: 7894 - DNA, 203 bp, Homo sapiens
ggcgcgccagtccttaggctggtcatcgtacctcctctaggctgacaactgtcgcccttttagggcccacgaccttcaagttacggttttagcgtccctcccgcggccgactcgcctacgtgaatgctagctcttcacccgaaggcctgcctttcaccccccccccccataaagaacgttaccgtcttcgactcggaccgatg

SEQ ID NO: 7895 - DNA, 203 bp, Homo sapiens
ggcgcgccagtcctactggcgggtgctagtaacactcactttgcttcgtagcggagcacatgagcggtgggaacacccccgtggtaacacggacccaccgggccaaaagccacgcctcacggcctcatgtgtgtgcaaccccagcacggcaaattgtttgtgaaacacatcttaaggtaacactgggacgactcggaccgatg

SEQ ID NO: 7896 - DNA, 203 bp, Homo sapiens
ggcgcgccagtcctccagcactcgccccagcgagatctgtgtgatcaacggggtcaccatgactctggccgatttccacgccggaattttcatcaagggtactgaacacgccgtgttcgctctcaacacatccgagggctggtacgccatagatgatgaggtgttctacccgtggacacccgaccctgcgactcggaccgatg

SEQ ID NO: 7897 - DNA, 203 bp, Homo sapiens
ggcgcgccagtcctacagcgtgcttgcgtacgtgccctacgaccaggaacccctggacgtagattggcaggaccgcgcaggcctgttccttcgtggagcgggtcagtcgtcccctgccactgggtcacaaaaccaatctggcaacactggtagtataatcaacaactactacatgcagcagtaccaaacgactcggaccgatg

SEQ ID NO: 7898 - DNA, 203 bp, Homo sapiens
ggcgcgccagtcctaggagacaactcttctggaggaccgcatcctcactacacgccacaacacaactacatccacaacacagagttctgttggcgtgacatacggttacgcctcgggggaccgtttcttgcctggacccaacaccagtgggctcgagacacgcgtcgaacaagcggagagattcttcacgactcggaccgatg

SEQ ID NO: 7899 - DNA, 203 bp, Homo sapiens
ggcgcgccagtcctttcttgtcgccatggtccccgagctacaagagttggagaagcgtgacgtttcacaactcacgctctttcctcaccagttcatcaacccgcgcaccaacaccaccgcccacattgtggtgccatacgtgggtgtcaacagacacgaccaggcaaagatgcacaaggcgtggacaccgactcggaccgatg

SEQ ID NO: 7900 - DNA, 203 bp, Homo sapiens
ggcgcgccagtccttcgtggtggcggtgctcgcaccgctaaccacttccaacatgggacaggacaacgtcgaggtgtatgcaaacatcgcacccaccaacgtgcacgttgctggagagaggccaatgaaacaaggcatcattcccgtggcctgcaacgatggctacggtggcttccagaacaccgatccgactcggaccgatg

SEQ ID NO: 7901 - DNA, 203 bp, Homo sapiens
ggcgcgccagtcctccaagaccgcagatccaatctacggtctagtgtccaacccaccgcgcacagcgtttcccggtaggttcactaacctgctagacgtcgctgaagcgtgtccaacattcctggactttgacggcacaccttacgtcaaaaccaggcacaacagtggtagcaagatactagcacacacgactcggaccgatg

SEQ ID NO: 7902 - DNA, 203 bp, Homo sapiens
ggcgcgccagtcctcgcacgaccctgactcggcggtgcttgtctcggtcagcgctggcgctgatcttgaatttcggctcccgattaaccctgcgacccaaacaactagtgcaggtgagggtggtgacgttgtgacaaccgatgtcacgacacatggcggagttgtggacacaccgcgacgccaacacacgactcggaccgatg

SEQ ID NO: 7903 - DNA, 203 bp, Homo sapiens
ggcgcgccagtcctccaacgtggagttcctgctggacaggttcacacacattggtacgatcaccgcctcaaagacaatcgacctcatggacacgaaggaacacacattggtgggcgcaatcctgcgctcggctacgtactacttctgtgacctggaggttgctgtcttgggctcggaaaaatggactgcgactcggaccgatg

SEQ ID NO: 7904 - DNA, 203 bp, Homo sapiens
ggcgcgccagtcctcgtgggttcccaacggttgcccacacaccgaacgcgtggaggacaacccagttgttcacgcgaagaacggtgtagcccgttttgccctgccatacacagcaccacacagggttcttgctacagtgtacaatggtaactgcaaatactccaaaacccagcacgttgtagcacgcccgactcggaccgatg

SEQ ID NO: 7905 - DNA, 203 bp, Homo sapiens
ggcgcgccagtcctgtggcgacatggcagtgttggcacaacgcgttgagagtgaaatcacaagatgcaggcccacaacattcaacttcgggagactgttgtgtgaaacaggtgaggtctactaccggatgaaaagagctgagctgtattgcccacgacccttgcgggtcaggtacacgcataccactgcgactcggaccgatg

SEQ ID NO: 7906 - DNA, 203 bp, Homo sapiens
ggcgcgccagtccttggcgatcatgctagctgacaccggtctcgagattctggacagcaccttcgtcgtgaagaaaatctccgacgcgctctccagcgttttccacgtcccggcccctgtcttcagtttcggagccccgattctgttggcaggtttggtcaaggtcgcctccacgttcttccggtccacgactcggaccgatg

SEQ ID NO: 7907 - DNA, 203 bp, Homo sapiens
ggcgcgccagtcctagaaccctgacggcaaggacttcaagtacttcgcccagatggtctccaccacagggttcatcccacccatggcttcgctcgaagataagggaaaaccgttcaacagcaaggtcatcattgcgacgagcaacctttattctgggttcacacctaggacgatggtctgccccgacgcgactcggaccgatg

SEQ ID NO: 7908 - DNA, 203 bp, Homo sapiens
ggcgcgccagtcctacggactcgacgccatggagcctgacacagcacccggtcttccctgggccctccaggggagacgccgcggagctctcatcgatttcgagaacggcactgtcggacccgagattgaacaggcactgaagctcatggagaagaaggagtacaagttcacctgccaaaccttcctgacgactcggaccgatg

SEQ ID NO: 7909 - DNA, 203 bp, Homo sapiens
ggcgcgccagtcctacacggaacacgcctacgagaacaagcgcatcactgttgaaggtggaatgccctcgggttgctccgccaccagcatcatcaacaccattctcaacaacatctacgtgctctacgccctgcgtagacactatgagggagtcgagctgtcgcactacaccatgatttcctacggggcgactcggaccgatg

SEQ ID NO: 7910 - DNA, 203 bp, Homo sapiens
ggcgcgccagtcctcacatgtcgccagtgtcagttgaaggtacgaatgtcatcatgttgattcttggattgaatattagtttgtataatgaaattaagcgcactttgaatgtagatagcataccaatggtacttaatttaaatgaattcagtagtatagttaaatcaattagcagtaaatggtataatcgactcggaccgatg

SEQ ID NO: 7911 - DNA, 203 bp, Homo sapiens
ggcgcgccagtcctgttgatgaattggataaattgccaatgtcaataaaatcaacggaggaactgattgaaatgaagaattctggaactttaactgaagaatttgagctactgatctccaactcagaagatgacaatgagtgaaattactaatgtcactatctaattatacagtatttagccatcacacgactcggaccgatg

SEQ ID NO: 7912 - DNA, 203 bp, Homo sapiens
ggcgcgccagtcctatattgtcaccatttctcagagcacaaaattatggtattaatcttccaatcacaggctccatggacactgcatacgctaattcaacgcaagaagaaacattcctcacttctacactttgcctatattatccgactgaggctgcgactgaaataaacgataattcatggaaagaccgactcggaccgatg

SEQ ID NO: 7913 - DNA, 203 bp, Homo sapiens
ggcgcgccagtcctacactgtcacaactatttcttacgaaagggtggccaactggatccgtatattttaaagaatatactaacattgcatcgttttctgttgatccgcagttgtattgtgattataacgtagtactaatgaaatatgacgcgacgttgcaattggatatgtcagaacttgcggatctacgactcggaccgatg

SEQ ID NO: 7914 - DNA, 203 bp, Homo sapiens
ggcgcgccagtcctaattgcagagcaacagattcaaaattttcaggtagctaattggttacattttgttaattataatcagtttagacaagtagtgattgatggagtgttaaatcaagtcttgaatgataatataagaaatggtcatgtagtcaaccaattaatggaagctctgatgcaattatctagcgactcggaccgatg

SEQ ID NO: 7915 - DNA, 203 bp, Homo sapiens
ggcgcgccagtccttgaaaaattgcaattaacatcagtaacatcattatgtatgctaattggaaatgctacggttataccgagtccgcaaacattgttccattactataatgtgaatgtcaattttcattcaaattataatgaaagaattaatgacgcagttgcaattataactgcggcaaatagattcgactcggaccgatg

SEQ ID NO: 7916 - DNA, 203 bp, Homo sapiens
ggcgcgccagtcctttgattttagagcgtcaatgcatatgttaacgtctaacctaacatttaccgtatattcagatttgcttgcgttcgtttcagctgatactgttgaaccaattaatgctgttgcttttgataatatgcgcatcatgaacgaactgtaaacgccaaccccattgtggagatatgacccgactcggaccgatg

SEQ ID NO: 7917 - DNA, 203 bp, Homo sapiens
ggcgcgccagtccttcgaatggtgagtcaaggcagctaaagtttggtaggaaaacaattttttcaactaaaaagaatatgcatgtcatggatgatatggctaacgaaagatacacgcctggtataataccaccagtgaatgttgataaaccaataccattaggaagaagagatgttccaggaagaaggcgactcggaccgatg

SEQ ID NO: 7918 - DNA, 203 bp, Homo sapiens
ggcgcgccagtcctgaaattttgatactattagactatcattccagttaatgagaccaccaaacatgacaccagcagtagcagtactattcccgaatgcacagccattcgaacatcatgcaacagtgggattgacacttagaattgagtctgcagtttgtgagtctgtactcgccgatgcaagtgaaacgactcggaccgatg

SEQ ID NO: 7919 - DNA, 203 bp, Homo sapiens
ggcgcgccagtcctggatataagtggtcagaaatatcatttaagccagcgaattatcaatacacatatactcgtgatggtgaagaagttaccgcacatactacttgttcagtgaatggcgttaatgacttcagttttaatggaggatatttaccaactgattttgttgtatctaaatttgaagtaattcgactcggaccgatg

SEQ ID NO: 7920 - DNA, 203 bp, Homo sapiens
ggcgcgccagtcctaaagagaattcatacgtctatatcgattactgggatgattcacaagcatttcgtaacgtggtgtatgtccgatcgttagcagcaaacttgaattcagttatgtgtactggaggcagctataattttagtctaccagttggacaatggcctgttttaactgggggagcagtttctcgactcggaccgatg

SEQ ID NO: 7921 - DNA, 203 bp, Homo sapiens
ggcgcgccagtcctggttcatctatacgttcgattggatcttcagcatcagcatggacggatgtatcaacacaaataactgatatatcgtcatcagtaagttcagtttcgacacaaacgtcaactatcagtagaagattgagactaaaggaaatggcaacacaaactgagggtatgaattttgatgatcgactcggaccgatg

SEQ ID NO: 7922 - DNA, 203 bp, Homo sapiens
ggcgcgccagtcctttaaaaatttgaacgataattacggcattactaagcaacaagcatttaatcttttaagatctgacccaagagttttacgtgaattcattaatcaggacaatcctataattagaaatagaattgaacaactgattatgcaatgcaggttgtgagtaatttctagaggatgtgacccgactcggaccgatg

SEQ ID NO: 7923 - DNA, 203 bp, Homo sapiens
ggcgcgccagtcctcacaccccactgactgactcctttggatcttgacctcggaatgcctacttgacctcccacttgcctctcccttttcggattgccggtggtgcctggcggaaaaagcacaagtgtgttgttggctaccaaactcctacccgacaaaggtgcgtgtccgcgtgctgagtaatgggacgactcggaccgatg

SEQ ID NO: 7924 - DNA, 203 bp, Homo sapiens
ggcgcgccagtccttaggagatgccaataacaggctcgcccatgagtagagcatggactgcggtgcatgtgacttcggtcaccaggggcatagcattgctcacccctgaatcaagtcatcgagatttctctgacctctgaagtgcactgtggttgcgtggctgggaatccacgcttgaccatgtactgcgactcggaccgatg

SEQ ID NO: 7925 - DNA, 203 bp, Homo sapiens
ggcgcgccagtcctcttgatagagtcgcggctggccgactcatgggttaaagtcagttgacaagacacatggcttcttcaattctgatctctgactccaccttcgcccccatcctcacccacaagctctctcgacgtgtcaggcgacaccccgttgcctggcatcccagagagaacacccggctgtcccgactcggaccgatg

SEQ ID NO: 7926 - DNA, 203 bp, Homo sapiens
ggcgcgccagtccttacatcacagccatggaagagttggatgcttgctacatcaacgaacaacaccggctcttcccccttccccgtccctctcattggtacaactgtctctactgtcaacatccctcggaggacggtgacactctcatgtcgctggcctgtgagtacgatgaagactgcccccaccatcgactcggaccgatg

SEQ ID NO: 7927 - DNA, 203 bp, Homo sapiens
ggcgcgccagtcctaggcctctttccaagttctttgctgaaaaccctcctcctgcttcccttgcagggaaaatgaatctctctgacttttctgacctcaccctctccacaccttgccaaatcgtgcgccagggaaattcaaccactaacatctacggaagtaataacaatgttactactgacgttggtcgactcggaccgatg

SEQ ID NO: 7928 - DNA, 203 bp, Homo sapiens
ggcgcgccagtcctgcaaacggttggactcctacggttaacacaggtcttggtgatggtcctgtctcctcttctgctgacgatcttgctggtcgctgtggtggatcctccaccgctagcaaggattcctccaaatcctctaaggttaaggttcacaactttaaccattggtgggaacctgctgcagctcgactcggaccgatg

SEQ ID NO: 7929 - DNA, 203 bp, Homo sapiens
ggcgcgccagtcctaaagctctctcccgtggcgttgacaaagcgctcgacgggattgagggcgccggcaaacttgccggtagtgccatcaaaagcaagctctcaggtgcccgccctggcccctcccctaatctcatagctctcaacccctcttccacccaatctggtaatgctatgatcacaacgggtcgactcggaccgatg

SEQ ID NO: 7930 - DNA, 203 bp, Homo sapiens
ggcgcgccagtccttccactgctcctgtggttgttgcttaccctcccaccccttctgtccctctccccaatccagatgctccctcacaacctggcccgtctggtgaccgtacatggttgctagacagtctcgaatggaccaccgaggacccatccttctggtgcctcgctggtccaaacgggatgcaacgactcggaccgatg

SEQ ID NO: 7931 - DNA, 203 bp, Homo sapiens
ggcgcgccagtcctacaatggctgagacgactggcgaaaaagttgccgaggctgtgattgaacctgtccttcttgctgctactggaactcctatttcttttgtcactaacctcttcgcccaatggcgaggggagctccagctttcccttcttttcactggttctgctcaacactttgggcgtcttgcacgactcggaccgatg

SEQ ID NO: 7932 - DNA, 203 bp, Homo sapiens
ggcgcgccagtcctactcttggtactgtctctatctgggtgatgaatccactcaccggaccatcatccgctcccccctctgctgtgatccaggctttcgtttctgctggggaatccttcaccttgcgtggtatccaagctcctggattccaaatccaggctgctgacgatgctgacgctcccactccacgactcggaccgatg

SEQ ID NO: 7933 - DNA, 203 bp, Homo sapiens
ggcgcgccagtcctgtttccaacattgagtctggttctgctactactgttcctgaacctcgtaccaccttctcctacactgacaatcctactccccctgacaccaacctacagcgtttcttctccatttacagacccatctttgtgaatggtcaggattactctgtgggcttcactgctgaggctggccgactcggaccgatg

SEQ ID NO: 7934 - DNA, 203 bp, Homo sapiens
ggcgcgccagtcctgtccgtcctaagggccgttcccgcattgtgcgtcagtgcttgactaacgatgtccccacccccacactctgtccagatgtgcgggtatacattgtcaaggtccagcgcatgacgtacacccattgggcactccgcgcggtccattcagatcgcgtggaacaaatttctctctcccgactcggaccgatg

SEQ ID NO: 7935 - DNA, 203 bp, Homo sapiens
ggcgcgccagtcctaacactggcttctctctcctccttggcttgggcgctcttgcccttctgtctggttgtgccgccgtgcaagcgtcgaaaggcggtataattcgacagggtcttctgtctcttgaagctcctcctgaggttgtccaggctgcaaaccgtgttgctgaatcaattgagaccactgctcgactcggaccgatg

SEQ ID NO: 7936 - DNA, 203 bp, Homo sapiens
ggcgcgccagtccttcggtagtgcgtgaggctgacctagccaggtctaccctcaatatctcaatggcagcaaaccgagttgctgagtcgattgaaaccaccgccaccgcagtgcgcgaggctgacctcgctagatcgaccctcaacatctcaatggctgcgtctgacatcagaatggcagcgacacagcgactcggaccgatg

SEQ ID NO: 7937 - DNA, 203 bp, Homo sapiens
ggcgcgccagtcctgtttcttccagtctgaacggcttcactgacatgctttcctctttctccaaaaccttcactcagggtgcttccaaaatgctgagtgatggtatttccactttccttacttgggtggccaaagtctttggttaccttcttgtcctctttggatctcccactccgatgtccatagctcgactcggaccgatg

SEQ ID NO: 7938 - DNA, 203 bp, Homo sapiens
ggcgcgccagtccttcctctgagcgcactccggtgtccgcgatcacggacgccatcacgcgctgtcgcgagctcaccaaggtggctgccgacgctaagtctggctctcactcttccttcctcctccaggccttgcgtaactaccaacttgctcttaattctgcacgcaaggcccaatctggtccccgtcgactcggaccgatg

SEQ ID NO: 7939 - DNA, 203 bp, Homo sapiens
ggcgcgccagtcctccagaacccgttgtgatctacctctatggtccaccgggaactggcaagtccctccttgcttctctccttgctagagttcttgctcagaagttatctggtaacccagatgacgtctactctccttcttctgccgtctgcgaatacttcgacggttacactggccaggtcgtccaccgactcggaccgatg

SEQ ID NO: 7940 - DNA, 203 bp, Homo sapiens
ggcgcgccagtcctctgggaaaggaacttacaatcatccatttccctaccatccgccaacatcgcgatctccgtcgctttattggctaccacccctatcccactggacatcttatttccactctctctggccctcctgtttacctgcggttttccaaaaaccgtatggttactcttgacctccccggtcgactcggaccgatg

SEQ ID NO: 7941 - DNA, 203 bp, Homo sapiens
ggcgcgccagtcctgttgtggaagaacctacagcttatggttacaaagcccccaccttccagggtctctgtggtgcacctctcatcacggatgatccagcaggtgttaagctgttgggactccacgttgccggggttactggttgctctggcttctctgtaccaatctctacctatcttcctgagatccgactcggaccgatg

SEQ ID NO: 7942 - DNA, 203 bp, Homo sapiens
ggcgcgccagtcctaaagtcacattaggcctcacacgtgtggtcgaagctgcacccatccacgctatcatcgctggtaggatgctgcttggtggactcattgagtacatgcaggcaaatcctggcaagcatggtagtgctgttggttgcaacccagacctacactggactaaattcttcttcaaattccgactcggaccgatg

SEQ ID NO: 7943 - DNA, 203 bp, Homo sapiens
ggcgcgccagtccttgtcactaccctcaagtctttgatctggattacaagtgttttgatgccaccctcccttcctgtgccttccgcattgttgagaaacacctcgaacgcctcattggagacgaacgggtaacccgttacatcgagaccatacgacactcgcgccatgtctttggcaacgagacgtatcgactcggaccgatg

SEQ ID NO: 7944 - DNA, 203 bp, Homo sapiens
ggcgcgccagtcctccatcattcatcaaggagttctacgacaggtacaccccacttgttgtgactccagcaaacaaaacagacactttcccggaaaactccaccatctatgacgtcacgtttctgaaacgttggtttgtgcctgatgacattcgaccattctacatccacccggtcatggatccagaccgactcggaccgatg

SEQ ID NO: 7945 - DNA, 203 bp, Homo sapiens
ggcgcgccagtcctcgatgccgggaaggccatttcgtttgctaccacattgggagtgaacaagtgccacgtacagatcatggacctcgggcacatgtgtgacgccaccatgagttatgagtgccctatgctggatgagggagtggaaccagatgatgtcgattgctggtgcaacacgacatcaacttgcgactcggaccgatg

SEQ ID NO: 7946 - DNA, 203 bp, Homo sapiens
ggcgcgccagtccttgtcttggaacatggaggctgcgttaccgtgatggcacaggacaagccaacagtcgacatagagttggtcacgacgacggttagtaacatggccgaggtaagatcctattgctacgaggcatcgatatcggacatggcttcggacagtcgttgcccaacacaaggtgaagcctacgactcggaccgatg

SEQ ID NO: 7947 - DNA, 203 bp, Homo sapiens
ggcgcgccagtcctagtcgggggtgtgttcaactcactgggtaagggcattcaccagatttttggagcagccttcaaatcactgtttggaggaatgtcctggttctcacagatcctcataggcacgctgctagtgtggttaggtttgaacacaaagaatggatctatctccctcacatgcttggccctcgactcggaccgatg

SEQ ID NO: 7948 - DNA, 203 bp, Homo sapiens
ggcgcgccagtcctagtcaagcaggcctgggaagaggggatctgtgggatctcatccgtttcaagaatggaaaacatcatgtggaaatcagtagaaggggagctcaatgctatcctagaggagaatggagttcaactgacagttgttgtgggatctgtaaaaaaccccatgtggagaggtccacaaagcgactcggaccgatg

SEQ ID NO: 7949 - DNA, 203 bp, Homo sapiens
ggcgcgccagtccttgaggaatgtccaggcaccaaggtttacgtggaggagacatgcggaactagaggaccatctctgagatcaactactgcaagtggaagggtcattgaggaatggtgctgtagggaatgcacaatgcccccactatcgtttcgagcaaaagacggctgctggtatggaatggagatcgactcggaccgatg

SEQ ID NO: 7950 - DNA, 203 bp, Homo sapiens
ggcgcgccagtcctaggactactgttactcacaaggagtgggaagcggagctggccccctagtgaagttctcacagccgttggcctgatatgtgcactggccggagggtttgccaaggcagacattgagatggctggacccatggctgcagtaggcttgctaattgtcagctatgtggtctcgggaaacgactcggaccgatg

SEQ ID NO: 7951 - DNA, 203 bp, Homo sapiens
ggcgcgccagtcctgagtgtggacatgtacattgaaagagcaggtgacatcacatgggaaaaggacgcggaagtcactggaaacagtcctcggcttgacgtggcactggatgagagtggtgacttctccttggtagaggaagatggtccacccatgagagagatcatactcaaggtggtcctgatggccgactcggaccgatg

SEQ ID NO: 7952 - DNA, 203 bp, Homo sapiens
ggcgcgccagtcctactcagcgaggtacagcttttggccgtacctcccggagagagggccagaaacattcagaccctgcctggaatattcaagacaaaggacggggacatcggagcagttgctctggactaccctgcagggacctcaggatctccgatcctagacaaatgtggaagagtgataggactcgactcggaccgatg

SEQ ID NO: 7953 - DNA, 203 bp, Homo sapiens
ggcgcgccagtccttgatgcgtttcctgactctaactcaccaatcatggacacagaagtggaagtcccagagagagcctggagctcaggctttgattgggtgacagaccattctgggaaaacagtttggttcgttccaagcgtgagaaacggaaatgaaatcgcagcctgtctgacaaaggctggaaacgactcggaccgatg

SEQ ID NO: 7954 - DNA, 203 bp, Homo sapiens
ggcgcgccagtcctgcgggtcatacagctcagcaggaagacttttgagacagaatttcagaaaacaaaaaatcaagagtgggactttgtcataacaactgacatctcagagatgggcgccaacttcaaggctgaccgggtcatagactctaggagatgcctaaaaccagtcatacttgatggtgagagcgactcggaccgatg

SEQ ID NO: 7955 - DNA, 203 bp, Homo sapiens
ggcgcgccagtcctagtcatcttggctgggcccatgcctgtcacgcatgctagtgctgctcagaggagaggacgtataggcaggaaccctaacaaacctggagatgagtacatgtatggaggtgggtgtgcagagactgatgaaggccatgcacactggcttgaagcaagaatgcttcttgacaacatcgactcggaccgatg

SEQ ID NO: 7956 - DNA, 203 bp, Homo sapiens
ggcgcgccagtcctcgctggaaaaagaggagcggctttgggagtaatggaggccctgggaacactgccaggacacatgacagagaggtttcaggaagccattgacaacctcgccgtgctcatgcgagcagagactggaagcaggccttataaggcagcggcagcccaactgccggagaccctagagaccgactcggaccgatg

SEQ ID NO: 7957 - DNA, 203 bp, Homo sapiens
ggcgcgccagtcctgtttttattactggtggtgctcatacccgagccagagaagcaaagatctccccaagataaccagatggcaattatcatcatggtggcagtgggccttctaggtttgataactgcaaacgaacttggatggctggaaagaacaaaaaatgacatagctcatctaatgggaaggagcgactcggaccgatg

SEQ ID NO: 7958 - DNA, 203 bp, Homo sapiens
ggcgcgccagtccttggcatgggcaaagggatgccatttatgcatggggaccttggagtcccgctgctaatgatgggttgctattcacaattaacacccctgactctgatagtagctatcattctgcttgtggcgcactacatgtacttgatcccaggcctacaagcggcagcagcgcgtgctgcccacgactcggaccgatg

SEQ ID NO: 7959 - DNA, 203 bp, Homo sapiens
ggcgcgccagtcctggctggagctctgatcacagcagcgacctccaccttgtgggaaggctctccaaacaaatactggaactcctctacagccacctcactgtgcaacatcttcagaggaagctatctggcaggagcttcccttatctatacagtgacgagaaacgctggcctggttaagagacgtggcgactcggaccgatg

SEQ ID NO: 7960 - DNA, 203 bp, Homo sapiens
ggcgcgccagtcctaggtgggacgggagagactctgggagagaagtggaaagctcgtctgaatcagatgtcggccctggagttctactcttataaaaagtcaggtatcactgaagtgtgtagagaggaggctcgccgtgccctcaaggatggagtggccacaggaggacatgccgtatcccggggaagcgactcggaccgatg

SEQ ID NO: 7961 - DNA, 203 bp, Homo sapiens
ggcgcgccagtccttgcaaagatcagatggttggaggagagaggatatctgcagccctatgggaaggttgttgacctcggatgtggcagagggggctggagctattatgccgccaccatccgcaaagtgcaggaggtgagaggatacacaaagggaggtcccggtcatgaagaacccatgctggtgcacgactcggaccgatg

SEQ ID NO: 7962 - DNA, 203 bp, Homo sapiens
ggcgcgccagtcctaagctatgggtggaacatagttcgtctcaagagtggagtggacgtcttccacatggcggctgagccgtgtgacactctgctgtgtgacataggtgagtcatcatctagtcctgaagtggaagagacacgaacactcagagtgctctctatggtgggggactggcttgaaaaaagcgactcggaccgatg

SEQ ID NO: 7963 - DNA, 203 bp, Homo sapiens
ggcgcgccagtcctaccaggggccttctgtataaaggtgctgtgcccatacaccagcactatgatggaaaccatggagcgactgcaacgtaggcatgggggaggattagtcagagtgccattgtgtcgcaactccacacatgagatgtactgggtctctggggcaaagagcaacatcataaaaagtgtcgactcggaccgatg

SEQ ID NO: 7964 - DNA, 203 bp, Homo sapiens
ggcgcgccagtcctatacggccaacaaagagtcttcaaagaaaaagtggacaccagggtgccagatccccaagaaggcactcgccaggtaatgaacatagtctcttcctggctgtggaaggagctggggaaacgcaagcggccacgcgtctgcaccaaagaagagtttatcaacaaggtgcgcagcaacgactcggaccgatg

SEQ ID NO: 7965 - DNA, 203 bp, Homo sapiens
ggcgcgccagtccttctcagaccagctgaaggaggaaaaacagttatggacatcatttcaagacaagaccagagagggagtggacaagttgtcacttatgctctcaacacattcaccaacttggtggtgcagcttatccggaacatggaagctgaggaagtgttagagatgcaagacttatggttgttcgactcggaccgatg

SEQ ID NO: 7966 - DNA, 203 bp, Homo sapiens
ggcgcgccagtcctaccctcgactggatggagcaattgggaagaagtcccgttctgctcccaccacttcaacaagctgtacctcaaggatgggagatccattgtggtcccttgccgccaccaagatgaactgattggccgagctcgcgtctcaccaggggcaggatggagcatccgggagactgcctgcgactcggaccgatg

SEQ ID NO: 7967 - DNA, 203 bp, Homo sapiens
ggcgcgccagtccttcttgcaaaatcatatgcgcagatgtggcagctcctttatttccacagaagagaccttcgactgatggctaatgccatttgctcggctgtgccagttgactgggtaccaactgggagaaccacctggtcaatccatggaaagggagaatggatgaccactgaggacatgctcatcgactcggaccgatg

SEQ ID NO: 7968 - DNA, 203 bp, Homo sapiens
ggcgcgccagtcctaggagaagctgggaaaccaagctcatagtcaggccgagaacgccatggcacggaagaagccatgctgcctgtgagcccctcagaggacactgagtcaaaaaaccccacgcgcttggaagcgcaggatgggaaaagaaggtggcgaccttccccacccttcaatctggggcctgacgactcggaccgatg

SEQ ID NO: 7969 - DNA, 203 bp, Homo sapiens
ggcgcgccagtcctccttttcggcctaaagaagatccttatgaagttgctgggagggtttggaccagttaggctggttctagccttccttgccttcttcaaattcacatcgctgcgcccttcccctggactcctcaagagatggagctcggtagggaagaaagaggccagcagaaccctcaaagggttcgactcggaccgatg

SEQ ID NO: 7970 - DNA, 203 bp, Homo sapiens
ggcgcgccagtcctacctggcgaggatggcatcaacaggtgcatactgcaggccatggatgttggcgaactctgcgctcataccatgacgtatgaatgcccaatccttgataagttggttgaacctgaagacatagactgctggtgcaatgcttcggccacctgggtgatgtacgggacgtgtttgcacgactcggaccgatg

SEQ ID NO: 7971 - DNA, 203 bp, Homo sapiens
ggcgcgccagtcctgacagtcatgggtgaaaacagacccaccatcgacatagagcttctcaagacagctgcctccaacatggctcatgcaagggcctactgctatgaggcgaccataagtgatacagtcatggagacaagatgcccgacacaaggagaagcagtgtctgacaaaaaaggggatggcaacgactcggaccgatg

SEQ ID NO: 7972 - DNA, 203 bp, Homo sapiens
ggcgcgccagtccttatcggaaaggcagtgcaccaggttctgggcggagccttcaggacgctgtttggtggcatgaattggttcaccaagatcctgatcggtgggctactgtgctggctgggagtgaactcccgtagcacgtcgctggcagcagggttcatcacattgggggcaatcctcatctttttcgactcggaccgatg

SEQ ID NO: 7973 - DNA, 203 bp, Homo sapiens
ggcgcgccagtcctctctacgcacacaatttggagtgagggagtggaggagagtcatttgatcatcccacacacactagcaggaccacgctcttggcacaacaccaggaaaggataccagacccaggtcaaggggccttgggctgaaggtgagcttgaattggtttttgaccactgcccaggaaccaccgactcggaccgatg

SEQ ID NO: 7974 - DNA, 203 bp, Homo sapiens
ggcgcgccagtcctggtcactctcatggacttgggcaggtacatgttcctggtggggacagcgttcgctgaagtgaactctggtagagacgtggcccatctggcgttgattgccactttcaaagttaggccggcattgctaacaacatatctatggagattgcactggggcacaagggaagagataggcgactcggaccgatg

SEQ ID NO: 7975 - DNA, 203 bp, Homo sapiens
ggcgcgccagtcctgagaaggagctggcccccaacagaagctctatccgccgtagggatgttgggcctggtgatgggcgcgacgatgaagcccggagctgagctgtcagggccactcgtagcctccggcctcctgctggtttgctacatcatatctggaaaaggcacagatctttttttagagcgcgccgactcggaccgatg

SEQ ID NO: 7976 - DNA, 203 bp, Homo sapiens
ggcgcgccagtccttgcggaactgtcctggtgtccggacgcagcggtttcaggcaccagcccaaggcttgatgtgaagatcacagaaggtggagatatggaactgattgatgataaaggaccatccacagaatctatcgtcctcaaggcaaccctcgtggctgtgtgtggaatgtggccgctggcaatcgactcggaccgatg

SEQ ID NO: 7977 - DNA, 203 bp, Homo sapiens
ggcgcgccagtcctggcaccaggtaaaggagcagagaatgtgcagaccaaacctgggatattcaacacagccacagggaccataggggcggttgcattggattaccccgctggcacctctggctcacccatcctaaacagtgaagggaaggttgtgggcttgtacgggaacggtgtgctggtgggcggcgactcggaccgatg

SEQ ID NO: 7978 - DNA, 203 bp, Homo sapiens
ggcgcgccagtcctaagctcatatgtgagtgccatatcccaggtcaagcaccctgagacccaaccacaggtggtcagtgacgacatgttcaggaaaaagaacttgaccattcttgacctccatcccggggcgggaaagaccagacgcatcctgcctgagatagtgaaacaagctattgacaggaggatcgactcggaccgatg

SEQ ID NO: 7979 - DNA, 203 bp, Homo sapiens
ggcgcgccagtcctgaggacagtcatcttggccccgacgagagttgttgccgcggagatgggtgaggctctgaaggggctgcccgttagatacatgaccacagccgtgcagagagagcacacaggaaccgagatcgtggatgtcatgtgccatgcaacattcaccatgcggttgatacagcccatgcgcgactcggaccgatg

SEQ ID NO: 7980 - DNA, 203 bp, Homo sapiens
ggcgcgccagtcctagatgacatggaaatcatggttcccgataaaccctggaataaagggtttgaatgggtcaccgactatcctggcaagactgtgtggtttgttcctagtgtccgcaatgggaatgagatagcatgttgtctggaaaaggcaggaaagaaaaccattcagctaaataggaaaagcttcgactcggaccgatg

SEQ ID NO: 7981 - DNA, 203 bp, Homo sapiens
ggcgcgccagtcctcaacacagagtatcagagaacaaagaatgaacaatgggactttgtgatcacaacagacatctcggagatgggcgccaactttgacgctgagcgcgtgattgactcacgaaaatgcataaaaccagtcattctggaggaaggcagggttaacctggtgggaccaatcccagtgaccgactcggaccgatg

SEQ ID NO: 7982 - DNA, 203 bp, Homo sapiens
ggcgcgccagtcctcgcctcaagcgccgctcagagaagagggaggatcggcagaaatccgagtagaacaggtgacgagtaccgatactcgggggggaccgttgaggatgatagtgaccacgcccactggacagaagccaaaatcctccttgacaatgtgcagatgccagacaggataataccccagctcgactcggaccgatg

SEQ ID NO: 7983 - DNA, 203 bp, Homo sapiens
ggcgcgccagtcctctatggacctgagcaaggaaaagtgaatgacgttgacgggatctacagactgcgggagccagagaaaaaagtgttcattgagcttctcaagagagctgaattgccagtgtggctaacctaccaggtcgcgtcagcgggcatacagtacaatgacaaaaaatggtgctttgatggcgactcggaccgatg

SEQ ID NO: 7984 - DNA, 203 bp, Homo sapiens
ggcgcgccagtcctaacgggcggtggatgcttgctgatgatgaagagcaaacccatagggaaaatgactgcgggactggtggtgacattggtagcagccggcctgtgttggcaagccaacgtcagtaaggttgtgatcgccagcgggatgaccgtgaccttgctcctgctgatagtgctcgtcccagacgactcggaccgatg

SEQ ID NO: 7985 - DNA, 203 bp, Homo sapiens
ggcgcgccagtcctacggctcgaacttgatttgaaacctgcaaccacctggacactgtacgcagtcattaccattatcttgtcacccttcgtgcagcacagcatcattaccacatacaacaacttctcattgacagcaataggcaaccaggccgggattctgttcggaatggggacgggagtccccttcgactcggaccgatg

SEQ ID NO: 7986 - DNA, 203 bp, Homo sapiens
ggcgcgccagtcctctacagaacttgggcttacctagggagttacaccaccgagccaaagggaacatccgcctccatggtgaacggagtcgtgaagcttctcacgaagccctgggatgtggtgagcggagttgtgaacatagccatgaccgacacaaccccttttgggcaacagagagtgttcaaggacgactcggaccgatg

SEQ ID NO: 7987 - DNA, 203 bp, Homo sapiens
ggcgcgccagtcctcgccgatgacacagcaggatgggacactcgtgttacggaagcagacttggatgacgaagcgctcatcatagagagcatggacagagagcacgcccagctggcttcggtgctcacggaaatggcttacaagaacaaagtggtttgtgtgctgaggccgggaaaaggggaaaccctcgactcggaccgatg

SEQ ID NO: 7988 - DNA, 203 bp, Homo sapiens
ggcgcgccagtcctgatggatgtgattagccgcagggaccaaagagggagtgggcaggtggtgacatacgcactgaacacctttacaaatgagaaagtccagctcattagatgcatggaggccgagggcgtcctagaagagagtgacgcagagcacctgatggatgagagcaaagtcaacaaatggctcgactcggaccgatg

SEQ ID NO: 7989 - DNA, 203 bp, Homo sapiens
ggcgcgccagtccttgtgcggcctgcgagccccctgggactatcggtatccaggctaaacaaaaaccgttgcacctcattgggctggtgcgtaaaatgacattgcggggcccaagccggctaagctgtaaccggtggaaggactaggaggttagaggagaccccccgcgcccataaccaacataaaaccgactcggaccgatg

SEQ ID NO: 7990 - DNA, 203 bp, Homo sapiens
ggcgcgccagtcctgctgtaaccggtggaaggactaggaggttagaggagaccccccgcgcccataaccaacataaaacagcatattgacacctgggaaagaccggagactctgttggctttccccacaccagccccctggcacagagcgccagatcgggggttggtgtggagcaacccaacaggactcgactcggaccgatg

SEQ ID NO: 7991 - DNA, 203 bp, Homo sapiens
ggcgcgccagtcctgatatctcggatcaagaggatgctcgatggactactcagaggagtaggaccagtcagaattgtcttggcgatcttaacctttttcaaatttacagctttgaaaccaacggcaggattgttgagacgatggaagctagtgggggtggttgaggccacccgccacttgaaaagcttcgactcggaccgatg

SEQ ID NO: 7992 - DNA, 203 bp, Homo sapiens
ggcgcgccagtcctggcggttatgatcccaactgctggaggaaacaaccgatgcgttgtgaaagctctggatgtcggattgatgtgccctgatgacatcacgtatttatgtcccaagctagaggatgggtatgacccagaggatatagactgctggtgcaacaccacggagatctacatccactacggcgactcggaccgatg

SEQ ID NO: 7993 - DNA, 203 bp, Homo sapiens
ggcgcgccagtcctccggtgcaccccaacgcgacacgcgagacgatcgaggcggtctatcacagtgcaccatcacggagagagcttgctcgaagcaaagaatacaccatggatggactcaaccaaggctaccaaatacttgaccaaggtggaaaactgggccatacgtaaccctggatacgcactagccgactcggaccgatg

SEQ ID NO: 7994 - DNA, 203 bp, Homo sapiens
ggcgcgccagtcctaagctgtgtgaccattacagcaaaggacaagcccacaatcgatgtgaagatgatgaacatggaagccactgacttggcgcttgtgagatcatattgttacgagcctaaaatcactgatgttagtactgaaccaagatgccccaccatgggagaggcccacaacaccaaagccaacgactcggaccgatg

SEQ ID NO: 7995 - DNA, 203 bp, Homo sapiens
ggcgcgccagtccttaaccaggagtacgtgtgtaagaaaggttatactgacagaggttggggtaatggttgtggactgttcggaaagggcagtattcacacatgcgccaaatttgagtgcaccaataaggctgagggaagaattgtgcagaaggaaaatgttcatttcgagttggctgtgtttgtgcacgactcggaccgatg

SEQ ID NO: 7996 - DNA, 203 bp, Homo sapiens
ggcgcgccagtcctagggcatgggacagttgttgtggaactcagctattctgggtctgatggaccatgtcgtatacccatatcaatgacagccaaccttcaggatttgaccccgataggaaggctcataacggtcaatccatatgtgtctacatcatcatcggggacaaaagtggttgttgagcttgacgactcggaccgatg

SEQ ID NO: 7997 - DNA, 203 bp, Homo sapiens
ggcgcgccagtcctacgggaaaaaggaatctgtggtgtaaggtccgtgggaagactggagcataacatgtggaattcaatcaagcatgagctgaatgccatacttgaggacaacgggccagacttgacagtcgtcgttgaacagccaactggtagatttaggaaaacccaccggcgtttagtgtggaccgactcggaccgatg

SEQ ID NO: 7998 - DNA, 203 bp, Homo sapiens
ggcgcgccagtcctaggcaccaaagtgacagtcaccccaacatgcagggatagggttgcctccgccagaacaacaacggcaagcggtaagctgatcacagattggtgctgtaggtcatgcactctccctccattgcggtacatgacaaagagcggctgctggtatggaatggagattagacctacagtcgactcggaccgatg

SEQ ID NO: 7999 - DNA, 203 bp, Homo sapiens
ggcgcgccagtccttgccaccctcttaggcgtggcactggcaatgataaccatggcgttgcacgactggaacatgaccatacccagcttgttgaattcaggagccacggcgtggctgttgctgcgcgcagtgagtgaagggaccgtcagcgcggcctgtattcccattctcggacttttggctccaggcgactcggaccgatg

SEQ ID NO: 8000 - DNA, 203 bp, Homo sapiens
ggcgcgccagtcctaatgaaaataattggaattgatgtatttcggatcgggctgcttatcatcggagttatgtcactcctgaaagaaagaaacaatgccatcgcaaaaaagaaaggtggagtgctgattggtttggccctggcccaagacggctgggtgaatccactggtgtacgcaggactgacgttcgactcggaccgatg

SEQ ID NO: 8001 - DNA, 203 bp, Homo sapiens
ggcgcgccagtccttgacctgtggttggagcgagctggagacatctcgtggattgaggatgcccaaataacaggaagctcacaacggtatgacgttgagatagattgtgatgggaacatgaaattgatgaatgatcaaggagtccctttttccatttgggcccttaggacaggactcattctagcatccgactcggaccgatg

SEQ ID NO: 8002 - DNA, 203 bp, Homo sapiens
ggcgcgccagtcctagctggagtaggagtgatgtttgatggggttttccacacgatgtggcatgtgacgaatggggccaccattaacgtgggggacggttgcctagtcccctattgggctagtgtaagagaggacttgatatcgtatggaggaccttggaagatgggcacgaaatggaacggggttgacgactcggaccgatg

SEQ ID NO: 8003 - DNA, 203 bp, Homo sapiens
ggcgcgccagtccttaatggcattcttgtcggagcaggcagcttcgttagcatgatttcccaaggccagcgaatggaagaagagattccgcaagtgttcagtgaagacatgctgaggaaaagacagctaactgtgcttgacttgcacccaggctcaggaaaaacaaggaaagtgcttccccaaattgtcgactcggaccgatg

SEQ ID NO: 8004 - DNA, 203 bp, Homo sapiens
ggcgcgccagtcctgtcacgccttctcacgccacaacgtgttcccaactacaacttgtttgtgatggatgaagcccatttcaccgaccccgcgagcatagctgcccgaggatacatctcaaccaaagtggagctaggcgaggcggcagccattttcatgacggccacccctccaggaacgcgtgaccccgactcggaccgatg

SEQ ID NO: 8005 - DNA, 203 bp, Homo sapiens
ggcgcgccagtcctttgtggcaagagatcagccattggcgtgtctgaagtggtcaaaatgcttccagagcatttcgcacacagaatgggagaatccatggacaatctgtacatgttgaccacttctgagaaaggtagcagggctcacagggaagcgctagaggagctaccagaaacactggaaacaatcgactcggaccgatg

SEQ ID NO: 8006 - DNA, 203 bp, Homo sapiens
ggcgcgccagtcctaaggagaacagcagcaggtgtgatgaaaaatccagtggttgatggaatcgtggcaacggacgtaccggatctagaagcaagcacaccaatcactgagaagaaatttggacaggtcatactaattgtggtagccttgtgctcagtttttctgaagcctggaacaacatcactaaccgactcggaccgatg

SEQ ID NO: 8007 - DNA, 203 bp, Homo sapiens
ggcgcgccagtcctctccaccacatggcatcatgacacagaaaatccatacaaaacctggaactaccatggaagttatgaagttaaagcaacaggatcagccagttccatggttaatggagtcgtgaaggtgttgtcaaagccttgggatgccttgcagaacgtagtaaacatggccatgactgacaccgactcggaccgatg

SEQ ID NO: 8008 - DNA, 203 bp, Homo sapiens
ggcgcgccagtccttagccacgcggcccttggtgcaatctttaaagaacagaacaagtgggcatcagctcgggaagcagtggaggacccagcgttttgggagttggtggatcaggaacgcgaggcgcaccttcaaggaaagtgtgagacatgcatctacaacatgatgggaaagagagaaaagaaaatcgactcggaccgatg

SEQ ID NO: 8009 - DNA, 203 bp, Homo sapiens
ggcgcgccagtcctgaaagtgatgcggcctgggagggaaggtatcaccgtgatggatgtgatttccagggaagaccagagaggaagtggacaagtcgtcacctacgcgttgaataccttcaccaatttgtgtgtccaattgattagatgcatggaaggagaaggactgctgaagcctgaagaagttgacgactcggaccgatg

SEQ ID NO: 8010 - DNA, 203 bp, Homo sapiens
ggcgcgccagtcctccccgagtggaaaccctcaacgggatggaggaactggcaagacgtccctttctgttcacatcatttccacgagttaaacatgaaggatggcagaaccatcgttgtcccatgcagacaccaggatgaactgataggaagggcacgattgtcaccaggatctgggtggtccctcaccgactcggaccgatg

SEQ ID NO: 8011 - DNA, 203 bp, Homo sapiens
ggcgcgccagtccttgaaacagcatgtctgagcaaagcttatggccagatgtggctactcatgtactttcacagacgtgacctgcggctgatggccaatgccatatgttcatctgtgccagtctcatgggtgcccacgggaagaaccacctggtcaattcacggaaaaggagaatggatgacaacagacgactcggaccgatg

SEQ ID NO: 8012 - DNA, 203 bp, Homo sapiens
ggcgcgccagtcctagatatgttgagagtctggaacagggtgtggattgaggagaacgaacacatggaagacaagacccctgtggcctcatggaacgatgtgccgtacctcggaaagcgcgaggacagttggtgtggaagtctgatagggcacagaacacgatcaacctgggcagagaacatatacaccgactcggaccgatg

SEQ ID NO: 8013 - DNA, 203 bp, Homo sapiens
ggcgcgccagtcctctcggagagctccctggcgttggagaggataggcacccagagtcaggccacaggttttgtgccactagcatgcagtgctgcctgagcaaagacatgccccaggtggactgggtaaacaaagccgcaaggcccccgtggcccaagcaagggaatggtgtgacccttgtgtaaggacgactcggaccgatg

SEQ ID NO: 8014 - DNA, 203 bp, Homo sapiens
ggcgcgccagtccttggaggaggagctcctccgaagaaggagagagatcgaggaggccaaaaggtctcgctccctgggacttcaagctccatcggatgggaccgtggcaaacgggtcaagggactcggcggacgaaagggactgctcggcaagctggggctgggatgggggtcttttttacagaaagacgactcggaccgatg

SEQ ID NO: 8015 - DNA, 203 bp, Homo sapiens
ggcgcgccagtcctcatcatccaagccatcatgcacctggtcctagtcctacacgccctgttcatgtccattgaccaacgctttaaggcgctcacccggcgggtgcgcgccctcgagaatcgacgatctgccaatcccctactgctcgccactatcatctgcgcggtcgccaccttgtgtggcaccatcgactcggaccgatg

SEQ ID NO: 8016 - DNA, 203 bp, Homo sapiens
ggcgcgccagtcctggtgatcgacatgcaagtgtcctccgctaaaggcgtgcaaatttacgaagggaaaacaaaccggactgactacttgcacttgttcaagcttccaaaagatggatgttggaacggagtgctggtttccaaacactgtcctaaggtcggcgacttggccaaggacttggaggccaccgactcggaccgatg

SEQ ID NO: 8017 - DNA, 203 bp, Homo sapiens
ggcgcgccagtccttgactgcggatctacatggagcgaattcacactgcgatataatcgatgtgtgggaaagaagcgcgtcaagcgggctaccgaacaaccgaaagcggacctacttgcggagatggagatggtaacgttcaagaccatccgtcaaaacaagacgattttcattatcgctctgctctgcgactcggaccgatg

SEQ ID NO: 8018 - DNA, 203 bp, Homo sapiens
ggcgcgccagtccttgacataccagtcaccttccgatttgctaagctcggaaacgcggctatgacttgtcgcttggaatcagagcaactcctgcttgattattaccacgttaccggcaacaaacgcgaaggactattcctgcggtcccaggtggacaattggcctggagtcatatcgtcttctgggggcgactcggaccgatg

SEQ ID NO: 8019 - DNA, 203 bp, Homo sapiens
ggcgcgccagtcctgttccgcgattgccaaggattaaaatcatcggtgtttgttcagagtggctttggatacagtggggttgttatcaccacgctgttgcaaccaacgaacgagagctgctcactcaacatggtgtgtcatggatgtcagttgctatcgacgaaaatggtgtttggggctggaaaacccgactcggaccgatg

SEQ ID NO: 8020 - DNA, 203 bp, Homo sapiens
ggcgcgccagtcctaacgtcccgtgccttcgtcggctgtgggaaccacactggttcactcttgattggcggtgcatctgtccccattgaatgtgtgatgaaccccatctctcaaggatggaggctaacccgacacgttgtggacaagtaccgacgattcggagtaccaggagttgcaggagtttggcgcgactcggaccgatg

SEQ ID NO: 8021 - DNA, 203 bp, Homo sapiens
ggcgcgccagtcctcgatttcgttggaggcttctccctcgggaacctgataaccaactcgacgttgctcgtcctcctagcagcgctggcattcctcgacaagcgtgttgtggtgctcctgctagtctgtggatacttctactacacacgtgctgatgtgggttgtggatttgatcccgacaggaagatcgactcggaccgatg

SEQ ID NO: 8022 - DNA, 203 bp, Homo sapiens
ggcgcgccagtcctcgtggtcgtgaaaccggttgagaaaccgagtgaagcgtgcccgacgtacctggccggttcatatgttaagaacgatgtcggagggtacactgatggcatgatgtggatgcgtagccgtaaggtgaatggctcatgggagatgttcgagcttgagacgacccaaagccaccaatgcgactcggaccgatg

SEQ ID NO: 8023 - DNA, 203 bp, Homo sapiens
ggcgcgccagtcctcatttggccacaggagtacacatttgatctcacgactcacaacgatagtacattgtttatgccagcccattacggagcgccgatgtccaaagccaaccacatccctgggtacggaactcaacacgagttcccgtggtacaaggccgagataaaattgcggcagggaccagttcccgactcggaccgatg

SEQ ID NO: 8024 - DNA, 203 bp, Homo sapiens
ggcgcgccagtccttgcgcattcaaagctcatcatcgagaacgagggtgttgaaatagacgagatggatcagatgttcccaaaaaccgtctctccaatccctggagctgaagctttgcttcaggatttccgggacagcctgccagtagatggatcttctcctttactggtgggcgtgcttctacacctcgactcggaccgatg

SEQ ID NO: 8025 - DNA, 203 bp, Homo sapiens
ggcgcgccagtcctcatgaacccattgttgggtatcacgtccatgctcttctgctggtttactgaagcatacgtgtggttgccgaggttgatcttcggcacgagcaatcgccgctctggggtgaacgacgttctgctagcccctcctgtctacgcggacgagattgatgttgaaagcgactttggacacgactcggaccgatg

SEQ ID NO: 8026 - DNA, 203 bp, Homo sapiens
ggcgcgccagtcctcataccggatggaacttacaggatagtggcccattgcacctttttcaagtatcacacaggagccggctatgccaaaggtggtgttttccacacactatggcatgtcacatcaggagcttgtgtctactgggagggcagagcggttcgtatgcactcggctgacatctaccgcgacgactcggaccgatg

SEQ ID NO: 8027 - DNA, 203 bp, Homo sapiens
ggcgcgccagtcctaaagacgcgcaaggtcttggttgccgaagcacaggaacacatcaaacaaacaaagagattgctcatcctaacaccaacacgagttgtcaaagatgaagtcatccgagcgattggtgaagcttgtccaggcgtggtcattggctcaaatctagccatgtaccggcgaaacgcagtcgactcggaccgatg

SEQ ID NO: 8028 - DNA, 203 bp, Homo sapiens
ggcgcgccagtcctcacggtagcatgccacgccacgctaacgcagtatgtcatggagaaaggcattgacagcatcaaattttcaaagatcataatggatgaatgccactttcttgatccgctgtcgattgcttgtcgtggaatcatggattaccataacgcgaagggagtcaacgtcacttacatgagcgactcggaccgatg

SEQ ID NO: 8029 - DNA, 203 bp, Homo sapiens
ggcgcgccagtcctgttggagaaagtcggcatcacagaagcctcggcaatccagcggcgtggaagaactggacggcgtgaagaagggcagtacatataccccatcggggttgagcttgaacatgagcccgcgaactgggcttgctggactgaggctcagatggtgcttgaccaaatgatgtgtgggcccgactcggaccgatg

SEQ ID NO: 8030 - DNA, 203 bp, Homo sapiens
ggcgcgccagtcctgaagctcaagatccggactgaagcaggggatcacgcgtacgcccccaggttccacgacgaccggtttgagaaatgcaacgaactggaaaagcgcacgaaattgtcaatctttctcaaacaacggagcgtcctcaattttgatgtcctcggtgtggctcatggcctgtatgtcgccgactcggaccgatg

SEQ ID NO: 8031 - DNA, 203 bp, Homo sapiens
ggcgcgccagtcctgttgacctcaatcaacatggaaatgctcggtaacacgtttcgcgacacaatcgaaaacctgcatgtcatatcaaatgtggacgacccttacgtctctgatttcacgatggggcaatctctgaatgcttggacagcagtcctcatcggggccgccgccagtacgatcctgctgttcgactcggaccgatg

SEQ ID NO: 8032 - DNA, 203 bp, Homo sapiens
ggcgcgccagtcctccacttcctgcgaggactgtttgccaatgaagctcaatcggcgtccgtgattggaggagttcaagtgtcggctattgcttgggagataatgattcccgtggctttttcagctttcttcgccacgacgttcgttacaaagatctacggcatcctgatcggggctatcttcttgatcgactcggaccgatg

SEQ ID NO: 8033 - DNA, 203 bp, Homo sapiens
ggcgcgccagtcctgttctggttcatcgtacatccaaaccgtctggcaacccgctcgctggtgaagactgacacttgcggaatcgggtaccggtggaaagagatattgaattctcttgacaagaacgcgtttgatcagtacaggtcccgaggtgtcaatgaaacggataagggagactatgtttctcgcgactcggaccgatg

SEQ ID NO: 8034 - DNA, 203 bp, Homo sapiens
ggcgcgccagtcctgttccggacaaaagggcataacctagccacattgaaagctggcgtcgacgtgtatgccgagccgccaaaagattgcaacacgatcgtctgcgacattggagaaagcgattctcgtggtgatgtggagcgaacccgcacgttgaaggtactgggcttgcttgagaagtggttggacgactcggaccgatg

SEQ ID NO: 8035 - DNA, 203 bp, Homo sapiens
ggcgcgccagtcctgcacaacccaaatgcagcttttgcctgcaaggtcttgtctccctatcacatcgaagtgcttcgaaaactggagacgttacaacacaagtacggaggccgggtcgttcggctgtcgtatagccggaactccaccgctgaaatgtattacatctcgggcgttcgggcaaacattgtcgactcggaccgatg

SEQ ID NO: 8036 - DNA, 203 bp, Homo sapiens
ggcgcgccagtcctaaatctgcacacctggtttgttgatcgtgaacatccttaccagtccttcaactaccacggatcattcgccactgacgacatttcccccggtgggcaaacggtgaatcctatgatgcggcgcatcatgtggccgtgggactttctcactcgtgtcaccacattcatgatgacggacgactcggaccgatg

SEQ ID NO: 8037 - DNA, 203 bp, Homo sapiens
ggcgcgccagtcctcgtgtctacgtattcgcagcaaaagatccttagggagaaggtcgacacgctaacagtcgagccggacacacgcacgaggagcttgaaccggctaatcatgaaacatttttcacgcctgttcaagaagcgaggactacgaccccgaatcctagctccctctgactacgtcaacaacgactcggaccgatg

SEQ ID NO: 8038 - DNA, 203 bp, Homo sapiens
ggcgcgccagtcctgtctcctaggtactctagctgggagcaagttgagttctgttcccaccatttccacgccttggtgcttagagacggacgagagattatcgctccttgccgtgaccaacatgaaatcattgggagagctcggatccagaaaggaggtgtggttgacatgtcagctgccgggtgcttcgactcggaccgatg

SEQ ID NO: 8039 - DNA, 203 bp, Homo sapiens
ggcgcgccagtcctggccaaagctcacgctcaaatgtgggggttgtactacttccaccggcgagacctgcggctaggattcgctgcaatcgtgtcggctgttccctcgaattgggttccaacgggccgcgtctcatggtctgtgcaccagcatgctgagtggatgacaacacaagacatgctggaggtcgactcggaccgatg

SEQ ID NO: 8040 - DNA, 203 bp, Homo sapiens
ggcgcgccagtcctatggaacaccgtttggattgtgaacaacccgtggatgaggaccaaagaccttgtcaaagcttggacggacatcccgtatttacctaagtcaaaggacatagcgtgcggcagtttgattggcgaacgtgacagagcttcgtggtccaagaacatcgtggccactgttgagacagccgactcggaccgatg

SEQ ID NO: 8041 - DNA, 203 bp, Homo sapiens
ggcgcgccagtcctgcgctgaacaagcttggtatcttggcaactaccactggatggtttccagcccgcgcaaggaaggacacgtaaatcacgtgttcttgggagttgacgactctccgcccccagtccccaggtcagggtatgactccgtggtgttgaaaggacactaaacaagcttggcatcttggccgactcggaccgatg

SEQ ID NO: 8042 - DNA, 203 bp, Homo sapiens
ggcgcgccagtcctagcggctagagtgaagaacctagccgttaaagtaaaaaacaaaacaaaacaaagtgcaagaggtttgcgagggttcctcttgtttctagtggcccaaattttctgggctagaaaactaaccccgcaggttaaaagattgtggagaatggtggacaaagtgcaaggtctccggatcgactcggaccgatg

SEQ ID NO: 8043 - DNA, 203 bp, Homo sapiens
ggcgcgccagtcctcctgaagaacattaggaacatcgttaccaatctgatgaagggactggctggtcgcaagaaaaagcgaagcttgacagtacccttggtccttttgctgattccactgattgcttactcagctactgtcacccgtcaacgcggattggggcttttgctcaacgtcacttttgctgacgactcggaccgatg

SEQ ID NO: 8044 - DNA, 203 bp, Homo sapiens
ggcgcgccagtcctcgttgggaagacctatgaggttgaggggggcaattgctctgtcaacactttggatgcgggcaaatggtgtgaagattatgtggagtatgagtgcgtcactctctctgagggtgaagagcctgacgacctggattgttggtgctacggagtggacaatgtccgtgtcacctatggcgactcggaccgatg

SEQ ID NO: 8045 - DNA, 203 bp, Homo sapiens
ggcgcgccagtcctggtggctttagcatactttgttggcacatcaaatgtgcagagggtagttattgccatcttgcttcttggcattggaccagcttattcaacacactgcttaggaattccaaaaagggacttcataaggggacttgatggaaacacctgggtgtcagtggttttagaacagggcagcgactcggaccgatg

SEQ ID NO: 8046 - DNA, 203 bp, Homo sapiens
ggcgcgccagtcctgggagccaagaaagatgattgggaaaatcacacaaaattggtgacttttgttccgaccacaggaacatcaactgttgcttttacaggctatggaaactttggcttagagtgtcacgttcagatgatggtggacctcagcaattcctatctggtgaaagtaggaactgatgcctgcgactcggaccgatg

SEQ ID NO: 8047 - DNA, 203 bp, Homo sapiens
ggcgcgccagtcctgctggtcaacaaacaatgggttcacgatattactctcccatggcagagtggaacaggaggacattggagagacaagcatttcatggttgactttgaagaaccacatgcagtcactatgaaggcgttggtcctgggtagccaagaaggggctcttagaacagctctgtctggtgccgactcggaccgatg

SEQ ID NO: 8048 - DNA, 203 bp, Homo sapiens
ggcgcgccagtcctaatggttgtggaactaaattctaatagatattcccttaaaggaggtcatgtgacgtgtaaggcgtacatgaacaatctcatcctgaaaggttcaacctactcaatgtgcaaaagagggatgtcctttgctaagcaaccagttgagacagaccatggaacagcagtgatgcagatcgactcggaccgatg

SEQ ID NO: 8049 - DNA, 203 bp, Homo sapiens
ggcgcgccagtccttggtgctgccttccatgcaatttttggtggtctcagttggataaccaagatattgattggagggttgctcatctggctgggtctcaactctcggagtagttcaatgtcaatgggcttcatatgcattggagccttgctgcttgtgctggccacaggagttggagcagaagtgggcgactcggaccgatg

SEQ ID NO: 8050 - DNA, 203 bp, Homo sapiens
ggcgcgccagtccttgatagagcaaagtcagtaagatcaacaacagatagtggaaagatcatacctgaatggtgctgccgcagttgcaccatgcctccagtgagtttctgggggcctgacggctgctggtattccatggaagttaggccaaaacacaccaatgaagcacatctggtgaaatcctgggtcgactcggaccgatg

SEQ ID NO: 8051 - DNA, 203 bp, Homo sapiens
ggcgcgccagtccttggagagaccatggctgctgttgggctggttggagtgcttgctggcatgggactgaaggacatgaacggaatgcttggaccagtggccgttggtggagtgttactaattgtaatgagtctttcaggaaaggttgatgggctggtaatcaagaaagtggctgacgtgacctgggacgactcggaccgatg

SEQ ID NO: 8052 - DNA, 203 bp, Homo sapiens
ggcgcgccagtccttgaggatgctgagattagtggagcatcacaccgttatgatgtggaacaaactgacacaggtgagttcaagttacgaaatgaagaacccgccccctggattcaggtggctgtcttgacaatagctatccttagtgcagccacacatcctgcttgtcttgccgtggtcacaattggcgactcggaccgatg

SEQ ID NO: 8053 - DNA, 203 bp, Homo sapiens
ggcgcgccagtccttcctgtgaatgtgcaaaccacgcccagtgttttccaactgaaaaacggaaaagaaataggagccgttaatcttgactatcctagcggtacctctggctcaccaatattaaacaaaaatggagatgtcattggcctatatggaaatggaatattgattggaaataacacctacgtcgactcggaccgatg

SEQ ID NO: 8054 - DNA, 203 bp, Homo sapiens
ggcgcgccagtcctatacggagtggaaggcaccaaaacaacaacaagtccgggagaaacacgactaagagaagaccaacggaaagtgttccgagagctggtcaagagacttgacatgccggtttggttttcatggcaggtcgcgaaggcaggtctcaaggtgcaggacagaagctggtgttttgatggcgactcggaccgatg

SEQ ID NO: 8055 - DNA, 203 bp, Homo sapiens
ggcgcgccagtccttttgttaggcttgcaaggatttcctgaatttctgtctgggaaaatgcgggaagcgatcgacacagtaacagtcctatacactagtgacactggaagtagagcctacaaacacgcactagcaatgatgcccgaagctacaacaattttcctactggtgatgctggctatcatttgcgactcggaccgatg

SEQ ID NO: 8056 - DNA, 203 bp, Homo sapiens
ggcgcgccagtcctactcattgagggcgacaccaatgcttattggaatggacctattgctgtagcgttttcaggattgatgagaggaaactactatgcaaccattggacttgcctacaatggatggttggccaaacagacaaggagaggcaaagcagctggagtgaccctgggggaagtttggaagagcgactcggaccgatg

SEQ ID NO: 8057 - DNA, 203 bp, Homo sapiens
ggcgcgccagtcctgcagctgaacatgttagggaaacaagaatttgagaggtacaaagtgccagacattactgaagtggacgggaccgcagctaggcgttacctgaaagaaggacgaacagatgtgggaatcagcgtctctcgaggagcagccaaaatcagatggcttcacgagcgcggctacctcagcgactcggaccgatg

SEQ ID NO: 8058 - DNA, 203 bp, Homo sapiens
ggcgcgccagtcctgcctagtgggaaagccatcatagaaggggacgtgtttcttcccactggaacgcgaagcgttgccagtgaagcgggcaccatagaccatgaggcgctcaagctcagagttgaccagattaaggcagagtactcaaagacttggacacatgattcaaaccacccatatcgaacatgcgactcggaccgatg

SEQ ID NO: 8059 - DNA, 203 bp, Homo sapiens
ggcgcgccagtcctgaagagtgcaagtgaggctgtccaggatccacagttctggaaactggttgatgatgagaggaagctgcatctgcaaggccaatgccggacatgtgtgtacaacatgatggggaaacgtgaaaagaaaccctctgaatttggcaaagcaaagggaagcagggcgatctggtacatcgactcggaccgatg

SEQ ID NO: 8060 - DNA, 203 bp, Homo sapiens
ggcgcgccagtccttatttcaagaagggatcaaagagggtccgggcaagtggtcacttatgccctgaacaccgtgactaatcttaaggttcaactcatacgcatggcggaggcagagcatgtcattacaaattttgatgttgacacagttagccagaagaccctgcaggacttgagatgctggcttgacgactcggaccgatg

SEQ ID NO: 8061 - DNA, 203 bp, Homo sapiens
ggcgcgccagtcctgatgtatttccaccgcagagaccttagagttatggccaacgcaatcaactcgaccgttcctgtggattgggttccaactggaaggacaacatggtctattcatggaaagggagaatggatgaccactgaagacatgctgcaggtgtggaacagagtttggatagaagacaatcccgactcggaccgatg

SEQ ID NO: 8062 - DNA, 203 bp, Homo sapiens
ggcgcgccagtcctcctttgcaaataggcagtggtgcatctcccaatgtacaaatgactctcacgcttactccaactggatctgttttcaatggcttgagacatcccaaaccagctgcccaatcaccctttcctactagaccctttcatcactcatttcagtttagttcaactgtgccagatgtgactcgactcggaccgatg

SEQ ID NO: 8063 - DNA, 203 bp, Homo sapiens
ggcgcgccagtcctgaaccctgttatggtatgactgttgttccacccaaagacttcatgccagccccaataacagatttggtttctcttgcgaaggtgccaaccttttgcacagttaccgaaaacaagccatatttcgaggtcaacaataataaatcagatgcccccgtttttcagtctaacgtggttcgactcggaccgatg

SEQ ID NO: 8064 - DNA, 203 bp, Homo sapiens
ggcgcgccagtcctctttctgaccctcactatgcccacaccctagttgcaggtttgggtcgttactttggaaattacagaggtagtttacaattcactttgatctcagctacaacaagcatgacccgtggaaaactgctgtgttgttacacccctccaggtgctgacaaaccaaccactgttgaacaacgactcggaccgatg

SEQ ID NO: 8065 - DNA, 203 bp, Homo sapiens
ggcgcgccagtcctgcaatgatgtctacttatgctatatgggatttaggacttcagtccacctttgaatttgttgtgcctttcatatctactgttgactttagagtaaatgttgtctctacttcctcagccgtcaacgtagatggttggttttcaattttcaaactaaatgctctaacctacccagcacgactcggaccgatg

SEQ ID NO: 8066 - DNA, 203 bp, Homo sapiens
ggcgcgccagtcctgttttgatgcttgcccctaatccctctttctgtggtgctgcctataccgtttttgctatgtttgaccagacaggaacaacaggtgcgaagaaaagacttttgtttggtcagggtgattatcatctttacagatcttgtcccttcacttactatactgcagatctggaagtaacacgactcggaccgatg

SEQ ID NO: 8067 - DNA, 203 bp, Homo sapiens
ggcgcgccagtcctaaatttatggtctatattagatacaaaaatttcagaggttatgtgcccagacctttaccccgtcttgttcaaccaaacccgagttcacgcgtcaggatggctgcttcagatggtttagcccctagaaagtacttatcctatagaaaaatacagctttcaggtgatgtagaaacacgactcggaccgatg

SEQ ID NO: 8068 - DNA, 203 bp, Homo sapiens
ggcgcgccagtccttctgatcgtggtgcagttgaaagacgcatcacttttgacattggagtaacccccggttcagcagcaacccgaaacggtaagctggaccttgctatcgccctgaagccagatggacccggtgaatttccttacaactgtgactgtcagcttttacacacaactggacttgcacttcgactcggaccgatg

SEQ ID NO: 8069 - DNA, 203 bp, Homo sapiens
ggcgcgccagtccttacggcttgacagatgttgcagccgttaagataagcaatggcccggagtggaaaaacctttcaaaactctttctgaaccttgaaactgaactcttgcccggaacgaggattacggttttgtctaacgacaacatcaacatgttaagagaaggttcttttcttcgttatgaagaacgactcggaccgatg

SEQ ID NO: 8070 - DNA, 203 bp, Homo sapiens
ggcgcgccagtcctagactaaacccaggtgttgattttgattcagtcattttctctaaacacgtgaataacgtggtaattgataaagacacttcaatttggcagtctttgaagctcgctgcccaggtttatgctcaaaggttaaagaatattgacaaagagcctcttacagttgaagaggcaattgctcgactcggaccgatg

SEQ ID NO: 8071 - DNA, 203 bp, Homo sapiens
ggcgcgccagtcctggaattcctggacttgaccgcttggaccccaaaactgcttcaggtttgccctacaaaaagacaaggaaacagatgattgactttcaaaaatgtgagatcactgatgaccaacttaagtgtagacttggaatgtggcttgcaggcagaaaaccagaaactctttatcaaacatttcgactcggaccgatg

SEQ ID NO: 8072 - DNA, 203 bp, Homo sapiens
ggcgcgccagtcctgttgaatcggttcattgctatgaggacaagcgcatcaccatacgtggtgggctgccttcaggcactgctggaacttcaataatcaacactatcattaataacataatcttgcacgctgctttctattatacctactctaactttgaatgggatgatttacagatgcttgcttatcgactcggaccgatg

SEQ ID NO: 8073 - DNA, 203 bp, Homo sapiens
ggcgcgccagtccttgggctccagttatggaaatttcaaatttacaggctatgctttcttggtataaacctggaacactgaatgaaaaactggaaagtgtgtcccgcctcgcccacttttgtggagaggaggaatacaatgaattgttcaagccgtttgttgaggacggctttgacataaagccctggcgactcggaccgatg

SEQ ID NO: 8074 - DNA, 203 bp, Homo sapiens
ggcgcgccagtcctgcggagacttaggcctcacagattgtgttttgtgttattggatgctggatggtcacgttggagactgcatgtggcagtcttgaaacgtgtggtttgacgtctatccattatggcagtgggtggagtactgcaaagatgtcaccgtgctttacacggtttttgaaccccacaccgcgactcggaccgatg

SEQ ID NO: 8075 - DNA, 203 bp, Homo sapiens
ggcgcgccagtcctaggagacctgaggaatttccatgtggctttgccaggagttgtagcgatgctgtgtgtgtgtgcggatttcccctcatggcaacatgagcctcacaggccaaaagccctgtccgaaaggacccacacagtggagcaaccccagctccctcctacaaagctttgtgagaatgaactcgactcggaccgatg

SEQ ID NO: 8076 - DNA, 203 bp, Homo sapiens
ggcgcgccagtcctattgttaataacttttattcaaaccagtattatgcttctattgatgcttctgcccaaggtgttgggacctctactactcctgaaaacggcaacgtatctggctttcttggacttgcaggtagtgcttttaatgctctctctcttctcgcctcaccacgaaccgagacaggaatgcgactcggaccgatg

SEQ ID NO: 8077 - DNA, 203 bp, Homo sapiens
ggcgcgccagtcctacaccagaacaatttatgattttccctcaccaacttataaatcctaaagacacaaatgttgccacagtacgtgtgccgtacattaatattgctccaacaaatgatactacagtacatacagtatggacagctgttgttatggttcttgtacctcttaacttttcttctggtgctcgactcggaccgatg

SEQ ID NO: 8078 - DNA, 203 bp, Homo sapiens
ggcgcgccagtcctgttgattacatgcccttacccattacagatttagttgagcttgctaaagtgcccagttttgttactgtggcaaacagtgacacgactagcgagcgtagtttcccttatttctctgttagtaacacagaacaaggcagaaatcttttcaaatccagtgtagttctcagcgacttacgactcggaccgatg

SEQ ID NO: 8079 - DNA, 203 bp, Homo sapiens
ggcgcgccagtcctacttatgctatctgggatttgggattacaatcaaccttcaattttgtagtcccttttatatctgcttctgacttcagatttaacacctcttctgtatctaatgctttgaactctgatggttggatcacagtgtggcttatgaaccctctaacatatcctcccagtacacctcctcgactcggaccgatg

SEQ ID NO: 8080 - DNA, 203 bp, Homo sapiens
ggcgcgccagtccttccctttctccctgtgcgtcagtgtgtggccagcctatctcttccttcctgtttgctcaacgagcgaatcccaagaaaactctaaagctgcgctcaggtgatgaattcttgtatagatgttgccctttttcttacattaaatgtgaccttgagtttactgtggtcccccctgcgcgactcggaccgatg

SEQ ID NO: 8081 - DNA, 203 bp, Homo sapiens
ggcgcgccagtccttctcccagacattgcaaggcaataaatgactacaacagaggtgactcctttcagagaccgaccaactcttttgaattcatggacagacttgtggaatgtgctaccaagcttgggaaagtccaaattgcaacttatttcagaaattttactacagctgattctgatacaagcagacgactcggaccgatg

SEQ ID NO: 8082 - DNA, 203 bp, Homo sapiens
ggcgcgccagtcctccagagccagttgttgttgttttgcgcgggaaaccaggcgtaggcaaatctgctgcagctactgttatggcagctgcagtatctaaattgttggtaggaagtcaatcagtgtacaccctttccccagatacggaacatatggatggatatcacggacagtttgtgactttgatgcgactcggaccgatg

SEQ ID NO: 8083 - DNA, 203 bp, Homo sapiens
ggcgcgccagtcctgatgaccttggacaaaacccagacggagaagacttcagatgtttctgtcaaatggtttcttgtgctcagtacagacctgctatggctgaccttaaagacaaaggaatcctgtttacatccagactgttgattgctactactaatctcccagattttaaccctgttactatctctcgactcggaccgatg

SEQ ID NO: 8084 - DNA, 203 bp, Homo sapiens
ggcgcgccagtcctagatttgaggatgaggtaccgactaatgtaggtaacatgccctttgtaatgctttacaaatcaacctcttattttggaatgtgtggctcagttgtatgtagcagatttgttgatggtggaggaataattggaatgcactgcgcaggtggaggcggagtcagtgttggaactcgtcgactcggaccgatg

SEQ ID NO: 8085 - DNA, 203 bp, Homo sapiens
ggcgcgccagtcctcggtatgatccgcgattaaatgagggagtcaacttggatgaggtgatcttctcaaaacatactcaaaacactcttgttgagaaaggatccactttcagaagcgcccttgacatggcagcagaaatttatggtgaaaagtttagaggaaatgatttctctcccctttcagttgaacgactcggaccgatg

SEQ ID NO: 8086 - DNA, 203 bp, Homo sapiens
ggcgcgccagtcctcattaccagacatttcttaaggatgaaatcaggcccattgaaaaggtcaaagcaggaaagactagaataattgatgttcctcctcttgatcatgtcatcgcttttagaatgctctttggcagattcattgcccactaccacttaaactttggcttcaaaacaggctctgctattcgactcggaccgatg

SEQ ID NO: 8087 - DNA, 203 bp, Homo sapiens
ggcgcgccagtcctggttgtgacccagatgtcgcttgggcttcttttggctttgaactcagtggctttccttatctgtatgattttgattactcaaactttgatgcttctcacagtacttcaatatttgaaatcttagaacagaaattcttttccccagaattaggttttgatcctagatgctcacttcgactcggaccgatg

SEQ ID NO: 8088 - DNA, 203 bp, Homo sapiens
ggcgcgccagtcctctcttgaaatcccttgcagtttcaacccactgttatgagaacaagagactccagattgctggaggacttccctctggcacggcaggtacctcagtactgaacaccgtgataaacaacattatctttcacggtgcactataccacacttacactaattttgagcgggatgacatccgactcggaccgatg

SEQ ID NO: 8089 - DNA, 203 bp, Homo sapiens
ggcgcgccagtcctaaagttgctggagtttgggctccagtgatggaaactgaaaacctcgaggcaatgttgtcttggtacaaaccaggaactcttaatgaaaagctccagagtgtctcaagacttgcccacttctcaggacgtgacgtgtatgaccaccttttcaagcccttcattcgtgatgggtttcgactcggaccgatg

SEQ ID NO: 8090 - DNA, 203 bp, Homo sapiens
ggcgcgccagtcctctggcaaataacctaggggactaggttttcctttttattttaaagttgtcaatatgggtgcaaataacagcaaagaatctgtgaacagctctggcaataatggcacaactgttaataacttttatgctaataattattatggctctattgatgcttctgcccagggagttgggacgactcggaccgatg

SEQ ID NO: 8091 - DNA, 203 bp, Homo sapiens
ggcgcgccagtcctcctcttctactcccgaaaacggtactgtatctggttttcttggaatggcaagttctgcttttaatgcactttccttattggcttccccaaaggtagaaaactctttatacactgaagacagacttttgacacggaaagctggcaacacatctgtaaattcgcaggctgcagaagcgactcggaccgatg

SEQ ID NO: 8092 - DNA, 203 bp, Homo sapiens
ggcgcgccagtccttcatgacacagaagctcagtttgtatcaacctccggctgaggaaattgcccactcacactattctactcagacaataacaccaaacaaaaatgtatcttttgatctagccgacatgactgcagagcaaatgatgttgtttcctcatcaactcatcaaccccaaagatacaaatgcgactcggaccgatg

SEQ ID NO: 8093 - DNA, 203 bp, Homo sapiens
ggcgcgccagtccttgcaccacgcttcttctacggctcaaagccctatcccaaccagacctttccaccactctttccagttcagctcaactgttccagatgtcactgagccttgttatggaatgactgttaatcctcccaaagattacatgcctgaaccagtgggtgatttggtttccttagcgaaagcgactcggaccgatg

SEQ ID NO: 8094 - DNA, 203 bp, Homo sapiens
ggcgcgccagtccttaggaagtctagttactgtgtcttaccctagcaactcagatcaaccttactttgagatttcaaacaccaaaaaggacactcctcttttcaagtgcaatgttctactttctgaccctcactttcagcacactttggtgtctaatttaggtaagtactttgcaaactatagaggatcgactcggaccgatg

SEQ ID NO: 8095 - DNA, 203 bp, Homo sapiens
ggcgcgccagtcctctttacagttttcttttatttcagctactactggcatgactaagggcaagttgcttctttcctacaccccaccaggaagtggtgcaccaaccactttggagcaagcaatgaatggcacgtactcaatttgggacattggtttacaatccaccttcaactttgttgtgccctacacgactcggaccgatg

SEQ ID NO: 8096 - DNA, 203 bp, Homo sapiens
ggcgcgccagtccttatcagctgtggactttagattgtgtgctgcctctgctagctccgtggtaaacacggatggatggtttacagtgtggttgttgaactctcttacttaccctccaggaacccctccaacccagaatgtagtggtcatgttatcagcaggtgaagacttttcctacagaaaccccacgactcggaccgatg

SEQ ID NO: 8097 - DNA, 203 bp, Homo sapiens
ggcgcgccagtccttaagtccagcttggacccaaagcccaggttctaccccgcatgacaatgcggagaaaggtaccattgagaattgtgatgcatccttgaacagtggacatagtgtttctctgccaactcctcactctaatgttagatttttctttgatagatacagatttttggggttgttagaaacgactcggaccgatg

SEQ ID NO: 8098 - DNA, 203 bp, Homo sapiens
ggcgcgccagtcctctgtcacggttcacttagccacggaagcttctactgagtctagtacaaccactgttacatctagtctttcatcttcaggtagtttgtttacacttaatcctacattttatggcaaaaatggctttccagtctctttcatgatacctttctgtagtcctctcaccctcctccctccgactcggaccgatg

SEQ ID NO: 8099 - DNA, 203 bp, Homo sapiens
ggcgcgccagtcctagaaagatagcaaagatgttgagggaccatacaatggacctgacaagaaatcactcaaggttttgaaattaaaggctcagagtcctatgttagatctggaaaagaaagttttcaaaaatgtgttgccttttggacttgtatataatggaaaaacctatcaacaatcttgcttggcgactcggaccgatg

SEQ ID NO: 8100 - DNA, 203 bp, Homo sapiens
ggcgcgccagtcctttgtctctactgaggaaggaaccagagtgcacgtaccgcgtgtcagcaagctgaaaagaactcatgcctcataccctgcaacctctaaatatggacctgctgctttgacccgcaatgaccctcggctcaaccctggtgtggatctcgatgaaatgattttctccaaacacaaagcgactcggaccgatg

SEQ ID NO: 8101 - DNA, 203 bp, Homo sapiens
ggcgcgccagtcctactttgactattcaaactttgatgcaagtcattccacttccatatttgaaatcttggaagaggaattctttaccccagaaaatggttttgatgtgagatgctctctactgctaaaatctttatcctgttctactcactgttgtgaaaacaaacggcttaccataataagtggttcgactcggaccgatg

SEQ ID NO: 8102 - DNA, 203 bp, Homo sapiens
ggcgcgccagtcctgaggagttattcgaaccgtttgtcaagaacggtttcgaaatactgccatggaaacagcttcacttggagtggctcaataaatttggctattaattgttgaactggttaatattctttatcaattggtttaatttggtttaatttggcatttattgggtgtattcaaattttatacgactcggaccgatg

SEQ ID NO: 8103 - DNA, 203 bp, Homo sapiens
ggcgcgccagtcctctacgcgggcggagtgatactcccgctccttcttggacaggcggcctccacgctctttgtggatcttaaggctgccaagtcactggtgtttgaagtgaagaatggagagacactagggcgtttcatgtggctttgccagggattgtagcgatgctgtgtgtgtgtgcggatttccgactcggaccgatg

SEQ ID NO: 8104 - DNA, 203 bp, Homo sapiens
ggcgcgccagtcctttaaaaactcagctaccattactgacaagcagctcgcactaccagggtttaggtctttcaacaggtcaagggacaatatctgaaaagggttctattgatgctgctggtacaattcctcaacaactcttcatatatccacaccagttgattaacccaaaagacacaaacatagcccgactcggaccgatg

SEQ ID NO: 8105 - DNA, 203 bp, Homo sapiens
ggcgcgccagtcctcaccctgctcctaatgtacaaacagcaatacctgttagaatgacacaaaattctggacagttttccacaactcttcctgctagaatggaaccatgttatggcttaactcccaaccccaccagagactttcttcccccagtagtcgaagatttactcagcatagcaaaagtccctcgactcggaccgatg

SEQ ID NO: 8106 - DNA, 203 bp, Homo sapiens
ggcgcgccagtcctgatggttatcctgactattcaaggactgttggtgcatacggtgtggcccctgcaaaccactttggcactttgactgtagctgctaatgatgaaggttacaaattctttgtttatgttagatacaaaaacttcaaagggtatgtccccaagaccctacctccacaaccactgtttcgactcggaccgatg

SEQ ID NO: 8107 - DNA, 203 bp, Homo sapiens
ggcgcgccagtcctccttctgcttacttagctgcttccgctgtgctcattgcggacggcatttctttccttgactggtatgaaaaaataaaaagatttcttggttctcgttttcgagttccacctcctatcttcactcttgcccaaggaccagatcttagagacttagttactttctttaatgctgctcgactcggaccgatg

SEQ ID NO: 8108 - DNA, 203 bp, Homo sapiens
ggcgcgccagtcctatcaagagcaaaaggactacaagcggaatgcttgaaggactggtggtgcagtcgcccaaaattgtaggctacaccaaggacgacgagggcgtcgtcattgttgactgtctcgaggattggcacagaattcgagacaagaaaagaaagcaacaggctcttgagatggttgcagagcgactcggaccgatg

SEQ ID NO: 8109 - DNA, 203 bp, Homo sapiens
ggcgcgccagtcctgagatgcaaattcaacatgacaaacattctcagaccatttccttgataaaacagtttctctcagggctcggtgtggtggctgctgttggagccgcctttgccgcaggcaaggtactgaaaaacatgatgacctcagaccgggcacaggatgaaccagactctgaatcccaggagcgactcggaccgatg

SEQ ID NO: 8110 - DNA, 203 bp, Homo sapiens
ggcgcgccagtcctctctttgttggaaaaagggttttccttgtgaacaaacatgcaattgactcagttgaacaaaaatttcaagttgcaggaaaaacatatgacttggatgatgttgatgtggcaattcttgacacggaatatggacttacggatgttgcagctgtcaagctcaacacaggcccagaacgactcggaccgatg

SEQ ID NO: 8111 - DNA, 203 bp, Homo sapiens
ggcgcgccagtccttggaaaaacctttcaaaactctttgtttcactggacacgactctacacccaggaaccaggataacgattttgtctaacgaccaacttaacatggtgagagagggtagttttctcagaaatgaggatgacatacccaccaatattggcccaataccttttgtcatgctttataagcgactcggaccgatg

SEQ ID NO: 8112 - DNA, 203 bp, Homo sapiens
ggcgcgccagtcctgcttcctcttactttggtatgtgtggttctgctgttgtgaccagaattggtgattgtcccggaattcttggtctccattgtgctggcggtgggggtgtgtgtgtggcttccagagttacaaaaagaatggtagaaactgtcctaaaatacttttatccacctcaggtacagggacgactcggaccgatg

SEQ ID NO: 8113 - DNA, 203 bp, Homo sapiens
ggcgcgccagtccttatgactttgattactcaaactttgatgcttctcattcagagtccatctttgaacttcttaaacagtttgttttcaccaaagacaatggttttgatcacagatgctctctcatgattgattctctggttacctcgacccactgctatgagcaacaaagaatgaccattcgcggccgactcggaccgatg

SEQ ID NO: 8114 - DNA, 203 bp, Homo sapiens
ggcgcgccagtccttaccccacccaaggggggagaaagaggtgatagtgggcatacgcgatttaccaaggaaaggtgattgcaggacaggcaatcgcctggggccggtgagtggcttgttcataaagccggggcctattttctatcaggattaccctggtccagtatatcacagagccccccttgagccgactcggaccgatg

SEQ ID NO: 8115 - DNA, 203 bp, Homo sapiens
ggcgcgccagtcctgttgtaggctacagaggcatgaatggaacaaacatggctggtgtaattggtataacatagagccttggatatggttgatgaataagacccaagccaacctaaccgaaggcacaccccctaaagaatgtgcagtgacctgcagatatgacaaggatcaggagatcaatgttgtaacgactcggaccgatg

SEQ ID NO: 8116 - DNA, 203 bp, Homo sapiens
ggcgcgccagtcctcgcaggccagagacagacccacaaccctgaccgggtgtaagaagggtaagaaattctctttcgcaggtgaagtagtcgatggcccttgcaatttcaacatatctgctgaagacatgctttacgatgaaatagggtgtgcaggcgttttccaggaaatggctcaacacatagttgcgactcggaccgatg

SEQ ID NO: 8117 - DNA, 203 bp, Homo sapiens
ggcgcgccagtcctggtatactaacaactgtacccctgcctgcttgcctatgaatactaggattgtgggaccaggcaagtttgataccaacggggacgatggaaaaatcttacacgagatgggtggccacctatctgagctggccatattggcacttgtggtaatgtcagacttcgcacccgaatcagcgactcggaccgatg

SEQ ID NO: 8118 - DNA, 203 bp, Homo sapiens
ggcgcgccagtcctcccacaagaacctggacttagccggaatattcctcagtaacgcaccaatcgtgttaatggtgctaaccctgtgggcagatctactgaccctcatcctagtcctaccaacctatgaattaacaaaattgtactacatcagaagggtgaaaaaggatgtagagaggagttggctagcgactcggaccgatg

SEQ ID NO: 8119 - DNA, 203 bp, Homo sapiens
ggcgcgccagtcctggaacttggtaatgaaacacaagatcagaaatgaaactattagggcgtggtatgaggaagaagaaatttacggaatgccaaaaatcatcacattgatcaaagctgcctcgctaagtcagagtaaacactgtatcctatgcactgtatgtgagagacgtgattggaagggtggcacgactcggaccgatg

SEQ ID NO: 8120 - DNA, 203 bp, Homo sapiens
ggcgcgccagtcctgttgccctaagtgcggtcgttccggcaggcccatatcatgcggaatgactctggctgactttgaagaaaaacattataagaagatcttcataagagagggagaattggacggaccttttaggcaggaagccagaggttatttacagtacatagcaagggggcagcttttcctaacgactcggaccgatg

SEQ ID NO: 8121 - DNA, 203 bp, Homo sapiens
ggcgcgccagtcctggaacttaccaatactggcaaccaaagtaaagctattaatggtggggaacctgggatccgaagtaggcgacctcgaacatcttggctgggttttgaggggacctgcggtgtgcaaaaagatcgtatcccacgagaagtgccatactgggatagccgacaaattgacagctttctcgactcggaccgatg

SEQ ID NO: 8122 - DNA, 203 bp, Homo sapiens
ggcgcgccagtcctttggaatcatgcccagagggactactcctagagcgccggtcaggttccctacatcactaataaagatcaggagagggttagagacaggatgggcttatacacaccaaggagggataagttcagtagaccatgtaacagcagggaaagacctgttggtctgtgactctatgggcacgactcggaccgatg

SEQ ID NO: 8123 - DNA, 203 bp, Homo sapiens
ggcgcgccagtcctttacttgtgtgactgcctcaggtacaccagctttctttgatctgaagaacttaaaaggctggtctgggctgcccatatttgaagcatccagcggcagggttgttggaagagtcaaagttgggaagaatgaggagtctaaacccactaagctcatgagtggaatacaaacagtgtcgactcggaccgatg

SEQ ID NO: 8124 - DNA, 203 bp, Homo sapiens
ggcgcgccagtcctctgcggcagagtcagtataccaatacatgaaacaaaagcatcccagtattgccttcaacctcagaataggggagatgaaagaaggagacatggctactgggataacatatgcctcatatgggtacttctgccaaatgccccaaccaaaattgagagcagcgatggtggaatactcgactcggaccgatg

SEQ ID NO: 8125 - DNA, 203 bp, Homo sapiens
ggcgcgccagtccttgatgaagggggaagacctgggatcaaacttcctggatatagctggacttaagataccaacagaagagatgaagggaaatatgttggtgttcgtacccactaggaatatggctgtggaggtggcaaagaagttgaaggctaagggttacaactcaggctattattatagtggagcgactcggaccgatg

SEQ ID NO: 8126 - DNA, 203 bp, Homo sapiens
ggcgcgccagtccttaaagaggatggcagtgactgcaggtgagcaggcacagaggcggggtagagtaggacgggtaaaacctggcaggttctacaggagtcaggaagctgcatccggttcgaaagactaccactacgacttgctgcaagctcaacgctacggaatagaagatggcataaacataacaacgactcggaccgatg

SEQ ID NO: 8127 - DNA, 203 bp, Homo sapiens
ggcgcgccagtcctagtcctttagggaaatgaattacgattggagcctctatgaggaagacagcttgttaataacccaattggaagtcctcaacaatctcctgatatcagatgacctcccggctgcagtgaagaacattatggccaggactgaccacccagaacccatacagctagcttataatagctcgactcggaccgatg

SEQ ID NO: 8128 - DNA, 203 bp, Homo sapiens
ggcgcgccagtcctaccctggtagtcaacagaccagcgagacaggaaaagccctaaaacaggtatcaggtttatccacagctgaaaacgccctcctagtagccctgttttcatacgtgggctaccaagcgttgtctaagaggcacatacccgtggtcacagacatatacaccatagaagaccaaagaccgactcggaccgatg

SEQ ID NO: 8129 - DNA, 203 bp, Homo sapiens
ggcgcgccagtcctgtgatggcttaatggggacaggcttgagtgcagccatggaaatgatgtcccaaaacccagtctcggtgggaatagctgtgatgctgggggtgggagctgtagcagcccataatgcaattgaatcaagtgaacaaaagaggacactattaatgaaagtgtttgtaaaaaatttttcgactcggaccgatg

SEQ ID NO: 8130 - DNA, 203 bp, Homo sapiens
ggcgcgccagtcctatggaaacctaagagtgaccaggtactatgataaagatggtgcagagttgaaaccggtaattaaactggaaaaacaggctgagctgtactacaaaggggccacactaagagtagactttagcaacggaaagagtgtaactgcaactgacaagtgggaggtggaccatgcaacgacgactcggaccgatg

SEQ ID NO: 8131 - DNA, 203 bp, Homo sapiens
ggcgcgccagtcctacttgaagagactaattgaactagtccacaagaacaaattggaggaaaaggcaataccccaagctacagtaacaacctggctagcatacacctttgtcaacgaggatgttggaacgataaggccatcttttggggaaagagtgttgcctgaaagcccgggtgacccgagtttgccgactcggaccgatg

SEQ ID NO: 8132 - DNA, 203 bp, Homo sapiens
ggcgcgccagtcctgcagctggatctaccaaaacacagtaaaggagaatgatttgagacccttatttgaggaactgttactgcagtgcccccctggtggtagacaaaccaaaggacatgtagcatctgcataccaactagcacaagggaactgggagcctataagttgcaatgtaaatatgggtacaacgactcggaccgatg

SEQ ID NO: 8133 - DNA, 203 bp, Homo sapiens
ggcgcgccagtccttaccagcaagaagggtcaaaacacatccttatgaagcatacttgaaattaaaagatcttttaaatgagcataagatgagggtggaaactggctgtgctgacttaaaagaccataataggtggatactaaggaaagtgaagcaccaagggaacttaagaacgaggtacatcttaacgactcggaccgatg

SEQ ID NO: 8134 - DNA, 203 bp, Homo sapiens
ggcgcgccagtcctatgctaaagtcagattggcaatcaccaaagtgatgtacaaatgggtcaagcaaaaacctgtggtgataccggggtacgaaggaaaaaccccactttttcaaatcttcgataaagtaaagaaggagtgggatggcttcaacgacccggtagcagtgagttttgacacaaaggcttcgactcggaccgatg

SEQ ID NO: 8135 - DNA, 203 bp, Homo sapiens
ggcgcgccagtcctaaggagcgcagatattgtatgaatctggcaaaccacagaaaatactagaaggagaccaaatgaaggtggcttacagatttgaagacatagagttttgttcccacacaccaatccccgttagatggtcagacaatagtagtggttacatggccggcaggaacaccgccacggtaccgactcggaccgatg

SEQ ID NO: 8136 - DNA, 203 bp, Homo sapiens
ggcgcgccagtcctttgcaaaaatggccactaggctagactcaagtggggagaggggcactgccgcatatgagaaggcagtggcattcagcttcctcctaatgtattcctggaaccctttaattaggaggatatgtctgttgaccttatcgtcaaaaccagaggtagacccctctaaacaagccacttcgactcggaccgatg

SEQ ID NO: 8137 - DNA, 203 bp, Homo sapiens
ggcgcgccagtcctggaaggaagaaggtaactggcttgtcaatgccgaccggctagtttctagcaagactggcaaaatgtatatccccgatgaagggcacaccttgcaaggcaagtattatgaagaactgagactaactaggccagggggacccactataagggtgggaatagacagataccgtcttgcgactcggaccgatg

SEQ ID NO: 8138 - DNA, 203 bp, Homo sapiens
ggcgcgccagtcctctgaccctggaaacggaagacggtactgctattgattctatcaattataaacttccggctgacgcttgcctcgtaggacttccgattgagaaacactgcccgctcgtgagcaagctcgccgacctggacaacattgactgtggctcaacgactgaagagtttaggctgaaataccgactcggaccgatg

SEQ ID NO: 8139 - DNA, 203 bp, Homo sapiens
ggcgcgccagtcctaatagatgtcaagtcacgcccagaaagcgtaggagctctcaaccacggccggcttcgcacactggcctaatcgaagaagttgagctcttgaccttcaaatttatgcgtgagcacatgcctattttcgtcgtttgccttctcgttgtctccgttgctcggaaatggcccatgtggcgactcggaccgatg

SEQ ID NO: 8140 - DNA, 203 bp, Homo sapiens
ggcgcgccagtcctgaatggggactaggacaagttgccacgtgcgttgaagtccaatgcctgaccatggtaaatgtatctgtgctcgttgactcagttattcaggccactgccagtatggaactccatgggcaccaagactcaagagccgtgttgcgtgatgttcccacggtatttcatttcggggaccgactcggaccgatg

SEQ ID NO: 8141 - DNA, 203 bp, Homo sapiens
ggcgcgccagtcctggccacgtagaactcgcggacagtgtcgtccctgttgactgtctcgtcacaccggtagcccaggcttggaggcttatgactcatgtggccggtcgatactcaaaacatggcatggctggtatcggaagcgtctgggaggacctggtgcggaactttcacttttcgtggagttggcgactcggaccgatg

SEQ ID NO: 8142 - DNA, 203 bp, Homo sapiens
ggcgcgccagtcctggagccttcgtgtggaagcagcttggcagtggcccaatgaaagatcactccgttgagctcgacgactatgctttcaccaacttgtacattcgcgacatgttcgatggtacaaacaaaccttgtttgatatgcgaggacacattgcagtgcgccgccctgagacgagccgcagtccgactcggaccgatg

SEQ ID NO: 8143 - DNA, 203 bp, Homo sapiens
ggcgcgccagtcctgccgcaagaattgctatgcatccaggggtgatgtatgtgaacaccactctatcgtacaacagaacttttgttgaaacgcgaaaacgggttttgacagtgacgctggaatctttggagtataaagtaggatcctacgtcacacatggtcgtcttgagggggacatgggatatctgcgactcggaccgatg

SEQ ID NO: 8144 - DNA, 203 bp, Homo sapiens
ggcgcgccagtcctgcccgcacacgagcgacgacgtggtcacggttgattcttacaactgtcgcgatgcttacttttggcctacccaacattttttcctcggtgggcttgtcggcatgggtgttgttagttgcgtcatcggcatatcaacctatcgacgtcgtcatgaacctctggataatcctccagcgactcggaccgatg

SEQ ID NO: 8145 - DNA, 203 bp, Homo sapiens
ggcgcgccagtcctattggggcctatcgtgggatgactcaggaccttccaccagagatcctcacgttttgcttgataatgggatggaaaacggcattggcgctaggtaccgttgccttactgacgcaaggtacgagcgctttttacaagtggacgcagaaatcactagagtccaaaagctcctacaggcgactcggaccgatg

SEQ ID NO: 8146 - DNA, 203 bp, Homo sapiens
ggcgcgccagtcctacgggggacgtgcctgacgggatcgcccttgaagaagatgaagggggaaacttccgtgaccttcgaggaacatatagcgatgaggggatcactattggccaagacatggggtctgcccagatcccagagaccatggtcatcatattgattggttgtgccctcacgtctgcttctcgactcggaccgatg

SEQ ID NO: 8147 - DNA, 203 bp, Homo sapiens
ggcgcgccagtcctatctatcgaattaatgtacgtagcttcatggaaaaccgacagcgtggagtaggtgtggcaaaaaacggagttttccacacgttaatgcatgtcactcgtggagagcccctcaaatggcgagaaaagctagtgtccttacattcgggaagtgctttacgagatgtagtgtcgtatcgactcggaccgatg

SEQ ID NO: 8148 - DNA, 203 bp, Homo sapiens
ggcgcgccagtcctatcgtttcggaagtcaaagcaaattttgacgcggggttgaggaccataatcctgacacccactcgggttgtcatggctgaagttatggaagccctcgggcaagccggaataacgtgtgaccggaaccttatgtattgtcgcagaaatttggtgacagttgcctgtcacgccacgcgactcggaccgatg

SEQ ID NO: 8149 - DNA, 203 bp, Homo sapiens
ggcgcgccagtcctttcacaaaatttgtgttgtcgcatggcgtaaagaaaattggggtggcgctcattgtcatggatgagtgtcacttcatggatcccatgtcaatagctgcccggggagtaatggagcatctacatgagaagggaacgaaactcatgtatttgagtgccaccccccctggacactcccgactcggaccgatg

SEQ ID NO: 8150 - DNA, 203 bp, Homo sapiens
ggcgcgccagtcctccccttcatcgcgcaaacttcacagctaattacgctcgggctagtagcgacgaaacctctctggttgtttccactgacatttcggaaatgggggccaatttgggtgttgatatggttatcgacacccgcaaggttctccggcccctcgtagcatccgagaatagaatcaagttgcgactcggaccgatg

SEQ ID NO: 8151 - DNA, 203 bp, Homo sapiens
ggcgcgccagtcctcccgaagaggccatgtacagccaaccccctgggcgctataccttagttggggaagacctgctccgctttatgaagttcctggacaaagacgatattcctacctggctcgcttggcattgggcagaggcggccgaccgcagacattctgccctcttccagggtaatagcactggccgactcggaccgatg

SEQ ID NO: 8152 - DNA, 203 bp, Homo sapiens
ggcgcgccagtcctaatccccggtcgcacatccacgacgtaatggatttcggatcaatgctgtcggccattggattgattgacatgaacttcctgttttataagtttttgcatattgccatgcgagccctcggagctatggcccctttcagtaaatttcgcgccctagaaaagtccaccacgataggtcgactcggaccgatg

SEQ ID NO: 8153 - DNA, 203 bp, Homo sapiens
ggcgcgccagtcctcttggctgtggacgtggcggctggagccaaagagtggttatggaggagacagtgacgtccgttcatgggttcacaattggtggcaatgacaaggaaaacccccagcgatttgtcacacgtggatataatttgaccagcctcaagcccggggtggacgtctacaaactggagccacgactcggaccgatg

SEQ ID NO: 8154 - DNA, 203 bp, Homo sapiens
ggcgcgccagtcctaagcgatgtgacacaatcatgtgtgacatcggtgaaagtgacccaaatctcaccaaagagcggacaagaacactaaaagtcttacagctattggagacttggttatctatcaaccctgaggcccaatttgtatgcaaggtcctatccccctactcccttgaggtgttgcggaagcgactcggaccgatg

SEQ ID NO: 8155 - DNA, 203 bp, Homo sapiens
ggcgcgccagtcctgttgaatccctccagcaaaagtacaaaggtaagctcgtgcgcttggcacacagtaggaatagcacggctgaaatgtattacatatcaggaaataggtccaacgccgtaagggacgcttatatgaccctggctgctttaataggaagattttcgcgacacattgacagtgtattccgactcggaccgatg

SEQ ID NO: 8156 - DNA, 203 bp, Homo sapiens
ggcgcgccagtcctctcccggagccaacactaccgcgaggaaccagagctgatccagcagctagcgtgtctgccatgaatgttgatgacatggttgatcgtgtcagaaaggtccaacaggaaaacagcgcgacatggttcattgacccggaacacccgtataaaagctttagatattttgggtcttttcgactcggaccgatg

SEQ ID NO: 8157 - DNA, 203 bp, Homo sapiens
ggcgcgccagtcctctggaatttgaggccttggggttcctaaatgctgatcactgggtcagtcgtgaaaactttcctgggggtgtgggtggagtgggtgtcaattactttggcaactacctaaaggaaatttcgctcaaaggcaagtatctctttgctgacgatatagcagggtgggatacgaaggtgcgactcggaccgatg

SEQ ID NO: 8158 - DNA, 203 bp, Homo sapiens
ggcgcgccagtcctagttctgaagaccttgaggatgaagagactctcttaaccgaactgactgcaaaccccttccaccgcgccctaatcgccgccacaatgaagttggcttaccggaacatagtggcgatgtttccccgcacccacacgcgatacggtagcggcaccgttatggatgtcgtcgggcgccgactcggaccgatg

SEQ ID NO: 8159 - DNA, 203 bp, Homo sapiens
ggcgcgccagtcctgcgggagatgatgttgtagtgtcgacaatgaatcggtcatttgcctcttccttagactacttggagctgacgggaaagacccgtaaaaacgttccacgaggtgccccttcaaaaatggaaagcgactggcaaaaagtcgaattttgctcacatcactaccacgaactttccctccgactcggaccgatg

SEQ ID NO: 8160 - DNA, 203 bp, Homo sapiens
ggcgcgccagtcctgccgctatcacctccgccgtcccttccaactggtttccagtcgggcgaacatcctggtcagtacatcaatttcacgaatggatgacgacatccgacatgctccgcgtttggaacgatgtgtggatatacaataacccgtggatcagagtgaaggacccaattggctcatgggatcgactcggaccgatg

SEQ ID NO: 8161 - DNA, 203 bp, Homo sapiens
ggcgcgccagtccttatggcaggcgggcttgtggacggcttcggcccacccacagcaagaatgccatcatctgtcctcacccccaattttcccttttcttcccctgcaaccattacgcttactcgcatgtgcattgagtggtgcatgtgttgaacaaacagctacactcacatgggggcgggttttcccgactcggaccgatg

SEQ ID NO: 8162 - DNA, 203 bp, Homo sapiens
ggcgcgccagtccttcttctgttcacgatggagggctctaacggattctcgagttcgttggctggcctttcttcatcgcgctcttctctacgcctcctcactcattttctctccctccccaccttacccgttaacatctatctcaatgctcgccgtcactccggctggtatcgctccccccccaccttcgactcggaccgatg

SEQ ID NO: 8163 - DNA, 203 bp, Homo sapiens
ggcgcgccagtcctacccgttaacatctatctcaatgaacaatttgacaatctctgcctggcggctttgcgctatccgggccacaaattgtatccctctgtccacactctgttccctgatgtttcacccctcaagattccccactctgtccccgcctttgctcacctcgtccagcgacaggggctgcgcgactcggaccgatg

SEQ ID NO: 8164 - DNA, 203 bp, Homo sapiens
ggcgcgccagtcctgcggcaaggaaactccatcaccaacatctacggcaatggcaacgacgtcaccacagacgtcggcgccaatgggatgtccctccccattgccgtaggtgacatgcctaccgcctctacctctgaagcccctcttggttccaacaaaggtggctcttccacttccccaaaatccaccgactcggaccgatg

SEQ ID NO: 8165 - DNA, 203 bp, Homo sapiens
ggcgcgccagtcctctctcaaaccacagctcttcttgctcttcccggcaacatcgccggtggtgccccctctgcaacagttaatgccaacaacacttccatctcttcccaagctcttttaccctctgttaatccttacccttccacccctgctgtctcactccccaatcccgacgctcccactcaggtcgactcggaccgatg

SEQ ID NO: 8166 - DNA, 203 bp, Homo sapiens
ggcgcgccagtccttggccccgccgccgaccgccagtggctcgtcgacaccctctcttggtctgagacgatcgcaccccttactgtcttctctggacccaaggctctcacccctggcgtctacccccccactattgaacccaacactggtgtctatcctctaccagctgcactctgtgtttcccatcccgactcggaccgatg

SEQ ID NO: 8167 - DNA, 203 bp, Homo sapiens
ggcgcgccagtccttgaatctgtcttttccactgcctacaatgctcacgcctacttcaactgtggcttcgatgtcacagtcgtcgtgaacgcttcccagttccacggcggctcgctgatcgtcttggccatggctgaaggtctgggcgacatcaccccagctgattcttccacttggttcaacttccccgactcggaccgatg

SEQ ID NO: 8168 - DNA, 203 bp, Homo sapiens
ggcgcgccagtcctcgacgttcgccttccccagtgccccgcccttggtttccaatcgggagccgatggtgcagaagtccaacctgcccccaccagcgacctctctgatggtaaccccaccaccgaccctgcccctcgtgacaactttgactacccccaccaccctgttgatccttccactgacctagccgactcggaccgatg

SEQ ID NO: 8169 - DNA, 203 bp, Homo sapiens
ggcgcgccagtcctcaatgtctctgccccttcccaaccctgcactttctacgtcttctatgcccccccgggtgcatctgtcccttctgtgcagactctcgcagaactctctttcttcacccacactgccactcctctcaacctggcagcaccaaccaacatcactgtctccatcccttactcctcccccgactcggaccgatg

SEQ ID NO: 8170 - DNA, 203 bp, Homo sapiens
ggcgcgccagtcctccagtctgttctctgtacgtcctttggaggtttcggcctccaaaacggcggagatgcaggtaacctccactccaacacatggggtactctcatcctctatgttgatctcccccaatctgacagtgtctctgtttctgcttacatctccttccgtgactttgaagcgtacgtccccgactcggaccgatg

SEQ ID NO: 8171 - DNA, 203 bp, Homo sapiens
ggcgcgccagtcctccgccagactcctggcgttggccctgtgcccacgagcacctccatcgttcgtgtcgctcggcccacccccaaaccccgcacggctcgccgccaaggcggcaccctcgcggacctcatcctctcccccgaaagccgatgcttcattgtcgcccacactactgcccccttctactccgactcggaccgatg

SEQ ID NO: 8172 - DNA, 203 bp, Homo sapiens
ggcgcgccagtcctcatccttctggtcaaccccgacgaggagtatgccatcagcatgttctctcatggcgacgagtcaatcctccagtactcgtcgcgctctggcactcgcctcacccccactgccccagccttcttcctctgtgctgctgcatctgttgacacagtcctcccctactccatctctcacgactcggaccgatg

SEQ ID NO: 8173 - DNA, 203 bp, Homo sapiens
ggcgcgccagtcctatcacacctttggcttaccgatctgactggcattcctctccgcgcagtccccccccttactctcttcctctccgcgggagccgccctgtgtgccggcgcacaaacgctgatagccgtcgcacagggtggttctaccccggaaaccccacccactcccaaccgcgctctcctccgcgactcggaccgatg

SEQ ID NO: 8174 - DNA, 203 bp, Homo sapiens
ggcgcgccagtccttcgtcagggccttggcgatctcccggatgcggcgaaaggactttccgccgcgctcgagagtgttgccagggtcgctggcgatgccaacattgccacctcctcccaagccattgctacctccattaactctctttccaactccattgatggtgctacttctttcatgcaaaacttcgactcggaccgatg

SEQ ID NO: 8175 - DNA, 203 bp, Homo sapiens
ggcgcgccagtcctgcacattcgcctgaatgtgacggcacgtgacggtgtggccttctcagcggcggctgctctccaaccctccaaccccccttctgcaactcgctattgcaaatttgctaaccctctcactcagttttctatgtttaatctggctgtcgattacaaatcagttgtccttcccaacaccgactcggaccgatg

SEQ ID NO: 8176 - DNA, 203 bp, Homo sapiens
ggcgcgccagtcctccctctcacctgctttgatgaactggttgactttgttctgagctcccttcgcgaccgggcttcggtgaactcgctcctctctggcatggtgcgcactgacgtcacacgccaaggtgggaacgctgatgcccccgctccttctgcagctcctctcccctctgttatcccatctgtcgactcggaccgatg

SEQ ID NO: 8177 - DNA, 203 bp, Homo sapiens
ggcgcgccagtcctcccatcccaggaccccttcacccgtgcggttaacgagaaccgccctgtctctttcctctccaagatctggtcgtggcgagctcccatcttcgccgcctcctctttcctttctctcatcgctgcaactctcaccattgtccgttgtctccgtgacctgcggtccactcagggtgccgactcggaccgatg

SEQ ID NO: 8178 - DNA, 203 bp, Homo sapiens
ggcgcgccagtcctatacagtgggactcctgttccgaaaccacggaaaaaggatctcccaaaacaacctgtgtactctgggcctgtccgccggcagggtttcgaccccgccgtcatgaagatcatgggcaatgtggactcttttgtcaccctctcgggtactaaacccatctggactatgtcctgcctcgactcggaccgatg

SEQ ID NO: 8179 - DNA, 203 bp, Homo sapiens
ggcgcgccagtcctcggttcgccgatgattgccactgatcctggcggcttgggtatcctcggtatccacgtcgctggggtggctggctacaacggcttctccgcacgcctcacccccgagcgtgtccaagctttcctttcccacctggctacaccccaatctgtcctctactttcacccacccatgggcgactcggaccgatg

SEQ ID NO: 8180 - DNA, 203 bp, Homo sapiens
ggcgcgccagtcctcccgcctgcgcacgtctctcgtcgcagccggctccatcccatccctcccgcctttggtgctttccccatcaccaaagaaccagcagccctttctaggaaggaccctcgcctccccgagggcaccgacctggatgccatcaccctcgccaagcacgacaagggcgacatcgcgaccgactcggaccgatg

SEQ ID NO: 8181 - DNA, 203 bp, Homo sapiens
ggcgcgccagtcctgccctggccttgcatggaggaggcggctgactggtacttctcccagcttcctgataacctccctgtcctctcccaggaagatgccattcgtggtctcgaccacatggatgccatcgacctctcccaatctcctggctacccttggacgacacagggccggtcccgccggtccctcgactcggaccgatg

SEQ ID NO: 8182 - DNA, 203 bp, Homo sapiens
ggcgcgccagtcctgttcgacgaggatggcaaccctctccctgagctccaggaagccatcgattccgtctgggacggtggctcctacatctatcaatctttcctcaaggatgagttgcgccccacggcaaaagccagagctggaaaaacccggattgtggaggcggctccgatacaagcaattgtagtcgactcggaccgatg

SEQ ID NO: 8183 - DNA, 203 bp, Homo sapiens
ggcgcgccagtccttggacgtcgcctccttggttctctcatcaaccacctccagggtaaccctctccagcatggcagtgccgttgggtgcaatcctgacatccactggactcaaatcttccactcactcacctctttctctaatgtctggtctattgattactcttgctttgatgccactatcccctccgactcggaccgatg

SEQ ID NO: 8184 - DNA, 203 bp, Homo sapiens
ggcgcgccagtccttgctgacaaggcttctgactttcctgactcttcttccatctttgacatcactttccttaaacgctattttgtccctgatgatatccacccccacctcatccatcctgtgatggatgagcaaaccctcaccaactcaatcatgtggttgcgtggcggggagtttgaggaggtgttcgactcggaccgatg

SEQ ID NO: 8185 - DNA, 203 bp, Homo sapiens
ggcgcgccagtcctgcggtcactcgagactcttgcctttcactcgggaccgaagaactactcggcttggtgtgagaaaatcaaggctaagattcgagagaacggctgtgacgccactttcactccctactccgtcctccaacgtggttgggtttccacctgcatgactggaccctaccccctcaccggcgactcggaccgatg

SEQ ID NO: 8186 - DNA, 203 bp, Homo sapiens
ggcgcgccagtccttttcgaccgccttatggcaggcgggcttgtggacggcttcggcccacccacagcaagaatgccatcatctgtcctcacccccatttctcccctccttcccctgcaaccattacgcttactcgcatgtgcattgagtggtgcacgtgttgaacaaacagctacactcacgtggggcgactcggaccgatg

SEQ ID NO: 8187 - DNA, 203 bp, Homo sapiens
ggcgcgccagtcctgcgggttttcccgcccttcggcctctcgcgaggcccacccttccccttcctcccataactacagtgctttggtaggtaagcatcctgatcccccgcggaagctgctcgcgtggcaactgtggggacccagacaggttatcaaaggcacccggtctttccgcctccaggagtatccgactcggaccgatg

SEQ ID NO: 8188 - DNA, 203 bp, Homo sapiens
ggcgcgccagtcctcgtagtcgtcttccggcttgtccggcgcatgtttggtgaaccggtggggtaaggttggtgtgcccaacgcccgtactttggtgacaactcaagaccacccaggaatgccagggaggtaccccgcctcacggcgggatctgaccctgggctaattgtctacggtggttcttcttgcgactcggaccgatg

SEQ ID NO: 8189 - DNA, 203 bp, Homo sapiens
ggcgcgccagtcctcttccatttctttcttctgttcatgatggagggctctaacggattttcgagttcgttggctggcctttcctcatcacgctcttcacttcgcctcctcactcatcttctttccctcccccccccgaatcgcgacgcccgccgccactctggctggtaccgctccccccccaccctcgactcggaccgatg

SEQ ID NO: 8190 - DNA, 203 bp, Homo sapiens
ggcgcgccagtcctccccgtcaatgtctacctcaatgaacaatttgacaatctttgcctggcggctttgcgctacccaggctgcaaattatacccctctgtttacactctatttccagatgtctcacccttcaagatcccccaatccatccccgcctttgcccaccttgtccagcgacaggggttgcgcgactcggaccgatg

SEQ ID NO: 8191 - DNA, 203 bp, Homo sapiens
ggcgcgccagtcctatccaacggcaacgttgttcgcggatcccgctactccaagtggtgggagcccgcggccgcacgcgccttggatcgtgctcttgaccatgctgttgacgcgactgacgcagttgctggcgccgcctccaagggcatcaaggctggagccaccaagctctccaacaagcttgctggcgactcggaccgatg

SEQ ID NO: 8192 - DNA, 203 bp, Homo sapiens
ggcgcgccagtcctccacgcaatcatcaatctggctaattctaattctgctaccctcaaacttccttacattggagtcactccaaacacctccactgaaggacttcacaactattggaccattctctttgcccctctgactcctcttgctgtcccgaccggctcccccacctctgtcaaagtctccctcgactcggaccgatg

SEQ ID NO: 8193 - DNA, 203 bp, Homo sapiens
ggcgcgccagtcctccaatggcgtggctctctacagatctctctcatcttcactggtcctgctcagtgctacggccgccttcttcttgcttacacccctccctccgccaatcctcccaccaccatcgaggaagccaacaacggcacctacgatgtctgggatgtgaatggcgactccacctacactttcgactcggaccgatg

SEQ ID NO: 8194 - DNA, 203 bp, Homo sapiens
ggcgcgccagtccttgacgtccgcctcccacagtgtcctgcccttggcttccagtcgggagctgatggcgcagaagtccaacctgcccccaccagtgacctctctgatggtaaccccaccactgaccccgctcctcgtgacaactttgactaccctcaccaccctgttgatccttccactgacctagccgactcggaccgatg

SEQ ID NO: 8195 - DNA, 203 bp, Homo sapiens
ggcgcgccagtcctcaacgtctctgctcctcttcaagcttgcaccttctacatcttttatgcccctcccggtgcatctgtcccttctacgcagacccttgcagaactctctttcttcactcatactgccacccctctcaacttagctgctccaactaacatcactgtctctatcccttatgcctctcccgactcggaccgatg

SEQ ID NO: 8196 - DNA, 203 bp, Homo sapiens
ggcgcgccagtccttcggcaaacccctggtgtcggtcccatccccacgagcacctccatcgttcgtgtcgcccggcccactcccaaaccccgcagggtccgccgtcaaggtggtactcttgcagacctcatccttacccccgagagtcgttgcttcattgttgcacatactactgccccctactactccgactcggaccgatg

SEQ ID NO: 8197 - DNA, 203 bp, Homo sapiens
ggcgcgccagtcctcttctctggccttgccccgaagaaccccacctctcctctccaacacctctttgccaagctcatcaaatgggtgaccaaaatcatcggttcactcatcatcatctgcaacaaccccaccccctcagcactcattggtgtttccctcatgctctgcggtgacctcgccgaggacatcgactcggaccgatg

SEQ ID NO: 8198 - DNA, 203 bp, Homo sapiens
ggcgcgccagtcctcgagaagattatgtcccacatcaagaatcttctcgagtggcttggggtcctcgtcaaagatgaccccaggaccaaactcaactcgcagcatgagaaaattctggaactctacactgactctgttactgcttcttcaactcccccctctgagctttctgcggacgccattgggtccgactcggaccgatg

SEQ ID NO: 8199 - DNA, 203 bp, Homo sapiens
ggcgcgccagtcctcaacctggacctggccaagcaacttctcactctctcgcatgctgccaactctgtcacccacatccagttgtgcacacgcgctatcaccaactactctacagctctctctgccatctcccttgtcggtacacctggcacgcggccagagccactggtcgtgtacctgtacggacccgactcggaccgatg

SEQ ID NO: 8200 - DNA, 203 bp, Homo sapiens
ggcgcgccagtcctccctgggactggcaaatccctcctcgcttctctcctcgcttctactcttgctcaggccctctctggtgaccccaacaattactactcaccttcttcccctgactgcaaattctacgatggttactctggccagcctgtccactacatcgacgacatcgggcaagaccccgatggcgactcggaccgatg

SEQ ID NO: 8201 - DNA, 203 bp, Homo sapiens
ggcgcgccagtcctcccactctcctgcttcgatgaactgattgactttatcttgggctctcttcgcgatcgggcctcggtgaactcccttctctctggcatggtgcgcaccgacgtagcacgccagggcgggaacgctgacgcccccgctccctctgcagctcctctcccctctgtcctcccctctgtcgactcggaccgatg

SEQ ID NO: 8202 - DNA, 203 bp, Homo sapiens
ggcgcgccagtccttccttcccaggaccctttcgtccgtgcggtgaacgagaaccgcccggtctctttcctctccaagatctggtcgtggcgtgctcctatcttcgccgcctcctctttcctttccctcattgctgcaaccctcaccattgtccgctgtctccgtgacctgcggtccacccagggtgccgactcggaccgatg

SEQ ID NO: 8203 - DNA, 203 bp, Homo sapiens
ggcgcgccagtcctctggccttgcatggaagaggcggctgactggtacttctcccagctccctgacagcctcccagtcctctctcaggaagatgccattcgtggtctcgaccacatggatgccatcgacctctctcagtctcctggctatccttggacaacacagggccggtcccgccggtctctgttcgactcggaccgatg

SEQ ID NO: 8204 - DNA, 203 bp, Homo sapiens
ggcgcgccagtcctgcgtcgtcttcttggttctctcatcaaccacctccagggtaaccctctccagtatggcagcgccgttggatgcaaccctgacatccactggactcaaatcttccactctctcactcccttctctaatgtctggtctattgattactcttgctttgacgccaccatcccctctgtcgactcggaccgatg

SEQ ID NO: 8205 - DNA, 203 bp, Homo sapiens
ggcgcgccagtcctaagtcctaaaaacccttaacttggtcatactactcaactcagcaaaatgggagctcaggtatcaacacaaaagactggtgcgcatgagacgggtctaaatgcgagcggcaattcggttatacattacactaacatcaatttttacaaagactctgcatcaaactccctgaacagcgactcggaccgatg

SEQ ID NO: 8206 - DNA, 203 bp, Homo sapiens
ggcgcgccagtcctactattcggacagaacatgctgtaccattatttaggtagaacgggctacactgttcacgttcaatgcaacgcctcaaagttccaccaagggtgtctcctggtagtgtgcgtgcccgaagccgaaatggggtgtgccacagttgataggacggttactgaggagtatttatcaaacgactcggaccgatg

SEQ ID NO: 8207 - DNA, 203 bp, Homo sapiens
ggcgcgccagtcctggtgctatgtacaccggggagtaaccaattcctgacatcagatgactttcaatccccctctgcaatgccgcagttcgacgcaaccccccaaatgcacataccaggacaagtgagaaatctaatggaaatcgctgaggtggattcagtagtgccagtgaataacttatcacgctacgactcggaccgatg

SEQ ID NO: 8208 - DNA, 203 bp, Homo sapiens
ggcgcgccagtccttcgcttcgtccacgacgatgtgtataccagtgcagggtacattactgcttggtaccaaaccaccatagttgtccccccaaaaactccgacagattgcaagctgatgtgtttcgtgtcggcctgcaatgacttctcggtgcgtatgttgagagacacccctcacatagaacaggacgactcggaccgatg

SEQ ID NO: 8209 - DNA, 203 bp, Homo sapiens
ggcgcgccagtcctgcacacacacggtgccttcggccagcagtccggtgctgtgtatgtcggtaactatagagtggtaaatagacacttggccacgcataatgattggcaaaattgcgtgtgggaagactacaacagagaccttctcgtgagcacaacgactgcccatggttgtgataccattgccagcgactcggaccgatg

SEQ ID NO: 8210 - DNA, 203 bp, Homo sapiens
ggcgcgccagtcctatgtgagcaagtcaacctgctcaaggagacgctggttggtcaagactccattctagagaaatccctcaaagccctggtcaaaattatatcagccttggttatagttgtaaggaatcacgacgacctcgtaacagtgacagccaccctagcactcattgggtgctctgcatcgcccgactcggaccgatg

SEQ ID NO: 8211 - DNA, 203 bp, Homo sapiens
ggcgcgccagtccttgacgagtgctgtcctgtcaatttcaagaagtgctgcccactagtgtgtggtaaagccatccagtttatcgacagaagaacacaaatgaggtattcgttggacatgcttgtgaccgagatgttcagagaatacaaccacagacatagtgtgggggcgacacttgaggcactcttcgactcggaccgatg

SEQ ID NO: 8212 - DNA, 203 bp, Homo sapiens
ggcgcgccagtcctagactacggcttcctcaatctgggtggaacacccaccaagcgcatgctaatgtacaacttccccacgcgtgcagggcagtgtggtggtgtcctgatgtcaacgggtaaagtccttgggatacacgtcggcggaaatgggcaccagggtttttcagcagccctgttacgccattacgactcggaccgatg

SEQ ID NO: 8213 - DNA, 203 bp, Homo sapiens
ggcgcgccagtccttttaaccacaagtgcaggttatccttatgttgcccttggtatcaagaagagagatattttatctaagaagaccaaggatctgacaaagctgaaggagtgtatggacaagtatgggctgaatctccctatggtcacatatgttaaggatgagctgagatcggcagaaaaggtggccgactcggaccgatg

SEQ ID NO: 8214 - DNA, 203 bp, Homo sapiens
ggcgcgccagtccttaaaggtaagtccaggttaattgaggcatcaagtctaaatgattcagtagctatgaggcaaaccttcgggaacttgtacaaaacattccatctgaacccaggtatagtgacaggcagcgcagttggttgtgatcccgacttgttttggagtaaaatcccagtcatgcttgacggcgactcggaccgatg

SEQ ID NO: 8215 - DNA, 203 bp, Homo sapiens
ggcgcgccagtcctaattaggtggaccaaagaccccaaaaacacccaggatcatgtgcgatccttatgcctattggcttggcataatggggagcaagaatatgaagagtttgtgtccaaaatcaggagcgttccagtgggacgctgcctgaccctgccagcgttctcaactttgcgcaggaggtggctcgactcggaccgatg

SEQ ID NO: 8216 - DNA, 203 bp, Homo sapiens
ggcgcgccagtcctaaggtcttagaaactctcaactttattttgacactcaatacagcaaaatgggagctcaagtatcaacgcagaagactggggcacatgagactagcttgaacgccaacgggagttcggtcattcactacaccaacatcaactactacaaggatgcagcctcaaattcagcaaacacgactcggaccgatg

SEQ ID NO: 8217 - DNA, 203 bp, Homo sapiens
ggcgcgccagtccttggtaggttacggtgtgtggccagagtacttgtctgacaaggaggcgacagcggaggatcaaccaacacaaccagatgttgcaacatgcagattctacaccttagattcagtgcagtgggaaaagaactctgcaggatggtggtggaaattccctgaggctttaagtgatatggcgactcggaccgatg

SEQ ID NO: 8218 - DNA, 203 bp, Homo sapiens
ggcgcgccagtcctgcctattcggtcaaaatatgatgtaccattacttaggacgggcaggttacacgattcacgtgcaatgcaatgcttcaaagttccatcaagggtgtttgcttgtggtctgcgttcctgaggcggagatgggtggtgctaaagtcggacaggcattcgaggcagatgcactagccacgactcggaccgatg

SEQ ID NO: 8219 - DNA, 203 bp, Homo sapiens
ggcgcgccagtcctcactgaacacacctggcagtagtcagttcctgacgtctgatgacttccagtccccttgtgcactaccgcaatttgatgtcacaccacccatgaaaattcccggtgaagtccacaatttaatggagatagcagaggttgactcggtcgtgccggtaaacaacgttaacggcactacgactcggaccgatg

SEQ ID NO: 8220 - DNA, 203 bp, Homo sapiens
ggcgcgccagtcctctgaccaaatggacatgttcagaatcccagtgacaatagggaacaagacccaagatcaagtatttggagtgagattgcagcctggactagacagtgtcttcaaacacacactacttggagagatcctgaattattatgctcattggtccgggagcataaaactaacattcatgtcgactcggaccgatg

SEQ ID NO: 8221 - DNA, 203 bp, Homo sapiens
ggcgcgccagtccttctgcggatccgcgatggcaactggcaagttccttattgcgtactcccctccgggtgcggacccaccgactaacagaaaaggggccatgctgggcaaaaatatagtatgggacatcggactgcaatccagttgcgtactgtgtatgccgtggatcagccaaactcattatagaccgactcggaccgatg

SEQ ID NO: 8222 - DNA, 203 bp, Homo sapiens
ggcgcgccagtccttactgcaaggtgacgtagaggaagcagtgagaaaagccattgtccacgtggctgacaccatacgcagtggcccaagtaactccgaaagtgtgccagccctgacggcagctgagaccggacacacctcgcaggtgactcctagtgacaacatacaaactaggcatgttaagaactcgactcggaccgatg

SEQ ID NO: 8223 - DNA, 203 bp, Homo sapiens
ggcgcgccagtcctaccactccagatcagaatcatccatagaaaatttcctggggagatcggcatgtgtgtacatgaaggactataagaacaaagataatgacatgacaaacaaatacgtcgcatggacaatcaacacaagacagatggtacaaatgaggcgtaagttggagatgttcacgtatgtgccgactcggaccgatg

SEQ ID NO: 8224 - DNA, 203 bp, Homo sapiens
ggcgcgccagtcctctccaatcactagcacaatacgtgtttatttcaagcctaaacacgtaagggtatggatcccgcgagcacctaggctatgtccctacgagaaagcagggagcgtggactttaaaccgactgcaattacctcaaccagagcaaccatcaacactgttcacagcaccactcgacccacgactcggaccgatg

SEQ ID NO: 8225 - DNA, 203 bp, Homo sapiens
ggcgcgccagtccttgcacacatatgggccgtttggtcaacaatcaggtgcagtgtatgtgggcaattacagagtggtcaacaggcacctggcaacccattctgattggcaaaattgcgtgtgggaggattccaacagggacctcttggttagtacaacaacggcgcacggctgtgacaccattgccacgactcggaccgatg

SEQ ID NO: 8226 - DNA, 203 bp, Homo sapiens
ggcgcgccagtcctggtgccaatgcactacaggggtgtacttttgtgcttcaaaaaacaagcactatccagtcgtttttgagggaccgggacttgtagaagtccaggagagtgagtactaccccagaagataccagtcccatgtactcctcgcagcaggcttttccgagcccggggattgtggtggaacgactcggaccgatg

SEQ ID NO: 8227 - DNA, 203 bp, Homo sapiens
ggcgcgccagtccttcttgaggtgcgaacatggagtcatcggcatcgtgaccatgggtggtgaaggtgttgttggtttcgctgatgtaagggaccttttgtggttagaggatgatgccatggagcaaggggttagagattatgttgagcaacttggcaacgcctttggttcgggcttcaccaatcaaacgactcggaccgatg

SEQ ID NO: 8228 - DNA, 203 bp, Homo sapiens
ggcgcgccagtccttttgtgaacaggttaacctattgaaagagtcattggttggtcaagactccatcctggaaaagtcacttaaagctttggtgaaaatcatatcagcactggtcatcgtagtaagaaaccatgatgatctcatcacagtaaccgcaaccctagctctgattggttgcaccacctctccgactcggaccgatg

SEQ ID NO: 8229 - DNA, 203 bp, Homo sapiens
ggcgcgccagtcctcagaggtgagagaaaaacacgaattcttaaacaggctgaaacaactgcccctgttggaaagccagattgccaccattgaacaaagcgccccttcacagagtgatcaagagcaactgttctccaatgtgcagtacttcgcacactactgtaggaagtacgcccccctgtatgctgcgactcggaccgatg

SEQ ID NO: 8230 - DNA, 203 bp, Homo sapiens
ggcgcgccagtcctttcaaggtccaccagtatacaaagagatcaaaattagcgtggcaccagaaacccccccccccccggccatagcagacctgttgaagtcagtagacagtgaggcggttagagagtactgcaaggaaaagggatggttggtacctgagattcactccaccctgcaaattgaaaagccgactcggaccgatg

SEQ ID NO: 8231 - DNA, 203 bp, Homo sapiens
ggcgcgccagtcctacttcaatgatgaacagggtgaaatcgagtttatcgagagctccaaggaggctggtttcccagttattaacacccccagcaaaacaaagcttgaacccagtgtattccatcacgtatttgagggaaataaggagccagcagtgttgaggaatggggaccccagattgaaggccacgactcggaccgatg

SEQ ID NO: 8232 - DNA, 203 bp, Homo sapiens
ggcgcgccagtcctactttgaggaagccatcttttctaaatacattggaaatgtgaacacgaacgtggatgagtacatgatggaagccgttgaccattatgctggacagttggcaactttggacatcagcacagaaccaatgaagctcgaggacgccgtctatggcactgaaggtctggaagcactggcgactcggaccgatg

SEQ ID NO: 8233 - DNA, 203 bp, Homo sapiens
ggcgcgccagtcctatctctctactagtgcagggtacccctatgttgcacttggtatcaaaaagagagacattttgtccaagaaaaccaaggacctgacaaagctgaagggatgtatggacaagtacgggctaaatctcccgatggtcacctatgtgaaggatgagctgagatcagcagagaaggttgcgactcggaccgatg

SEQ ID NO: 8234 - DNA, 203 bp, Homo sapiens
ggcgcgccagtcctccaagggtaaatccaggctaattgaggcatcaagtctgaatgattcagtggccatgaggcagacctttggaaacctgtacaaaacatttcacctaaaccctggcatagtgacaggcagtgcagttggctgtgaccccgatctgttctggagcaagattccagtcatgcttgacgcgactcggaccgatg

SEQ ID NO: 8235 - DNA, 203 bp, Homo sapiens
ggcgcgccagtcctctatcagatggactaaagatcctaagaacactcaggaccatgtgcgatctttgtgcttattggcctggcacaatggagagcaagaatatgaagaatttgtgtcaaaaatcaggagcgtcccagtagggcgctgcttgaccttgcctgcgttctccactctacgcaggaaatggccgactcggaccgatg

SEQ ID NO: 8236 - DNA, 203 bp, Homo sapiens
ggcgcgccagtcctatttttcacaagatccctcaaaattcacaaagcccgtagtagatgctctcaccgaagctgctgttcctttgaaatcaccatcagcagaagcttgcggttatagtgaccgcgtgttacaattgacactaggcaattctactattaccacacaggaagctgctaacattgtggtggcgactcggaccgatg

SEQ ID NO: 8237 - DNA, 203 bp, Homo sapiens
ggcgcgccagtcctccatgcctggagaagatggctctgaattcatagacccgctgttcttggacaacggtacgatgttgcaacaggcaactgttttcccccaccagtggataaatttgagaactaacaacagcgcaaccattatagttccatatatcaacaacataccagcagactcccctgttcgaccgactcggaccgatg

SEQ ID NO: 8238 - DNA, 203 bp, Homo sapiens
ggcgcgccagtcctttttaactacctctgatgactgttctgaaggtttgttaccaaattttcattctactcccgaaattttcatccctggtcaagtgaataatttactcgaattagtgcaaattgagacaatgatgacagtcaataatacagcaacccaggcttcaggagtgggtagaatcacgattccgactcggaccgatg

SEQ ID NO: 8239 - DNA, 203 bp, Homo sapiens
ggcgcgccagtcctctgtttcagtgcaaagtgatgtggacactcaaattgcaggtttcacaattaatcctggtagtgatggagtgtttcagtcaacataccttgggcaaatttgcagatacttcaacaactggtcagggagcattgaaatcactttcatgttctgtggatccttcatggcaacaggcacgactcggaccgatg

SEQ ID NO: 8240 - DNA, 203 bp, Homo sapiens
ggcgcgccagtcctcaatcccctttatgtccacatgtgcagcttatgcttggttttacgatggttatccaagatcatatggaccagatgccgaagcattaaataaatcatatggcatattaccagcaaatcaatttggcaccttttgcatgagattacttggtagtgctctgaagactacattgacagcgactcggaccgatg

SEQ ID NO: 8241 - DNA, 203 bp, Homo sapiens
ggcgcgccagtcctttagaatctacatgaggccaaagcatatcaaatgttgggcacccagaccatttaggatgttgccatatgttgaaaagaatagaccatcctacaaatcaccccctacagatccaatcaagaatcggactagtatcaccacaacgggagcatttggacaacaaagtggagctgtctcgactcggaccgatg

SEQ ID NO: 8242 - DNA, 203 bp, Homo sapiens
ggcgcgccagtcctacaaacacttcccagtgtgtttccagggtccgggtctcacatttattgaggccaatgagtactacccagcgcgatatcagtcccacgtgcttctagccgttggccatgcgcaaccaggcgattgtggtggcattttacgatgtgaacatggagtggtgggaatcctaacagcagcgactcggaccgatg

SEQ ID NO: 8243 - DNA, 203 bp, Homo sapiens
ggcgcgccagtcctcagaagaagtaccaccaccaccagccattgcagaccttttaaagtcagtggactcagaggaggtcagaaactattgtgaatcaaaaggatggatagtacctgccatggaaattaatgttgagagacacatcaatagagcaatgactattctccaagctgtgtccacctttgttgcgactcggaccgatg

SEQ ID NO: 8244 - DNA, 203 bp, Homo sapiens
ggcgcgccagtccttaatgtacaacttcccaaccaaatcaggacaatgcggaggcatactcatggctacaggtaaggtgttaggaatccatgttggtggcaatgggcaccagggctttgctgcaactcttttgagatcatatttcagtgaagagcaaggtgagattgaatggatggagaccaacaaggcgactcggaccgatg

SEQ ID NO: 8245 - DNA, 203 bp, Homo sapiens
ggcgcgccagtcctagtcaggttatcccataatcaatgcaccaaccaagacaaaactagaacccagcgtctttcatgatgtttttgagggaaagaaggagcctgctgtgttgaacccccgtgatcccaggttgagagttgattttgaagaagctatcttctccaaatatgtgggtaatgttaacacaccgactcggaccgatg

SEQ ID NO: 8246 - DNA, 203 bp, Homo sapiens
ggcgcgccagtcctcggtctggttcgcagctctaaaaatattgctggagaaaattggatacaccaacaatgagaccaagtacattgattatttgtgtaactcctatcacctttacaaaaataaacattattttgttagagggggcatgccatctggttgctcagggacttccatcttcaacagtatgacgactcggaccgatg

SEQ ID NO: 8247 - DNA, 203 bp, Homo sapiens
ggcgcgccagtcctccagtgggtcgatgccttttgcttccggcttattcgacacttagacggaaatggcttgactctttctaaattatatacaatcaatttaaatgattaggctaattggctaaccctgtcacgtatctggacgtgacaaaacgtgacaggggtaaatttagcacatccagagtgcttcgactcggaccgatg

SEQ ID NO: 8248 - DNA, 203 bp, Homo sapiens
ggcgcgccagtccttgttttcttgttttgccgtgcatttagaataagagacaacttaaacctccgattcggcaacacagggaataatctcaccagacccggcagtgtcttcaggcttcatagccccaagatggagagtcgggcccacaaagcatggatgacgcacaccgcatcaggtttcgaaacagacgactcggaccgatg

SEQ ID NO: 8249 - DNA, 203 bp, Homo sapiens
ggcgcgccagtcctttaccataagattttaacagcaggattgtcagtccaacaaggcattgtgagacaacgggtcattcaagtccaccaggttacaaacctagaagaaatatgccaattgatcattcaagcctttgaagctggtgttgattttcaagagagtgcagacagtttcttgctgatgctatgcgactcggaccgatg

SEQ ID NO: 8250 - DNA, 203 bp, Homo sapiens
ggcgcgccagtccttttacatcatgcttatcagggtgactacaagcaattcttggaaagcaatgcagtcaagtaccttgagggtcatggctttcgctttgaggtcaggaaaaaggaaggagtcaagcgactcgaagaattgcttcctgctgcatccagtggcaagagcatcaggagaacactggctgccgactcggaccgatg

SEQ ID NO: 8251 - DNA, 203 bp, Homo sapiens
ggcgcgccagtcctcggactgtttcctcagctttctgcaattgccctaggtgtcgcaacggcacacggcagtaccctggcaggagtaaatgtgggggaacagtatcagcaactacgagaagcagccactgaggcagaaaaacaattgcagaaatacgctgaatctcgcgagcttgaccatctaggtctcgactcggaccgatg

SEQ ID NO: 8252 - DNA, 203 bp, Homo sapiens
ggcgcgccagtccttcccagaaaccgcacggccgagaatcgatccccagcattcaaaatgcgttattaagaaaaaacatatgatgaagattaaaaccttcatcaacattgcacagactttgatccttaggagtttattctagctatctacaaaacgggtccaaaacggaatgatttccactagggctgcgactcggaccgatg

SEQ ID NO: 8253 - DNA, 203 bp, Homo sapiens
ggcgcgccagtcctcttttcaccaactggtccaggtaatttgcaagctaggaaaagacaattctgcattggacattattcatgctgagttccaagccagccttgctgaaggtgattctccccaatgtgccctgatccaaataacaaaacggatccccatcttccaggatgccactccgcccacaattccgactcggaccgatg

SEQ ID NO: 8254 - DNA, 203 bp, Homo sapiens
ggcgcgccagtcctctcaccttcagacatcaacgcatggcagtcccaaacaccggtgagggaggcgcccggcgacaacacatgatgataggctgatcttcgggataagagacatgaaaaaccaaaaagccgtttacatccagatccaagatcaagagtggcttggaaataaggggcacttgttctttgcgactcggaccgatg

SEQ ID NO: 8255 - DNA, 203 bp, Homo sapiens
ggcgcgccagtccttggtgaatgtaatatctggcccgaaagtgctgatgaagcaaatcccaatctggcttcctctgggtgtctctgaccagaagacatatagctttgattcaaccactgctgccattatgctagcatcatataccatcactcattttggcaaaacctcaaatccccttgtgagaatcacgactcggaccgatg

SEQ ID NO: 8256 - DNA, 203 bp, Homo sapiens
ggcgcgccagtcctaaactccagctgtgtcaactggcacgctccgcccagggatctcattccatcccaaattaaggcctatcctgctaccaggaagagctggaaagaagggctccaactccgatctaacatctcctgacaaaatccaggctataatgaatttcctacaagacctcaaaattgtaccaacgactcggaccgatg

SEQ ID NO: 8257 - DNA, 203 bp, Homo sapiens
ggcgcgccagtccttcgatccaaccaagaatatcatgggtattgaagtgccagaactcctggttcacaggctgactgggaagaagacaactaccaagaatggtcaaccaatcattccaattctgctaccaaagtacattggtcttgatcctctatctcaaggtgatctcacaatggtgatcactcaggcgactcggaccgatg

SEQ ID NO: 8258 - DNA, 203 bp, Homo sapiens
ggcgcgccagtcctaaggcagccaagcagcagcccccgagccgagcccaaacccattacacccgagcccaacacccatccagcaacccacaaccgtcaaacgcacagatggacaagcaaagaacatcaagccaggagcaacacagaccccaagtctaagctgatcaacccctcccgcaatcccaccaacgactcggaccgatg

SEQ ID NO: 8259 - DNA, 203 bp, Homo sapiens
ggcgcgccagtcctcgccagcaaaaatcccccaactcgataccaaccccaagcaaatcagctcaaaccgtctatctctccccgcttcactccacaccccagattcagcaaacgatcaacgcacttcttatgccacagcttatattaagaaaaagaacttgatgaagattaaggcaaccagtggtgctacgactcggaccgatg

SEQ ID NO: 8260 - DNA, 203 bp, Homo sapiens
ggcgcgccagtccttcttcatctctttgatttgagtcttaagtgaatacacaggttctaatactgttcttctgtccaacggtataattcagccaggcctaagacagtagctaatcacagtcatcatgggagcgtcagggattctgcaattgccccgtgagcgcttcaggaaaacatctttctttgtttcgactcggaccgatg

SEQ ID NO: 8261 - DNA, 203 bp, Homo sapiens
ggcgcgccagtcctgggtaataatcctattccataaagtcttttcaatcccgttgggggttgtacacaacaataccctacaagtgagtgatattgacaagtttgtgtgccgagacaaactctcttcaactagccaattgaagtcagtcgggttgaacttggagggcaatggagtagcaactgatgtaccgactcggaccgatg

SEQ ID NO: 8262 - DNA, 203 bp, Homo sapiens
ggcgcgccagtccttacacaaagtctcaggaactggaccatgcccaggaggactcgcctttcacaaagaaggagccttcttcctgtatgaccgactcgcatcaacaatcatttatcggggtacaacctttgccgaaggagttattgcatttctgatcttgcctaaggcgcgaaaggattttttccagtcgactcggaccgatg

SEQ ID NO: 8263 - DNA, 203 bp, Homo sapiens
ggcgcgccagtcctcagtagaggcacgggaccatccagccccacggtccccaacaccacagaaagccacgccgaacttggcaagacaaccccaaccacactcccagaacagcacactgccgccagtgccattccaagagccgtgcaccccgacgaactcagtggacctggcttcctgacgaacacaatcgactcggaccgatg

SEQ ID NO: 8264 - DNA, 203 bp, Homo sapiens
ggcgcgccagtcctacggggggttacaaatctcctgacaggatccagaagaaagcgaagggatgtcactcccaatacacaacccaaatgcaacccaaacctgcactattggacagccttggatgagggtgctgccataggtttagcctggataccatacttcgggccagcagctgagggaatttacaccgactcggaccgatg

SEQ ID NO: 8265 - DNA, 203 bp, Homo sapiens
ggcgcgccagtccttgaaggcataatggagaatcaaaatggattgatctgtggattgaggcagctggccaacgaaacgacacaagctcttcaattgttcttaagggcaactactgagttgcgtacattctctatactaaatcggaaagcaatagacttcttgctccaaagatggggaggaacatgtcacgactcggaccgatg

SEQ ID NO: 8266 - DNA, 203 bp, Homo sapiens
ggcgcgccagtcctaaatctcaacttagcttgctatgtgaaagccacttacggcgagaaggacttggtcaagaccaatcagagtcagttctggaggtatatcaacgcttacacagcgataaaggtgggaatttcgaggcagcactatggcagcagtgggatcggcaatcattgataatgttcataacacgactcggaccgatg

SEQ ID NO: 8267 - DNA, 203 bp, Homo sapiens
ggcgcgccagtcctatgaacaccagaaaaccaggaccagtcaaattctccctcctccatgaatcaaccttgaagacacttgctaaaaaacctgcgacccagatgcaagcactaatcttagaattcaatagttctctcgctatttaactcaactcatcaaaatgctaacttgtgatccttaagctgcaccgactcggaccgatg

SEQ ID NO: 8268 - DNA, 203 bp, Homo sapiens
ggcgcgccagtcctcttagacttttgataagaatactaactattgatgattgtctttgacatgaggataagaacactgcccattagatagatggggttcaccattaatacacaattacccaatcatgttaacagcagttagatccctcaagtatatcaagttcattctaccctttgcattgtcactctcgactcggaccgatg

SEQ ID NO: 8269 - DNA, 203 bp, Homo sapiens
ggcgcgccagtccttattccgcatactccttaaatccccaactaaagaactgtagactaccgaaacatatataccgactaaaatatgacaccactgttacagagtttttgagtgatgtgccggtagcaacattgccagcggattttttagtacctacatttcttaggactctatcaggaaatggttctcgactcggaccgatg

SEQ ID NO: 8270 - DNA, 203 bp, Homo sapiens
ggcgcgccagtcctcaaatgtttcactggtatgatcttgcaattctagcacgtagagggcgactaaatagagggaataatcgctcaacatggtttgcaagtgataatttggtagatatcctaggttatggagattatattttttggaaaataccattatcactactaccagtggatacacaaggcctccgactcggaccgatg

SEQ ID NO: 8271 - DNA, 203 bp, Homo sapiens
ggcgcgccagtcctccacatgcagccaaggactggtatcatgaatcggttttcaaggaggctattcaaggccatacacacatcgtgtccatctctacagcagatgtcttaatcatgtgtaaggacataatcacctgtcgatttaatactttactgattgctgctgtggcaaatctagaggattcagttcgactcggaccgatg

SEQ ID NO: 8272 - DNA, 203 bp, Homo sapiens
ggcgcgccagtcctcattcagattaccctttaccagaaacagtgtctgacctatacaaagcaggagattatttaatctcattgctaggatcagaaggttacaaagtcataaaattccttgagccgttatgcttagcaaagatccaactctgctcaaattacactgagaggaaaggaagattcctcactcgactcggaccgatg

SEQ ID NO: 8273 - DNA, 203 bp, Homo sapiens
ggcgcgccagtcctgcagtttttgaacccaatgttcttggttataacccaccgaataaatttgctacaaaaagggtacctgagcaattccttgaacaggagaatttctcaatagagagtgtcctacattatgctcaacgtctggaatatcttctcccggagtaccggaacttctctttttcactcaagcgactcggaccgatg

SEQ ID NO: 8274 - DNA, 203 bp, Homo sapiens
ggcgcgccagtcctgagaaggagttaaacattggacgagcttttgggaaattgccatatccaacacgcaatgttcaaactctgtgcgaagctttgttagcagatggtttggcgaaagcattcccaagcaatatgatggttgtgacagagcgcgagcaaaaagaaagccttttgcatcaagcgtcttggcgactcggaccgatg

SEQ ID NO: 8275 - DNA, 203 bp, Homo sapiens
ggcgcgccagtcctccacagtgttatatacatgtgagtgattattataaccccccacatggagtctctctcgaaaaccgagaaaatccaccagaaggtccaagctcttaccgtggtcatctaggcgggattgagggacttcaacaaaaactctggacaagcatctcatgtgcacagatttcattagttcgactcggaccgatg

SEQ ID NO: 8276 - DNA, 203 bp, Homo sapiens
ggcgcgccagtcctgaaatcaaaaccggttttaaactgcgatctgcggtaatgggtgacaatcaatgtataactgtactctctgtatttcccctcgaaactgagtctagtgagcaagaattaagttctgaagataatgccgctagagtagctgctagcttagcaaaagtcacaagtgcctgcggcatccgactcggaccgatg

SEQ ID NO: 8277 - DNA, 203 bp, Homo sapiens
ggcgcgccagtccttttttaaaacctgatgaaacttttgttcactcaggtttcatttattttggcaaaaaacaatatttgaatggagtacaattacctcaatcactgaaaactgctactagaattgcacccttgtcagatgctatctttgatgatcttcaagggacactagctagcataggcacggctcgactcggaccgatg

SEQ ID NO: 8278 - DNA, 203 bp, Homo sapiens
ggcgcgccagtccttgtatactagaacaactaaatgtcatctggctcaaaccatatgagcattgccctaaatgtgcaaagtcagcaaaccctaaaggggaaccttttgtttctattgcaattaaaaaacatgtagtaagtgcttggcctgatcaatcacgacttagttggacaattggagatggcatccgactcggaccgatg

SEQ ID NO: 8279 - DNA, 203 bp, Homo sapiens
ggcgcgccagtccttcagcaagagatagtaatattatcttccagaatgtcattaattttgctgttgcactttttgatctacgatttaggaacgtggctacttcttctatacaacatcatcgggctcatcttcatttgtcaaagtgttgcacgcgagaggttccagcccaatatttagtttatacatcacgactcggaccgatg

SEQ ID NO: 8280 - DNA, 203 bp, Homo sapiens
ggcgcgccagtcctctagctaaaactgttatccaatctataatttctgacagcaacaattcatcaacggatccaatcagtagtggggaaacacgatcattcaccactcacttcttgacatatcctaagattggactactatatagttttggtgcactcatcagttattatctaggcaacaccattattcgactcggaccgatg

SEQ ID NO: 8281 - DNA, 203 bp, Homo sapiens
ggcgcgccagtcctagaaccaaaaaattgactcttaacaacttcatatattacctagctactcaaatacataatttacctcatcgctcgttgagaatccttaaacctactttgaaacacgctagtgttatctcgagattaataagtattgactctcacttctcaatttatattggaggaactgctggtcgactcggaccgatg

SEQ ID NO: 8282 - DNA, 203 bp, Homo sapiens
ggcgcgccagtccttataacgaaagaccctctatcagaaagtctgaggggacaacagagattgtaaggcttactcggcagctgagggcaataccagacaccacaatatattgccgcttcacgggaatagtttcttcaatgcactataagctcgatgaagtcctttgggaatttgataattttaagtctcgactcggaccgatg

SEQ ID NO: 8283 - DNA, 203 bp, Homo sapiens
ggcgcgccagtcctggacaaataaaagtcactttaaacaattctgcaagccagattaccgatattactaatccaagttggttggcagaccaaaaatctaggatccctaagcaagtagagattataaccatggatgctgaaacaacagaaaacattaatcggtcaaaattgtacgaagcagtccaacagcgactcggaccgatg

SEQ ID NO: 8284 - DNA, 203 bp, Homo sapiens
ggcgcgccagtcctataaaaggtcgtattacaaaattggtaaatgattaccttaagttctttctaataatacaagccttaaagcacaattgcacatggcaagaggaactaagagctcttccagatctaattagtgtctgcactcgattctatcatactcgaaactgttcatgtgaaaaccggttcctacgactcggaccgatg

SEQ ID NO: 8285 - DNA, 203 bp, Homo sapiens
ggcgcgccagtcctgtacagactttatacttatcacgcatgcaggattcggaaatcaaactaatagatagattgaccggccttcttagtctatgtccaaatggtttttttcggtaaggactcttgacgtacaaactccacatagttatacaatggtaccaggacactatatgtaaattgaccctaagacgactcggaccgatg

SEQ ID NO: 8286 - DNA, 203 bp, Homo sapiens
ggcgcgccagtcctaccaagagcaggcccaaagggccattaggccacatctgctgagcctgcagaacacgcaggacttacttagcagaagagagcgcgtgccgaaaccagccaacaaattgacacagctgctcactctgaccctgaattcataaacaatattaagttgacaacagagatactaatccacgactcggaccgatg

SEQ ID NO: 8287 - DNA, 203 bp, Homo sapiens
ggcgcgccagtcctcgaggaggaaacaacagaagcaaatgctggacaatttctttcatttgctagtctgtttctcccaaaattggttgtcggagaaaaggcctgtctggagaaggttcaacgacaaatccaagtgcacgcagaacaaggtctgattcaatacccgacatcttggcaatcggtgggacacgactcggaccgatg

SEQ ID NO: 8288 - DNA, 203 bp, Homo sapiens
ggcgcgccagtcctcctccaaaaaacagagcacggagttcgcctgcatcccttggcgcgaacagccaaagtcaaaaatgaggtgagctcttttaaggccgctttagcctcactagcacaacatggagaatatgccccgtttgctcgtctgctgaatctatctggggttaataatcttgagcatgggctcgactcggaccgatg

SEQ ID NO: 8289 - DNA, 203 bp, Homo sapiens
ggcgcgccagtcctaccttttgatgccatcctttactaccatatgatgaaagaagagcccatcattttcagcactagtgatgggaaggagtatacatatccagactctcttgaagatgagtatccaccctggctcagcgagaaggaagccatgaacgaagacaatagattcataaccatggatggtcacgactcggaccgatg

SEQ ID NO: 8290 - DNA, 203 bp, Homo sapiens
ggcgcgccagtcctcggttagtactagtatcaacagtactgccagtggtccgaactttccagcaccggatgtaatgatgagtgatacaccctccaactcactccgaccaattgctgatgataacatcgatcatccaagtcatacaccaaccagtgtttcatcagcctttatactcgaggcaatggtgacgactcggaccgatg

SEQ ID NO: 8291 - DNA, 203 bp, Homo sapiens
ggcgcgccagtcctttggtcctgggatccccgatcacccgttgcggcttctaagaataggaaatcaagccttcttgcaagagtttgtgctgcctccagttcaattgccgcagtatttcacttttgacctgacggctctaaagctgatcactcaacctctcccggcagcaacctggacggatgatactccgactcggaccgatg

SEQ ID NO: 8292 - DNA, 203 bp, Homo sapiens
ggcgcgccagtcctcgaccggtcctacaggaatacttcgtcctggaatttcctttcatcccaaactgagacctatcctattgccagggaagaccgggaaaagaggatccagctccgatcttacttctcctgataaaatacaagcaataatgaactttctccaagacctcaaactcgtgccgattgatccgactcggaccgatg

SEQ ID NO: 8293 - DNA, 203 bp, Homo sapiens
ggcgcgccagtccttccaaccagcaacaccatccatacacaggtatcaattgggctgccgcagcatatagacccaatagcaagctgctgtccagaaaatagttccggaaagtaactcaaccatcgcaagcccaatgcagctttcagaaatccgccagcaacccaactccactgtacccccaatattaacgactcggaccgatg

SEQ ID NO: 8294 - DNA, 203 bp, Homo sapiens
ggcgcgccagtcctaggtttctggaacagggccgtgccctgaaggttacgctttccacaaagaaggcgctttcttcctgtatgatcgactggcatcaacaatcatctatcgaagcaccacgttttcagaaggtgttgtggctttcttgatcctccccgaaactaaaaaggactttttccaatcgccaccgactcggaccgatg

SEQ ID NO: 8295 - DNA, 203 bp, Homo sapiens
ggcgcgccagtcctccaggatccaggcagcaaccagaagacgaaggtcactcccaccagcttcgccaacaaccaaacctccaagaaccacgaagacttggttccagaggatcccgcttcagtggttcaagtgcgagacctccagagggaaaacacagtgccgaccccacccccagacacagtccccaccgactcggaccgatg

SEQ ID NO: 8296 - DNA, 203 bp, Homo sapiens
ggcgcgccagtcctgataatgcacaatcaaaatgggctaatttgcgggttgaggcagctagcaaatgagacgactcaagccctacagttattcttgcgtgctaccacggaattgcgcactttctctatattgaatcgaaaagccatcgactttttactccaaagatggggaggaacgtgccacatcttcgactcggaccgatg

SEQ ID NO: 8297 - DNA, 203 bp, Homo sapiens
ggcgcgccagtcctagcttagtctattgtgtgagagtcatctacgacgagaagggctaggacaggatcaatcagaatctgttcttgaagtgtatcagcgcttacatagcgacaaaggcggaaattttgaggcagccctatggcaacaatgggaccgacagtccttgatcatgtttataacagcatttccgactcggaccgatg

SEQ ID NO: 8298 - DNA, 203 bp, Homo sapiens
ggcgcgccagtcctgctacatagcgagaaggctattcagaaagtaaagaaacatgcaaccgtaataaaagcattgcgtcccgtaatcatctttgagacatattgtgtgttcaagtacagcattgccaaacattattttgatagccaagggtcatggtatagtgtaatctcagataaacatctaacacccgactcggaccgatg

SEQ ID NO: 8299 - DNA, 203 bp, Homo sapiens
ggcgcgccagtccttgcagttttcgagcctaatgttcttggatatagtcctccaaacaagttctcaactaagagggttcctgaacagtttcttgaacaagaaaatttctcgattgatagtgttctcacttatgcccagcgcctggattatctacttccacaataccggaatttttctttctcacttaacgactcggaccgatg

SEQ ID NO: 8300 - DNA, 203 bp, Homo sapiens
ggcgcgccagtcctctgtagtgcaattgactttgtactcaacccaagcggattgaatgtccctgggtcacaagacctaacatcttttttacgtcagatagtgcgtagaacaatcacattgagtgcaaaaaataagctaataaacacattgtttcactcctcagccgatttagaagatgagatggtatgcgactcggaccgatg

SEQ ID NO: 8301 - DNA, 203 bp, Homo sapiens
ggcgcgccagtcctcctgagtgtgcaggagatccttcaaatgacgccttctcattattcagggaacatcgtacatcggtataatgaccaatacagccctcattctttcatggcaaatagaatgagtaattccgcgacgagattggtggtgtcgacaaatactctcggggagttctcaggtggggggcacgactcggaccgatg

SEQ ID NO: 8302 - DNA, 203 bp, Homo sapiens
ggcgcgccagtccttaggaccaaaaagctagacctcagtcattttatgtattacttaacaactcaaatccataatttgccacatcgctcgttgaggatacttaagcccacctttaaacatgttagtgtgatatcaagactaatgagtattgatcctcatttttcaatctacatcgggggtacggcaggcgactcggaccgatg

SEQ ID NO: 8303 - DNA, 203 bp, Homo sapiens
ggcgcgccagtccttgatcgagggctttcggatgctaccagactattccttcgagtggccatttcttccttccttcaatttatcaaaaaatggatcgtggaatacaagacagctattcctctgtgggttatataccctttggagggacaaaatccagatccaattaatagctttctacatctgattatcgactcggaccgatg

SEQ ID NO: 8304 - DNA, 203 bp, Homo sapiens
ggcgcgccagtcctagccttactgcaaaatgaatcccctcaaaacaacatccaattccaagaagacagaaataatcaacagttgtccgataatctagtttacatgtgcaagagcactgccagtaatttcttccatgcatcacttgcctattggaggagccggcacaaaggacggcccaaaaatcgatccgactcggaccgatg

SEQ ID NO: 8305 - DNA, 203 bp, Homo sapiens
ggcgcgccagtcctaattcaaactctttacttaacccgtatgcaagactcagaagcaaaattaatggagagattaaccgggtttctaggattgtatcctaatggtattaacgcttaagatccccttagaggcatcgcaatatgactccaaacattaaatgatattgctgtcaatacatctacctgacccgactcggaccgatg

SEQ ID NO: 8306 - DNA, 203 bp, Homo sapiens
ggcgcgccagtcctgagagcaaggtttattataaaaaacctatacacatgactgcaatgcgtaatttataccgaaacacagtgagggctgcacatgcaggttcctgttgagctttaaaagatcatgcaatataaaatgatatttgtatactaatcatgttagtactaactaacagtactcactgcatacgactcggaccgatg

SEQ ID NO: 8307 - DNA, 203 bp, Homo sapiens
ggcgcgccagtcctcgtcatagaggacgatgccaagttccttctggagaacggctctctcccgtttggctccacccttgccatggcgcaccgctcccgcccctttcctgctgaccccaaaaccgaaacccaaatcctaaaccatctccactttgctatcaccactctccaccgtgaccccaactacaccgactcggaccgatg

SEQ ID NO: 8308 - DNA, 203 bp, Homo sapiens
ggcgcgccagtcctccccccctgcacaacccgcctccccgtccgcattcacaaagctgcctgggccttccacgcgttcggctaccgctgcacgctggttggttttgaaccctccactccgtggactctcaaagaagtgaaacaggttctacctgagacacttttccaggaagaatgccatgctttccccgactcggaccgatg

SEQ ID NO: 8309 - DNA, 203 bp, Homo sapiens
ggcgcgccagtcctcctcccaagccccaccatccaaggcttcacctacctcactcccgaccctatcttcgctgatgtcctacgccgcgtccgaagtggggacttcacagtcttccaatcggacaacgctaaggtttccggcgtcgatgatgactacaccctcatctactcctttggcccccacaccgccgactcggaccgatg

SEQ ID NO: 8310 - DNA, 203 bp, Homo sapiens
ggcgcgccagtcctatccactaacactggatcgccagccccccagaatcccaatgggccttccaactcctcccgccccaacaaaccccgtatgtccacccttggtcgtgtcaacgatcagctcgcccaagagcgcatccgcactcttcgggccggctccattggcatggacatcccctcccaagcccccgactcggaccgatg

SEQ ID NO: 8311 - DNA, 203 bp, Homo sapiens
ggcgcgccagtcctcccctgcaccaaacatgctaactttggctctggaacccacctcaacttcccttactccatcctcaattcccaacctggcactgctatctccaacgctttcagcacccattcctattggcgcggagacgccctcattcaggttaccgtcaacagttcaccacaagccagtggtgtcgactcggaccgatg

SEQ ID NO: 8312 - DNA, 203 bp, Homo sapiens
ggcgcgccagtcctgctgcttgttgctgcaatacctgaaggcgtcgatgtgttgacccctcaatccgcaacccactaccccttcaccctgctgaacctcgctaccaccaattgctgtgcccttctccttcccttcctgtcccctaatcccgtggacccctgcggcctccactttcagtggaacgtcgtcgactcggaccgatg

SEQ ID NO: 8313 - DNA, 203 bp, Homo sapiens
ggcgcgccagtcctagccctccccatcaccccccttcgcgtccctgccggaaccccctctttcctggacgtctcgtgcatgatggctcctcaggactctgagttctttgcgatgaagacccctgcccaacaaggtgtcaaagtccgcgaaacctcagctactgggaacgcctatgtcacgagctgctccgactcggaccgatg

SEQ ID NO: 8314 - DNA, 203 bp, Homo sapiens
ggcgcgccagtcctccccatctctctcaccaccccgatctctgggaccctaacccccctaggccaaacccttacccacttctcccaatggcgaggaaccctggatattgatctggtcttctccggatcacagcagaacactggccgcatcctggtgtccaccacacctccagtggctggatgccccgccgactcggaccgatg

SEQ ID NO: 8315 - DNA, 203 bp, Homo sapiens
ggcgcgccagtcctgaccatggaagctgctatgcgcaacacctgctacatctgggacctcaccacctccgcctccatctccatcaccatcccctacttttcctccaccccatggaaaaccctctcccgctccacttccctatccctctcggtcaaccagctggctggttggctggggctctatgtctacgactcggaccgatg

SEQ ID NO: 8316 - DNA, 203 bp, Homo sapiens
ggcgcgccagtcctctcccccctttcctgccctgctttcaaccctgatcaggcaaccattgccgtgttcatccgcggtggtgccgatttcgaggccagaattccgtctggtctcgcgaccgccaccatccagggtgatgaggaggtccccgcctcctcaaacgacggtctgaacaccttggagctcagcgactcggaccgatg

SEQ ID NO: 8317 - DNA, 203 bp, Homo sapiens
ggcgcgccagtcctcctctccggcttcccctccgctggctggagggaaatgacggaggatcgtgctcacgtcaccctctccgttcccttctctgctgaaaatcccgtgattgcctcccgctatctaggtttcccctcttacgaatcatcccaatcccttgccacttccctctactcctttggcaccctcgactcggaccgatg

SEQ ID NO: 8318 - DNA, 203 bp, Homo sapiens
ggcgcgccagtcctgatcctgcgcacttcacctgaaccgtgcttcgttatccgcaaccagcggctaacgtatgtacactgggccctccgctccggaaacaagcaggtctcaatccagagatctggcttgggcgggcttacgcccgtcatcggctatgaggacctagaaggtgaggtctacgcagaggtcgactcggaccgatg

SEQ ID NO: 8319 - DNA, 203 bp, Homo sapiens
ggcgcgccagtcctcccccctcacatcttcgccctggctgaagcgcaagttggaagcgagtacccctactccgcaaccaacaactgcaccacctgggtggagaccctgaccaacctctccctccccaacaccggcaattcgcttgccctcggattgggcgccatcggcgtgggagccgctgctgccttcgactcggaccgatg

SEQ ID NO: 8320 - DNA, 203 bp, Homo sapiens
ggcgcgccagtcctgttcggtagccccacccctctctccgttgccggtctccttgtcgtgatcgcctccgactttgctcctgccgtagtccagtatttcaagaacgtcgggaatccactcgccgctctctactactggattgcacgcaagctaggtctggaaagcgtgaccgccaaggacgccgtcgacgactcggaccgatg

SEQ ID NO: 8321 - DNA, 203 bp, Homo sapiens
ggcgcgccagtccttgttcgcgctaagagtgaaccctccgcccaactggcccagagtcacgacaccatcatggctctgttccaggactccatctccgccacctcggccccctccctggaccttcctgctgcccgttccaacctcgccaaagcccaatccctgcttcccctggccaccgcagcaaaatccgactcggaccgatg

SEQ ID NO: 8322 - DNA, 203 bp, Homo sapiens
ggcgcgccagtcctggtgaagaattccgggggcattagcaatgccctggccgcgctgatcccgggcgtcaagccgcttgcacgccagcaagctggtgacgaagtccccatcagcaaggcccccacctgcttcaccaacccttcttacattcccggatctactgaagatctgagttgggacccgaccgacgactcggaccgatg

SEQ ID NO: 8323 - DNA, 203 bp, Homo sapiens
ggcgcgccagtcctgatcgctgccgtctatgctccaaagatgccccaggtgcgtgacatccgtcgctttatccgggctccaaggatgcatcatgtcggtaccgtgattgccaactccacctctggccctgtgttcatgttggccaacaacgtgaagcacggtgacacaccctaccctgaccttaccggcgactcggaccgatg

SEQ ID NO: 8324 - DNA, 203 bp, Homo sapiens
ggcgcgccagtcctcgcattctcgaagcagaacaggggtgacctcgacaagccctggcccaccctccccgttgctgttgatctttacttttcccagtgtgatttccccaagctacgcatgctgtcgatggacgaggctatcaacggaactccactccttgacggtctcgatatgaagcagtctgctggcgactcggaccgatg

SEQ ID NO: 8325 - DNA, 203 bp, Homo sapiens
ggcgcgccagtcctggctggcaaaactcgtctgatcgaggctgcgcccatccatgcgatcatcgctggacgcatgctgctcggaggtctcttcgaacacatgcacgcgcgccctggccagtacgggtctgctgtcggctgtgatcccgactaccattggactccgttcttccactcctttgaccggttcgactcggaccgatg

SEQ ID NO: 8326 - DNA, 203 bp, Homo sapiens
ggcgcgccagtccttgcagaagtttgggctctggactactcctgtttcgactctactctcccctcctgcgctttcgacctaatcgctgctaaactctctcaaatcatcactcctctccccggcattgccgaggatgccatcgtgaagtacatccggtccattagcgtgtccaagcacgtttttggcgacgactcggaccgatg

SEQ ID NO: 8327 - DNA, 203 bp, Homo sapiens
ggcgcgccagtccttcgggcgtatctgatgaccggtggcaacccctctggctgtgttggaacctcaatcctcaactccatgattaataactctgtcctgatctctgctttcctcacccacccccagttcaaccctgcggagatgcgcatcctcacctacggtgacgacgtgctctacgccaccacccccgactcggaccgatg

SEQ ID NO: 8328 - DNA, 203 bp, Homo sapiens
ggcgcgccagtcctcaccatccacccttccttcgtcaaatccttcttcgatcagaacaccaccctaatcgtgacccctgccactaaggccggtgacttcccggatcactccacgatctgggacgttaccttcctgaagcgctggttcgtccccgacgaagagcgcccgtggtacatccaccccgtgatcgactcggaccgatg

SEQ ID NO: 8329 - DNA, 203 bp, Homo sapiens
ggcgcgccagtcctctactcctatctccaccaccgctggctccagctggtggtctcttaagtctgtgccttccaagcgtgttggaagtaaagccacgccggctcgcccccgtcatagggcaacccccgagtaccggtggtctcgggtctgctgctaaacccagtgggctcgttgccgtcccccattgccgactcggaccgatg

SEQ ID NO: 8330 - DNA, 203 bp, Homo sapiens
ggcgcgccagtcctgtaccgcaaggatagcaaggtatgaacacttgtggacgaaatggtaagtgatcaattcactttcatggccggaaggtcacgtggcaatcatgccacccaggtaccctcctctgggaggatctgagggtgggctaagcagaccctgccatgtggctgaacttttcccttattgttcgactcggaccgatg

SEQ ID NO: 8331 - DNA, 203 bp, Homo sapiens
ggcgcgccagtcctacagtgccagtgaattcaaccttttctggagaggttgtggctcgaagttctcggggttctaatcccccccctcccgctccgaaccacaaagagaagaaacccaaagagggtcgtagcaaggcctgggatttcgtgaagaagcttctcccggatccttcaaatgaggtctcgcttcgactcggaccgatg

SEQ ID NO: 8332 - DNA, 203 bp, Homo sapiens
ggcgcgccagtcctgttccccgcctcctggcgcagtccgatgaccagatcacaaatctggaaaccggaattgcgacagaatttctcccagcccaaattcccatgggcaaccttgatcaatctgaactatctgatttgtttgctatctacaggcctttctggaccggtgaggatttctctcaatctgtccgactcggaccgatg

SEQ ID NO: 8333 - DNA, 203 bp, Homo sapiens
ggcgcgccagtcctgctgttgcttacattccccccggtggccctatgggtcccgacctgaaacaggcactaaatttccccctggttcagattgatatttccagctatactatcaaagaaattcccataaacattcctcaatcctgtgtgactgaagcaatcccgaccagctattctggttttgctgatcgactcggaccgatg

SEQ ID NO: 8334 - DNA, 203 bp, Homo sapiens
ggcgcgccagtcctcttacccgtggaacctggggtcgcttatctggctccgggtggggtaccctggtggtagctgctttaccccgtggcggtaaatccctgaggatggcctggtggatggacgcgcgtattactcaagcccgcgtttacatgccccgagttattggtcgcgtaggcggcctgcagagtcgactcggaccgatg

SEQ ID NO: 8335 - DNA, 203 bp, Homo sapiens
ggcgcgccagtcctctattgaatattgatggttgctcccctcaaacacagttaggagtccttgattttccaccaaccgggcagtgtgttggtcagggtatcattgagaacacgagaattgcagctgagtcggtcagttatgcttcaatgaaccttgagagagcgttgacccaggaacggttagataagcgactcggaccgatg

SEQ ID NO: 8336 - DNA, 203 bp, Homo sapiens
ggcgcgccagtcctattttggtgcttttggtgtcaaattttaatttgtctactttgactggagttttccttatcctgagtgcagattttattactaaagtcacctttgaagccttcaaggacaatcccttccagttcattggcaaatggatcagtgagaagctggacctgggagttgacgtggatattcgactcggaccgatg

SEQ ID NO: 8337 - DNA, 203 bp, Homo sapiens
ggcgcgccagtcctgaaccaattctctacgtcaaggaagaagaagaccctgaggaaggtcctagtgggcaggcttttaagccgaaagatttcaatgattgggccaactttttcaaaaatattgattgggctgtgactcgattggtagttttaattgagaagttgatcaaacaaattcaggccgcaaagcgactcggaccgatg

SEQ ID NO: 8338 - DNA, 203 bp, Homo sapiens
ggcgcgccagtcctactctcctgaaacaagctctcagcaattacacccaggcacaaaattctttgcagcgcactatttttgctgtacgcccagagcctgttgtggtttacatctacggcggtcctgggtctggtaaatctgtcctggctggcctcttagcgcgtgccatttctaaggctctttctggccgactcggaccgatg

SEQ ID NO: 8339 - DNA, 203 bp, Homo sapiens
ggcgcgccagtcctgaggagaagggaatgtattataccagcaaagtgataattgtaactgctaattttaatcttccaaattatgcttctgctcgtgagcccaaagccctggagcgtcggctgcatttcaagatgtttatgggtggttcccttaatgtagactttgcttgtgcacctgatggcattccacgactcggaccgatg

SEQ ID NO: 8340 - DNA, 203 bp, Homo sapiens
ggcgcgccagtcctttggaacccgctgttttgcgccggagtgatgggcgtttgttagatggtgttgtgttagatgaggcaatattttctaagcatgataagggtgacatgactgaaccctggaagaatttaccccaagctttttctgtgtattttaatcagttccagaataaggagattaggactttacgactcggaccgatg

SEQ ID NO: 8341 - DNA, 203 bp, Homo sapiens
ggcgcgccagtcctgaaaatccccaggaatttatttacaccacattcttgaaggatgagctgaggaaagttgagaaagttgagaatggactgacccgggttattgaggctgcccccctgccagtaattctggctggacgcatgcttctcggaggtctgttcgaggagatgcagtcccaacctggtaagcgactcggaccgatg

SEQ ID NO: 8342 - DNA, 203 bp, Homo sapiens
ggcgcgccagtcctattagcaagtatatatccagcattgcatcttcccgccatgtgtatggaaacaagatttatctgatgcttggtggcatgccttctggctgtgtaggcacttcaatcctgaacacaatttgtaataactgctttgtgctttctgcccttttagagcataaggattttgacataaatcgactcggaccgatg

SEQ ID NO: 8343 - DNA, 203 bp, Homo sapiens
ggcgcgccagtcctgaaagggggcccggcggggcaacacccgtcggtccctctttccgtccaagccgcggacgttaaactgtggcacggttgtgcctaggtgcaaccctgctactaatggcggtacccctgcccttagtatgcatgtttgtatgaatggaatctgtagtgatgccctgctttggggtccgactcggaccgatg

SEQ ID NO: 8344 - DNA, 203 bp, Homo sapiens
ggcgcgccagtccttaactcacttgagactaaccagggtgcaaatgggcttactgcgacagttccggtcaactcaaccttttcgggtgaggttactgctagggctcctcgcaatcctccagccctgccccaaccgccgccggcccataaggagaagaaaccgaagactactgatgggaaaaagccttgcgactcggaccgatg

SEQ ID NO: 8345 - DNA, 203 bp, Homo sapiens
ggcgcgccagtcctattagccttcacaaaggcttttcaaaccaacgcctactacagatgtggctgggaagtgttaatggaagtcaatggcacattctttcatcagggggctatagctgtggttgcaattccagaggttcagacaactgctgcgttcactggtagtctaggccgcactcttgcgtaccccgactcggaccgatg

SEQ ID NO: 8346 - DNA, 203 bp, Homo sapiens
ggcgcgccagtcctgcatgctattctcaacatcagaacttctaaccaagccagactgctcttgccatatgcttctgccaatcgcttcgacccgaccactggtgctgttttcaagagtgattcagggcttcctgggcttggcaccctttcttaccaccaacaatgggtgctagtcgtgtgggttatttccgactcggaccgatg

SEQ ID NO: 8347 - DNA, 203 bp, Homo sapiens
ggcgcgccagtcctaccactgcaagtgctgtcaaatgaatccaatcttactgtgaatttgctggtccgtcctctccaagctgaattcatgggtcctcactatgcttatggacaaccctttgttgtcagggaggttgtgggttcttctggatttgctaatacccaacccatgcaggagtttaatgcaatcgactcggaccgatg

SEQ ID NO: 8348 - DNA, 203 bp, Homo sapiens
ggcgcgccagtccttaccatttgggacatcggtctaaattcaactctgtcctttgtgattcctttttgcagctcaacttcttggaaatccattggtgcttcttcaggccttgaattctcacaggcgcttggcatgctgtatatagctgtctataaccctctggtaacgccatatggggcacccaatgccgactcggaccgatg

SEQ ID NO: 8349 - DNA, 203 bp, Homo sapiens
ggcgcgccagtcctctctcttgtaggggtgacccttgttacaacaagagctgagttcctggatatgttattagatagtgaaggctactccgcccaaacacagataggagtccttgattacccccccagtgcccagtgcacgggacaggggatcattgagaataccagaattgcagctgagtctgttagcgactcggaccgatg

SEQ ID NO: 8350 - DNA, 203 bp, Homo sapiens
ggcgcgccagtcctttatgcctccatgaacctggagagagtgctgactcaagagaagctggaccgcatctctgagatttctaaatctttcatgctggccagcgagaatgtccaccaggcagttgagggaatcaacaccgccctcaatgcaattactcccatcttatccacctccccgcttattgaagtcgactcggaccgatg

SEQ ID NO: 8351 - DNA, 203 bp, Homo sapiens
ggcgcgccagtccttggtttgctggctcgtgcaatttcaaaggcactgactgggaaggtcgatgacatctatgcaccctcatcatttggaactgagcatttcgatggttaccaccaacagacggtccatatgattgatgatcttggtcaagctgtggatgggtcagactgggcaaatttctgcaatatcgactcggaccgatg

SEQ ID NO: 8352 - DNA, 203 bp, Homo sapiens
ggcgcgccagtcctattaaatgtggattttgcttgtgctcctgatggcacacctatgagacatttcaaatctggatgccctcttctgaggaactcggcaggattgctgaaagattctgggtccattctgccctgcaagttcaaggatgctgatgatttggttgacttggtggtggctgaggtgcgaagcgactcggaccgatg

SEQ ID NO: 8353 - DNA, 203 bp, Homo sapiens
ggcgcgccagtccttacttcttttaaaattgggaatgttatgtatgttaaggatgatgtgaagatgacccgcattggcgaagctgttctcttctacctgcctaatgtgccacaagggaaaaacctcctcaggtttgtcaaggctcgctcaattaagggagtcaaggctggcttcctggctggcaacatcgactcggaccgatg

SEQ ID NO: 8354 - DNA, 203 bp, Homo sapiens
ggcgcgccagtcctggatggcgtaccaaacatggtgcgagtgtgggagttaaccacgttccgtggaattgaaacccaggatggaatcttcaatgagcattgcttgggctatcgctgtgcttcttatgcaggcctgtgtggggctcctttggtcctggaggatcctgctgactatagaattgctggaatcgactcggaccgatg

SEQ ID NO: 8355 - DNA, 203 bp, Homo sapiens
ggcgcgccagtccttaaggaaattaggaccctctctcttcatgaggcaattaatgggactcccctgctggatggtattgacatgaatcagtctccaggctatccatatataacacaggggcggtcaaggcggtccctgtttacctggaatgaagaagggttttgggagcccactgatgaactgaaggtcgactcggaccgatg

SEQ ID NO: 8356 - DNA, 203 bp, Homo sapiens
ggcgcgccagtccttcctgattttgatttggactcttactatgtgatagcatatggtgatgatgtagtttatgcaactaatcctccaattagtccaagctttgtgaagaaattttatgatgagcatacccccctaaaagttactcctgctgataaaggctcaaccttcaatgaaaactctacaatattcgactcggaccgatg

SEQ ID NO: 8357 - DNA, 203 bp, Homo sapiens
ggcgcgccagtcctcttctttgaggatatgatggagcgcgctccaacattagatggagttcgcaaatctgctgcttctgtatatgattctgttggaactggtatgtgtattgctttatctggtattttgtcatttgttgctatagtatgtttaggtattacagatttgtcaactgcttctttcaataacgactcggaccgatg

SEQ ID NO: 8358 - DNA, 203 bp, Homo sapiens
ggcgcgccagtccttgatgtcaaaggcaagagtgacacatatattgcaccttcatttgtcattgctacttctaatgttgaccctttcacttttgagcctaagtctattcattctgttgatgcctttgtgcgtagattaaatatagtagtggaagtagatatagatgataattttgctaagtatgttcacgactcggaccgatg

SEQ ID NO: 8359 - DNA, 203 bp, Homo sapiens
ggcgcgccagtcctccgggtattctctacaacctggcttggtccttatgataaccctattgctgcttgtgcttatttaaatgctacattgcctgcccgcttttgtacttataatgctcaatttgctgattgttatgtgtctgatgctattattgatgattgcctacaccgttattattctgaagaggacgactcggaccgatg

SEQ ID NO: 8360 - DNA, 203 bp, Homo sapiens
ggcgcgccagtcctgaaatatgtggtgcaagatgaaggcaatgatgttgtgactatgttagaatcccatcaggattatgccattaagaagcctttagtggaatctcatcaagatgctaaattaattaaacctatcgtagagtcacaccaggaggttaaattaattaagccacttgtcgagtcccaccacgactcggaccgatg

SEQ ID NO: 8361 - DNA, 203 bp, Homo sapiens
ggcgcgccagtcctgtcaggttatagtatagattggacagatatcattgctgagtcatcaaatgatcataatgcccaggatattagtaagtcaattttgtctaaaaatttagttaggattatgaagcctgattcttcttactacacacatggattgtttgttaaaggacgaatgttgttgatgcctaacgactcggaccgatg

SEQ ID NO: 8362 - DNA, 203 bp, Homo sapiens
ggcgcgccagtcctgaaggaacacgtcgagctcattatcagcaaagctcgtaagggcattgttgatactgagctcggggtgttcacggcgaccctgaaggatgagcggagacctttggctaaagtggaggcgaacaaaacgcgagtgttcgctgctaccaatcaggctttagcattagctcagcgtagcgactcggaccgatg

SEQ ID NO: 8363 - DNA, 203 bp, Homo sapiens
ggcgcgccagtcctgtattttcttagttatcttgaacatgtaatgcttaatcgcgtagacaatgagataggtttgggtgtgaatgtgtattcgtatgattggtctagaatagtcaataaattgcatcatgtaggttctaaggttattgctggggatttttccaattttgatggttcactcaactcccacgactcggaccgatg

SEQ ID NO: 8364 - DNA, 203 bp, Homo sapiens
ggcgcgccagtcctaaattgcatgtataatatgttaatatttagatatgtttatcttcttgctcacgaggaaaatggctttcccttgtctcttgctaattttagtgggaatctcgctgctgtcttctatggcgatgattctctttgttgtgtctccgataaagtgtgtgagtggtttaatcagcactccgactcggaccgatg

SEQ ID NO: 8365 - DNA, 203 bp, Homo sapiens
ggcgcgccagtcctgataacacggcttatggctgtcaccggccatgtatatactgatgaaaccaagagtggttcaccaccaccgtatcgcgatatttctgaggtgacattccttaagagagaattcgtgaaacgcgactcattatggatcgctccactatctaaaaacacaatagaagatatgtgtatcgactcggaccgatg

SEQ ID NO: 8366 - DNA, 203 bp, Homo sapiens
ggcgcgccagtccttggattccttcttgctcaacaggaacgcggaggagctcatgattccgagcttctaagcttacttctttcagagtagttagggaccgttgacgacagctccacgtatatgctcattacgcccactgcggaaacaatgtgatgctgtggtgtatacgtggtcaagctagcggcgtgcgactcggaccgatg

SEQ ID NO: 8367 - DNA, 203 bp, Homo sapiens
ggcgcgccagtcctaacacgcgtcaggagatctccccagccaccatgggctaggttggcagccaggttttaacttggtggggagtaaaatagcctgctccaattcaaaattctgatacttctataatggattcttccgttactaacactggtggtttgatgccctcggctactatttccaattcagagcgactcggaccgatg

SEQ ID NO: 8368 - DNA, 203 bp, Homo sapiens
ggcgcgccagtcctacccttacagaacaacaacttatcacaaattatgaacagccatcaattagacaaatttctttacctgatgacatagttaaaggttcctcttttattgcctccaaattagctaatattgcttatatgcgttgcgattatgagttgtatcttcgggtccagggttctccatttcttcgactcggaccgatg

SEQ ID NO: 8369 - DNA, 203 bp, Homo sapiens
ggcgcgccagtcctcagggtcttctcttgctttggaataagatgaatgcggatcaaacttctaagattcgttcctcaattactgaacaccttcgctctattacttcttttcctggtgtcacacttaatatgcaatccgactcaagatctgttaagctagtaattccttatactagtgaatttcaagttcgactcggaccgatg

SEQ ID NO: 8370 - DNA, 203 bp, Homo sapiens
ggcgcgccagtccttctaaggatcgtgatctttctaaagtttctccctatgagaatattcctgctaagggtttcacacatggtgttggttttgattatggtgtatccactttcgcttttcctgataacgctattgatcctactattgctaatcctgagtccattgatgagatgtctattcaatatttgcgactcggaccgatg

SEQ ID NO: 8371 - DNA, 203 bp, Homo sapiens
ggcgcgccagtcctgcttctcggccgtatatgttggataggtataccatcaaaggtggaaatactccctcgccgtcaggtactgttgttgctgatatccctattagtcctgtcaattactctctctatggtagtattatccgtgattatagaaccatttttggtgctcctgtcagtctagctgttgcgcgactcggaccgatg

SEQ ID NO: 8372 - DNA, 203 bp, Homo sapiens
ggcgcgccagtcctatggcttcatggtggcgagctaaaattcaccttaatcttcagttcgcaaagacacaataccaccagtgtcgtttacttgttcagtatcttccctatggttctgatgttcaatctcttgaaaatgttctttcccaaattattgatatatcccatgttgatgagagtggtattgatcgactcggaccgatg

SEQ ID NO: 8373 - DNA, 203 bp, Homo sapiens
ggcgcgccagtcctttatgctttccttctattttcacaaataaatggatgcgttcttatgatcctgccactgaaggctacactgctgggtgcgcgcctggaagaattcttatttctgtgcttaatcctctaatttctgctagtactgttaatgatgacattgttatgatgccatggcttacttgggaacgactcggaccgatg

SEQ ID NO: 8374 - DNA, 203 bp, Homo sapiens
ggcgcgccagtccttcttttcagatttccgctttgcgtcatggtgataaggtcacgataacagaggatcctactaagataaatgttagtggtgttagttttctcactggcaccaattcttggaaagctagtttgaaggatagttctggaactttgttaggacgcttagagtatgatggtacttcttttcgactcggaccgatg

SEQ ID NO: 8375 - DNA, 203 bp, Homo sapiens
ggcgcgccagtccttctagtgattcacctgctagcttaattcctggtaagtataatgtggagcttgatcctgctgataattctgccgtagtcaccattgttgctaacaattcatttggaactgcttctcttgatacacatggtggtgggatggattatgctaaatcagattcttcttctttagttacacgactcggaccgatg

SEQ ID NO: 8376 - DNA, 203 bp, Homo sapiens
ggcgcgccagtcctgcttaaatctcttaccttaagagtccactctctgagtggttaacccgtcgcgagacgcgtgggttgagttgtcatgacatttgtcagttgtgacgagtgtaactcaacagtttttcctaaccacgcgtcgcgtggcaggttttttaatctgagagttacattcctacccactaacgactcggaccgatg

SEQ ID NO: 8377 - DNA, 203 bp, Homo sapiens
ggcgcgccagtcctctaaggttcctgacaatagctttatccggctatctagttacctaggtttacttttattagttgaccttaggagtgtaaccagtgtacacttgcttaccttaattggttggctaactagtcgctatgcattttcgtgcatatcggcggattcctaaaaaaaaaaaaaaaaaaaaacgactcggaccgatg

SEQ ID NO: 8378 - DNA, 203 bp, Homo sapiens
ggcgcgccagtcctgcctgatagggtgccggcgggcgcggtacgtgtggtatagtccgctgtcttggggtatggcgtctactcggttttgttgtcgttttggaatgtcccatgtcggagatgtcgttaccggtgtttgctttacttgtgcacgaataagaaaacagagtttggagttttggaagttaacgactcggaccgatg

SEQ ID NO: 8379 - DNA, 203 bp, Homo sapiens
ggcgcgccagtcctcatgagcaggctgcgttcttagagacacagtatcatcagttgacactatatccgcaccaaataattaacttgaggacaaccaatgcagccacgattgtggtcccgtataccaacatagcaccggcctcgttttacacgtgtcacaacacgtggaggttgatcataattcctcttcgactcggaccgatg

SEQ ID NO: 8380 - DNA, 203 bp, Homo sapiens
ggcgcgccagtcctcctgcatttcccatctggacaccatcagaggggttcccactaccaggtaggatgacaaatttgattagtgtggcccgtataccaacatttttgcagggtacaggaggaaacacttatggtttttcggtgcagaacgcaatacctgctgacaacaccacattgtatagtttggatcgactcggaccgatg

SEQ ID NO: 8381 - DNA, 203 bp, Homo sapiens
ggcgcgccagtcctgaagaggccatgctaggtacaaacatcatctgggattttgggttgcaatcaacgtgtacgtttgtgatcccgtatatttccatatcatctcgccggtttgcgaacacaacaggcaccattttctcatatgatggttatgtgaccgtttggtaccaaactgcggttgtatttgcgcgactcggaccgatg

SEQ ID NO: 8382 - DNA, 203 bp, Homo sapiens
ggcgcgccagtcctgttgctcgccttgagctcaacgaaatgatctaccagcagcgtattgctgccatcctggaaagagcagtggatgatagtgatgatgaaggttctgagagtgatgctagtgacagtggatactattcgctggatagtatggggctgagtgatttaaccagtgattcagagtttgggcgactcggaccgatg

SEQ ID NO: 8383 - DNA, 203 bp, Homo sapiens
ggcgcgccagtcctaagcaagtgttaggtattgtcacaaaattagttgccgtagtcacagccatcacacgatctggtggcgaccctgtcatcctggcctcgatgggtgctatgttatcagtagacctcatgaatgcgtgtccttttgaatgggcaaaacaacaagtggcccaactgatggaggtggagcgactcggaccgatg

SEQ ID NO: 8384 - DNA, 203 bp, Homo sapiens
ggcgcgccagtcctaaacacctgtcaaactccaagaagagaccgcatgaaccaattggactgcttattcatggggctccaggcacagggaagagtcttgcgaccaaactaattgggacaaagttagcaaagaatttaggaaacatggaaccttattttatgccacctgacccgaagtattttgatggccgactcggaccgatg

SEQ ID NO: 8385 - DNA, 203 bp, Homo sapiens
ggcgcgccagtccttatgctggacagcctgtggtggttatggacgatctaggacaaaacccggatggtgaggacatgaaactactctgtcagatgatatcgtgtgcagagttctacaccccccaagctgatctgcctgacaaagggaaaccttttacatcgtcctttgttcttgcttcaaccaacaaccgactcggaccgatg

SEQ ID NO: 8386 - DNA, 203 bp, Homo sapiens
ggcgcgccagtcctatgcttgtcaccttacttaccacactttattttatctggaaatcattacctgcaaacccacagggtgcatatgatggcattatccaaaagaacctgagagtcccagaaaaacggaagattgaagtgcaaggccctgaccctgacacccaatatgccctgtcgctgatgaaacaccgactcggaccgatg

SEQ ID NO: 8387 - DNA, 203 bp, Homo sapiens
ggcgcgccagtcctggacaggaaccagaggaacttgagatcgtgatagaacagtacgctgcccaactccagcccctgttgcccaaggatgtgcatgaacccatgactttgcaacaggtagtggagggatatgggcgtttagatggattagacctgaatacatctcctggttatccgtactgtacgcagcgactcggaccgatg

SEQ ID NO: 8388 - DNA, 203 bp, Homo sapiens
ggcgcgccagtcctccaatgtggtttaaggccctggacaagctactgcaacgcttaggttttgacacggaagatctgatcataggcttgtgtaattcaacacacatttatgagaaccaactctatagaaccgttggtggcatgccatcaggttgttcagggacatcaatcttcaatactctcatcaaccgactcggaccgatg

SEQ ID NO: 8389 - DNA, 203 bp, Homo sapiens
ggcgcgccagtcctttgtgccatctcatctggcacaacggtgaagagtcttataacaagtttattgccctggttcgtagcgagccagtggggagagcactacaactcccgccatataaacttttggagagagagtggttagataacttttattgacccggggccacgccgagtaggatcgagggtacacgactcggaccgatg

SEQ ID NO: 8390 - DNA, 203 bp, Homo sapiens
ggcgcgccagtcctcaagcgtgacattggacagatgctcgacggactgaataagcggaaggcgaaacgtcggggggggagttgctcttggatcattatgttactcccgatagttgctgggctgaagcttggaaactataatggtagagttttggccactttaaataagactgatgtatcagacttgctcgactcggaccgatg

SEQ ID NO: 8391 - DNA, 203 bp, Homo sapiens
ggcgcgccagtcctcaccccttcacggcatggacggaggtctaggagatcggtgaacgtgcatcaccatggagagagtctacttgaggccaagaacacgccgtggatggattcgaccaaagccactaaatatctcacgaaggttgagaactgggcgttgagaaatcctgggtatgctcttgctgccatcgactcggaccgatg

SEQ ID NO: 8392 - DNA, 203 bp, Homo sapiens
ggcgcgccagtccttttcataggctggaatctgggaacgacgagaagccaaaagataattttcacaattatgttaatgttaattgccccagcgtacagcttcagctgtctggggatgcagaaccgagactttgttgagggagtgaatggtgttgagtggatcgatgtcgttctggaaggaggcccatgcgactcggaccgatg

SEQ ID NO: 8393 - DNA, 203 bp, Homo sapiens
ggcgcgccagtccttgtgaccattacggcaaaagacaggccgaccatagacgtcaagatgatgaacatggaggctacggaattagcggttgtgagatcttactgctatgagccgagagtgtcggacgtgacgacagaatccagatgcccaaccatgggagaggctcataatcccaaggcaacttatgccgactcggaccgatg

SEQ ID NO: 8394 - DNA, 203 bp, Homo sapiens
ggcgcgccagtccttaccatgaacacaaaaagctggcttgttaacagagactggtttcatgatctcaacttaccatggacagggtcatcagcggggacgtggcaaaacaaagagtcattgatagaatttgaggaggcccacgccaccaaacaatcagtggtggctttggcatcacaagaaggagccctcgactcggaccgatg

SEQ ID NO: 8395 - DNA, 203 bp, Homo sapiens
ggcgcgccagtccttggcactgtcgtggtggaattgtcttatgcaggtaccgatgggccctgtagagttcccatatccatgtcggcagatctgaatgacatgacaccagttggacgcttgataacagtcaacccatacgtgtcgacctcctccacgggtgccaagataatggtggaagtggaacctcccgactcggaccgatg

SEQ ID NO: 8396 - DNA, 203 bp, Homo sapiens
ggcgcgccagtcctttccattgggaaaggcattcatcaggttttcggctcagcatttaaaagcttatttggaggaatgtcatggactactcaaggcatgttgggggcactgctattgtggatggggctgaatgcaagggacagatccatttctatgacttttctagctgtaggaggaattttagtcttcgactcggaccgatg

SEQ ID NO: 8397 - DNA, 203 bp, Homo sapiens
ggcgcgccagtcctcctggcagtaaatgtcaatgccgacacggggtgctcaatcgacttggctaggaaagaattgaaatgtggacaaggcatgtttgtcttcaacgatgttgaggcttggaaggataattataagtactatccatccacaccaaggagacttgccaaagtcgtggcagaagctcatgacgactcggaccgatg

SEQ ID NO: 8398 - DNA, 203 bp, Homo sapiens
ggcgcgccagtcctggctggaatttgtggcatacgatcagtcagcaggctcgagcacaacatgtgggtaagcatcaaacatgagttgaacgcgatcttggaagacaacgccattgacttgactgtggtggttgaagaaaatcctggaagatacgggaaaactaatcagaggctgccgaacgttgatggcgactcggaccgatg

SEQ ID NO: 8399 - DNA, 203 bp, Homo sapiens
ggcgcgccagtcctatggatggaaatgcgaacagaaaatacaactgattgtgacaccgcagtaatgggcacagcaattaaaggaaatagagctgtgcacagtgacctgagctattggatagagagcaagaataatggaagctggaaactggagagagctgtgctgggcgaggtgaagtcatgcacatgcgactcggaccgatg

SEQ ID NO: 8400 - DNA, 203 bp, Homo sapiens
ggcgcgccagtcctaggaatcacgtacagtgatctggtcaagtacgtcattctagtggcagctgcatttgctgagagcaatacaggtggtgacattgtgcacttggccatggtggccgcttttaacatccagccaggtttactgattggattcctactgaggaggaagtggagcaatcaggaaagcagcgactcggaccgatg

SEQ ID NO: 8401 - DNA, 203 bp, Homo sapiens
ggcgcgccagtcctaatagtggggatagatgtggtgagaataggtgtgctaaccctgggaatcctctcactattgaaagagaggagcaatgcaatggcaaaaaagaagggtggcatgctcctgggagtggcatgcgctaccgctggaatcgctagccctttggtgtttgctggtctgcacatggtgctcgactcggaccgatg

SEQ ID NO: 8402 - DNA, 203 bp, Homo sapiens
ggcgcgccagtcctatggctagagaaagcgagcgacatctcgtggagtgaggaggcgagggtgactggagcatcacagagatttgatgtggaaattgatcaggacggtaatatgagattactgaacgatcctggtgtgtcgctcggtgtttgggcctttcgaactgggcttattctgttatcttcatacgactcggaccgatg

SEQ ID NO: 8403 - DNA, 203 bp, Homo sapiens
ggcgcgccagtcctagtgggagtcatgcatgagggagtgtttcacaccatgtggcacgtgacgaatggggccgttattcaagcaggagaaggaacactggtcccatattgggcgagtgtacgcaatgatctaatttcctatggtggaccatggaaattggggaagcaatggaatggcgtagatgaagtcgactcggaccgatg

SEQ ID NO: 8404 - DNA, 203 bp, Homo sapiens
ggcgcgccagtcctgctgctcacacctcagcgagtgccgaattacaacttgttcattatggatgaggctcacttcacagaccccgccagtattgctgccagaggatatatatcaacaaaggtggaactgggagaggcagctgcaatattcatgacagccacacctccaggtacaactgaggcatttcccgactcggaccgatg

SEQ ID NO: 8405 - DNA, 203 bp, Homo sapiens
ggcgcgccagtcctgctaaataggaagagttttgactcagagtatcctaaatgcaagagtggagaatgggattttgtgataaccactgacatctcagaaatgggagcgaactttggagcgcaacgggtcatagatagtcggaagtgcattaaaccagtgattattgaggatggagaaggaagcgtgcacgactcggaccgatg

SEQ ID NO: 8406 - DNA, 203 bp, Homo sapiens
ggcgcgccagtcctaatgaatggaccagttcctataacatcagccagtgcagcccagcgtcgtggacgggttggaagggatgtaacacaaattggagatgaataccactactcaggaccaaccagcgaggatgatcatgatttcgctcattggaaagaggccaagatactgctggacaacattaacatcgactcggaccgatg

SEQ ID NO: 8407 - DNA, 203 bp, Homo sapiens
ggcgcgccagtccttcatcaagaaacctggagcatgccttggccggatttgagaccagcgacggcatgggcggcctacgcaggagctacaacatttctgactcccttgctaaaacacctcataataacagagtatgtgaacttttcactcatggcaatgacagcgcaggctggagcactatttggactcgactcggaccgatg

SEQ ID NO: 8408 - DNA, 203 bp, Homo sapiens
ggcgcgccagtccttccgtcttggcattatgaccaagacaatccttacaagacttggaactatcatggaagctacgaagtgaaagccacaggctcagccagctcaatggttaatggggtagttaggatactgtcaaaaccttgggacaccttgcaaaacgtggtaaatatggccatgacggacaccaccgactcggaccgatg

SEQ ID NO: 8409 - DNA, 203 bp, Homo sapiens
ggcgcgccagtcctggaatggaagccctcaaccggttggagaaactggcaagaagtacccttttgctcacaccatttccacgagctgcaaatgaaagatggcagaaagattgtggttccatgtcgagaccaggatgaactaattggaagagccaggctctctccagggtctggctggtcactaacagacgactcggaccgatg

SEQ ID NO: 8410 - DNA, 203 bp, Homo sapiens
ggcgcgccagtcctaacagcacgcctgagcaaagcatacgctcagatgtggttattgatgtacttccacaggagggacctcagactaatggcaaacgccatctgctcatctgtccctgtctcatgggtccccacaggaaggacaacgtggtcaatccatggaaaaggtgagtggatgacttctgaagacgactcggaccgatg

SEQ ID NO: 8411 - DNA, 203 bp, Homo sapiens
ggcgcgccagtcctcatttgtttgaagagataggaagaggaagtcaggccagggaatccctgccaccggatgttggatgacggtgctgtctgcgttccaaccccaggaggactgggttaacaaatctgggtgcatggaggagctaagcgttcaataccgtctcggagaactccctggctcacgaagtgcgactcggaccgatg

SEQ ID NO: 8412 - DNA, 203 bp, Homo sapiens
ggcgcgccagtcctaaagaaagcaaggcccaacctagagtcaagctgtaactctaggggaaggactagaggttagaggagaccccttgcgagtgaacaccacaagaaacagcatattgacacctgggatagactaggagaccctctgtcctaacaacaccagccacttggcacagatcgccgaaagtgcgactcggaccgatg

SEQ ID NO: 8413 - DNA, 203 bp, Homo sapiens
ggcgcgccagtcctcctttttgaggtgttcctctctaaggaaggccgccgtcggctcaatgtctttatttacacacacaacaaagctgcctggattgtgcgttccaaggttctggtgtcttcaagcaacaacatacaaaagatatctaaccgaggaattgcggcgtccaaaagcgacgtaggtgatcgcgactcggaccgatg

SEQ ID NO: 8414 - DNA, 203 bp, Homo sapiens
ggcgcgccagtcctccatgaactgtccagtggcggtggcaacataactatgatcaactactatggtgcccaatactcccaggctcatgccaacccttctgttcaaatggacccagagaagttcacaaagcccctcactgatcttgctttagcggggactggtcctgcattgaaatcccccaatgtggacgactcggaccgatg

SEQ ID NO: 8415 - DNA, 203 bp, Homo sapiens
ggcgcgccagtcctggaggctggttactcagataggatcatgcaaataaccgcaggcaactccactcttacaacacaggaagcagctcaggcgattgtgggttatggtgtttggccagattatgatgttggtgttgggcatgccattgacaaggaaacaaagcctggacctgctgttgagcggttttacgactcggaccgatg

SEQ ID NO: 8416 - DNA, 203 bp, Homo sapiens
ggcgcgccagtcctcaccctcgatagcatttactggaaccaggattggaagggtcgcgtgattcgcttgcctggcgccctcactgaccttggtatgttcggtcagaactgccaattccacttcctcatgagatcaggattctgcgtccatgtgcaggtcaacgcctcaaaatttcaccaaggaatgttcgactcggaccgatg

SEQ ID NO: 8417 - DNA, 203 bp, Homo sapiens
ggcgcgccagtcctttgtactcccgctgaaaatgccctgacacacaacttcgtgtctctatacattgttccaattgtcccactgaagttcgagaagggcgcatccacgaccatccctgtgactgtctccatctcgcccatgttcgcagaattctcagggctccgtaacagggtcgttgctcagggtgtcgactcggaccgatg

SEQ ID NO: 8418 - DNA, 203 bp, Homo sapiens
ggcgcgccagtcctccctactttccagatacctggatctggacagttcgtaaccactatcaagaacgatggtttcccagcattgccccactaccaagagaccccgctccacttcatccctggtgaggtcacgaaccttcttgaagtctgccagattgacacttttgccaaccttgggacatctgagctcgactcggaccgatg

SEQ ID NO: 8419 - DNA, 203 bp, Homo sapiens
ggcgcgccagtcctggctactggtaagattctcatcgcttacacaccaccaggcggagatgccccagcaacacgcaaggatgccatgctcgcgacccacgttgtgtgggatttggggctccagtcttcagttacattcacagtcccctacatctcccaatcacagtacagatataataacattgatggcgactcggaccgatg

SEQ ID NO: 8420 - DNA, 203 bp, Homo sapiens
ggcgcgccagtcctgaacatcttctcatatgatggtttcatcagcatgttctatcaaaccaatatagttgttccccctggtgccccatcgacctgccaaattgtcctcctagtttctgctgcaaaggacttcaccctccgcttggctactgacagtgcttacttccagggcctcggcgaagaccttggcgactcggaccgatg

SEQ ID NO: 8421 - DNA, 203 bp, Homo sapiens
ggcgcgccagtcctgaatcttgtcaatggttctgtgcaaactaccgcccagcaggtacttcgccccgctacaggtttagcttccgaagttcccaatactctttctatccacacaggcgagtcggggattctgactgcaccggaaacaggcgcctcctccaccactgaggctggggctatgattgagaccgactcggaccgatg

SEQ ID NO: 8422 - DNA, 203 bp, Homo sapiens
ggcgcgccagtcctcaggtcagtgtctactatgtactctgccgcagagacttccatcgaggcatttatgtctcggtatgcaatgttctctgccttcgaccttcgcactggttcaactgctgcgaacggcgaatacagaatcctggacctccgcttctcggaggaatcatctacacacaaggcccttgtcgactcggaccgatg

SEQ ID NO: 8423 - DNA, 203 bp, Homo sapiens
ggcgcgccagtccttgcaaagtatcgcatgttcacctaccttcgtatggggtatgatgtggtcgctattgtctccccaaaggcaaacatcagggaccgcgtccatatgtcatcaccgcccaaatttcagatgatgttcattccccctggttgcccagcaccccgtcttgtagatggtccggagtggtacgactcggaccgatg

SEQ ID NO: 8424 - DNA, 203 bp, Homo sapiens
ggcgcgccagtcctcctccccaccacccccagtgtctatttctctgtggaccaacccccggcatccctacggctaccatacatgggcgttatgtccacctttgcctcccgttatgatggcttctattcattccagacaaccaatcctcatagctacggttacttcccaggcaatgacattggcaagctcgactcggaccgatg

SEQ ID NO: 8425 - DNA, 203 bp, Homo sapiens
ggcgcgccagtcctcatcttcccggtctcccgaactgatttcatcgccccattccaccttttcaacaacagacttgtttttgcaccatatggtgatgatgacttcctccagatcccatacacggcagtgaggtgtgaccttgaacatgatttggtcctggggcgcatggggaagccaattttcacccgcgactcggaccgatg

SEQ ID NO: 8426 - DNA, 203 bp, Homo sapiens
ggcgcgccagtccttttgtgtggctcccctctcctgacgcgtgatggcattgtggctatggccacagcaggcagtgactcagttagttatttcacaaacctccaccttgtggagtggctcaatgtggagcccttagccgaagaacagggcatttcagattggttcagtgactttgcctcacaactgggcgactcggaccgatg

SEQ ID NO: 8427 - DNA, 203 bp, Homo sapiens
ggcgcgccagtcctatgtggaaagatgcgccaactcaaactgggcgctgatatctacggggtgcagcgaaaccaggccacacatcagattgtcaagtattaccaaaaggctatgtctatacttcaggcaatgacccaagggcgctccgaaccggtggcgcttttggtacacggcaccccaggaacaggcgactcggaccgatg

SEQ ID NO: 8428 - DNA, 203 bp, Homo sapiens
ggcgcgccagtcctgaagagcttagccacagaaattattggcagggccctcacgcagaagttgggtggcaacaggccatactctctcccacctgacccaaaacactttgatggttacgcccagcaacctgtcgtcatcatggatgatgttggtcaaaaccctgacggcgaggatctcaaactcttctgcgactcggaccgatg

SEQ ID NO: 8429 - DNA, 203 bp, Homo sapiens
ggcgcgccagtcctggttgataccgactataaaaggaatgacaagcttactgcaaacactgcacttgacaggtgcaaccatcctgcaaccaactttaagcactgctgtcctcttatctgtggtaaggccatccgtctcaaggacatgaggacaatgaagatgttcacactcgatgaggtggtgtcaatcgactcggaccgatg

SEQ ID NO: 8430 - DNA, 203 bp, Homo sapiens
ggcgcgccagtcctgctctacgcggagcatctaaaccgccaggggtgcggttctaagctcgaggcaatcttccaaggccccggcactaatgacatcatttcgtgtgaatggaatgctgaagcaaagaggaggggcgtcgctctcgtcacagaggatgagtggtttgagactgactacgacaaagaagacgactcggaccgatg

SEQ ID NO: 8431 - DNA, 203 bp, Homo sapiens
ggcgcgccagtcctttcaacaatggactggatcaagaaactttcctacggtctctccatcttgtcatccctcaccgctgtctgtggcttcatttacatgctttacaagatttttgcctcggttcagggcccctacacaggaactgcccaaaagacactcaagaagcctgaactcaagcgcaaagctgtcgactcggaccgatg

SEQ ID NO: 8432 - DNA, 203 bp, Homo sapiens
ggcgcgccagtccttgaagtggacctcgatgaggcgatgtttgccaagcacaagggtaacacagacattcccattgatgaagagcttgggattgccatagaccactacacagagcagattagaccccttatgcccattaaccttacagaacctttgacaatggaggaggtcgtctatgggacagataacgactcggaccgatg

SEQ ID NO: 8433 - DNA, 203 bp, Homo sapiens
ggcgcgccagtcctccttgaggggcttgacctctcaacctccgctggatttccatatgtcattaagaacaccaggaagagggaccttattcctgagcgtggccaacccttaacaaaattgcttgatgcccttgacctctatggctacgacctcccgtatgtcacataccttaaggatgagctcagacccgactcggaccgatg

SEQ ID NO: 8434 - DNA, 203 bp, Homo sapiens
ggcgcgccagtcctaattgacaaagtcaggaaggggaagacccgcctgatagagtgcagttccatgaatgacacaatcaggatgaagaccacttttggtcgcttgtttcagactttccatgcaaatccaggtaccgtcaccggatcagctgttggttgcaacccggatcttgactggagcaaattctacgactcggaccgatg

SEQ ID NO: 8435 - DNA, 203 bp, Homo sapiens
ggcgcgccagtcctcgtgtatgaggttgagggaggtatgccttcaggatgttctgggacatccatcttcaattcaatcataaataacctcataattaggacacttgtgttgaagtcttataaatcaattgacttggatcgcctgcgcatcattgcgtacggtgatgacgtgattatatcttaccctcacgactcggaccgatg

SEQ ID NO: 8436 - DNA, 203 bp, Homo sapiens
ggcgcgccagtcctccagctggatgctgctgcactcgcggagtgcggcaaggattacaatttgacaatgacacctgcagacaagtcagacacattcaatgaggtaacatgggacaacgtcacctttcttaagcgacgatttgttccagacaagcacttcccattcttggtccaccccgtcttcccaatcgactcggaccgatg

SEQ ID NO: 8437 - DNA, 203 bp, Homo sapiens
ggcgcgccagtcctcaagcaccgtctgggaagatgttccgctgtggctgccaaacctggtaacaggtgccccagtgtgtgtagtcttcctccagtctccggactggcagtcttgtgtaaagatgcagtgtaaggttcaagtgccaaatccctggaaggagtgaccctctactgccctaggaatgctgtcgactcggaccgatg

SEQ ID NO: 8438 - DNA, 203 bp, Homo sapiens
ggcgcgccagtcctgcaggtacccccaacttcggttggggatctgagcacaggctaattgtctacgggtagtttcatttcccatcctctcttttttggcatcatggcgaacacacgggtttcacgatctgtgctctccgctgttgccaaaacttctacccacagagtctatcacacagttcttgactgcgactcggaccgatg

SEQ ID NO: 8439 - DNA, 203 bp, Homo sapiens
ggcgcgccagtcctctatgacaggctctacctcaattcctacccccaaatgctctaccccctaccccgctcaccctctttcccttgccccttctgcatgtatgatgaagacctggaatttctctcacccgagtcgctctgcggcgagggcgctgagccatgttggaagtgcatgtcaaagtccccccgcgactcggaccgatg

SEQ ID NO: 8440 - DNA, 203 bp, Homo sapiens
ggcgcgccagtcctcggagcgctccaacaacttctcaaatttccccacctctcccccgcacagatgcccctcgccgtgaaacaactcaaacggcaggggaattctgtcaccaacatctacggcaatggtaacaacgtcactactgacgttggtgccaatggctggtcccccaccgtgtccactggactcgactcggaccgatg

SEQ ID NO: 8441 - DNA, 203 bp, Homo sapiens
ggcgcgccagtcctcggtgatgcccctgtctctgcatcagcagacaccatccccggtcgctccgggggtgcgtcttctgacaaaactggatctgtttcagtctcctcaggcaacaaggtgggctcccgcttctccaagtggtgggagccggctgccgcgcgcgctcttgagcgtgcgaccgatgccaccgactcggaccgatg

SEQ ID NO: 8442 - DNA, 203 bp, Homo sapiens
ggcgcgccagtcctctccctggaatccccttccttccccatctccacagaatccaattggggcactcaatctggccaagccccgactgcctatccccttcccttttctttcgtgcgtgcgtacccggacaccccctgggctgccatgtacgacacccactccatgtggaattgtggttggcgtgtgcacgactcggaccgatg

SEQ ID NO: 8443 - DNA, 203 bp, Homo sapiens
ggcgcgccagtcctggtcaccgtcaacggttcgcagttccacgctggagccctcatcctttacatggtcccggaagcgactactcaaaccatcgagtcatctcgtcgcaatgccgggttcgtgtacccctatgtcatcctcaacctctatgagagcaacactgctaccattgaggtcccctacatttccgactcggaccgatg

SEQ ID NO: 8444 - DNA, 203 bp, Homo sapiens
ggcgcgccagtcctggcagatgaaccaggcgaacgcctggcgatccttcctgtctccccttctgccattgctggcacaggtactcccatatcctatgtcctctctctcttctcccaatggcgcggtgagctcgccgcccaccttctcttcacaggttcttcccagcactatggccgcttggtcgtgtgcgactcggaccgatg

SEQ ID NO: 8445 - DNA, 203 bp, Homo sapiens
ggcgcgccagtcctccaagttccccttgaccccatccactggcaaagtgacgccgatgtctccggcctcactgctatgctttcctgtttcacctatatctctgctgatctccgcatcaccttgcggatttctaaccccaatgggctaccaatctccctcatggtggcctttgccccccctggatcaaccgactcggaccgatg

SEQ ID NO: 8446 - DNA, 203 bp, Homo sapiens
ggcgcgccagtcctgaagactgttgccatcgtgcggcaaggcgctcgccacacccttggtgacgtcccaccagacgacacagtctacatcatccgtgcgcgtagaccaacttacgtgcactgggccctccggaaagtcactcctgatggaagtgccaaacaaatttccctttcccgtgaaggcctcaccgactcggaccgatg

SEQ ID NO: 8447 - DNA, 203 bp, Homo sapiens
ggcgcgccagtcctcgccgtggtcgcatacgaaccatgtgaaggtgagatctatcgggaagtcccactctcctcctggtccattgccgaacttcaactcggcagcccgtgggattacagtgccaccaacaactgtacgcacttcgtccaacgggccaccaatgtggatctccccaacaccggcttctccgactcggaccgatg

SEQ ID NO: 8448 - DNA, 203 bp, Homo sapiens
ggcgcgccagtccttctcacctggctcgccaaaatcttcggctatctccttgtcctctttggttccccctccccaatgtccatctctggacttctagtcatcatctgtgctgatcttgccccccatgcccgggatttcttcactgcctcgggcaatgtcctctcctccctccacttctggatcgcgaccgactcggaccgatg

SEQ ID NO: 8449 - DNA, 203 bp, Homo sapiens
ggcgcgccagtcctgttcctgaaccaatccctcagaaattacaccttggccctttctcaacaccgcaagcgccaggtcggcccccgaccggaacccgtggtggtctacctctacggaccccccgggaccgggaagtccctcttggccgccctccttgcccaaacccttgcccaacgcatatccggtgacgactcggaccgatg

SEQ ID NO: 8450 - DNA, 203 bp, Homo sapiens
ggcgcgccagtcctagaaaaaggtacacattacacttctcgtgtcattgtgattacctccaacttccatgagcccaatgagcgcgcagcgcgctcgatgggagccctcaagaggcgcgtccaccttcggatcaacgtcacctccaatggcgtgaggtttgacccggtgaacgcgctcaacccaatccccgactcggaccgatg

SEQ ID NO: 8451 - DNA, 203 bp, Homo sapiens
ggcgcgccagtccttggaacccaatccaaatacttcacctctcaaacccctctcacccttttccaagccaacgtggtccgcttggaccgcgattcaatctggacaccctccttctccaacatggacgagctcgtggacgctatcatggcgcgcatggaccgttcatccggtgtttcaaattctcttgccgactcggaccgatg

SEQ ID NO: 8452 - DNA, 203 bp, Homo sapiens
ggcgcgccagtcctctccctcatcaagcgtcagggcaaccgcgtggtcgaagcaactccccgggaaatccccgaggagtatgctgacgagctcgtggaagccttggcacaccacagggctgtaccctgttccctctccctctcccacgccatctccaacaacaccccccttgaaaccatctcccagaccgactcggaccgatg

SEQ ID NO: 8453 - DNA, 203 bp, Homo sapiens
ggcgcgccagtcctcctctggcgctacaggaaacccatcttcgccgccaccaccttcctggcggtggtcggattcctttgctccatcatccccctcgctagatcaatctggcagggccgcgaagactcttcctcgcagccccaagcggcgtactcaggtgtgccgcaccaaaagtcaaaacccaaaaccgactcggaccgatg

SEQ ID NO: 8454 - DNA, 203 bp, Homo sapiens
ggcgcgccagtccttcccaaacccatccccacccaacatatccagcgccaggggatctctcccgcaatccctggcatttcccagaatgtcgttcacgtcgagtccggaaacggcctcgagaagaatgtcatgtctggcttctacctcttctcccgctacctacttgtccccacccacctacgtgagcccgactcggaccgatg

SEQ ID NO: 8455 - DNA, 203 bp, Homo sapiens
ggcgcgccagtcctccaccacaagaccctcctcgtgggcgttgacgcctacgattgggccaccctccctaccctcgagcttggtgagctcaccctagtccataccccaacctctcgccagtacaaggacatgcgccgcttcatcggcgcacacccctatcccactggccttcttgtctcccaacttaacgactcggaccgatg

SEQ ID NO: 8456 - DNA, 203 bp, Homo sapiens
ggcgcgccagtcctatcagccccgctctatgtccgcttctccggcaaccgcgtgcttgacatgaacttccccggtgccatcgtctgtgagcaggcgtacggctaccacgcagctacctttgaaggtctgtgtggtgccccgcttgtcacggacgatcctgccggggtcaagatccttggattgcacgtcgactcggaccgatg

SEQ ID NO: 8457 - DNA, 203 bp, Homo sapiens
ggcgcgccagtcctggccggagtggctggtacgagtggtttctcagcccccctccataccattctccctgaaatcctcagatttgccactacccaccaatccctcatcatccccactggagaggcgaagcccggagtcaacatcaaccggaactcgcgcctccgtccctctcccgcctatggtgccttcgactcggaccgatg

SEQ ID NO: 8458 - DNA, 203 bp, Homo sapiens
ggcgcgccagtcctcgttctcacccaggaacaggcgatccatggaacccccaacatggaagggcttgatatggggcaggctgcgggtttcccatggaatacccaaggccggtcccgtcgatcgctctttgatgaacctgaacctgggtactttgtccccaaacctgaactccaggtagagattgaccgcgactcggaccgatg

SEQ ID NO: 8459 - DNA, 203 bp, Homo sapiens
ggcgcgccagtcctttcccacggtagtgcggttggttgcaaccctgacgtccactggaccgagttcttctacaagttctctgagttctcacaagtgtttgatctggactacaagtgctttgatgcaactctgccttctgctgccttctcccttgtggctaaacacctggagcgcctcaccggtgaccccgactcggaccgatg

SEQ ID NO: 8460 - DNA, 203 bp, Homo sapiens
ggcgcgccagtcctccgtgttgtgaaatacatcgaatccatccgccattcccatcacatctatggcaaccagatgtatgacatgatcgggggaaacccctccggatgtgtggccacttccatcctcaacaccatcatcaacaacatctgcgtgctatcggccctaatccagcacgtggacttttcccccgactcggaccgatg

SEQ ID NO: 8461 - DNA, 203 bp, Homo sapiens
ggcgcgccagtccttaccaaatttcagatcctcgcgtacggtgacgacgtcatctacgcgacggaacccccaatccacccctcctttatcagagacttctaccagcgtcacaccccgctggtggtcacccctgctaacaagggctctgatttcccccccacgtccacgatctatgaagtcaccttcctcgactcggaccgatg

SEQ ID NO: 8462 - DNA, 203 bp, Homo sapiens
ggcgcgccagtcctcaaacgctggtttgttccagatgacaggcgcccattctacattcaccctgtgatggaccctgacacctacgagcaatcagtgatgtggttgcgtgatggagactttcaagacgtggtcacctcactctgtcatttggccttccacagcggacccaagacatatgagcgttggtgcgactcggaccgatg

SEQ ID NO: 8463 - DNA, 203 bp, Homo sapiens
ggcgcgccagtcctcatgaaagtgcgcgagcagtgcctcaagtctgggttcgctccaaatttcctcccctactcttacctccaactccgctggcttaatatgctggcagcctgatagttagggaacccaaccacggtggaatacccgtggtgctagttagttagaaccctttactctcctccatggtgcgactcggaccgatg

SEQ ID NO: 8464 - DNA, 203 bp, Homo sapiens
ggcgcgccagtcctatataaagaccacccacaatctttcgggtgagcccctaagccatggttgtactgtgctatcttctaagacgtcctccctctggacgcactttccccccggtgccgcgcctcccctgggagctgcacccggggaccggggtagtctttgaacttttctaactgttcttaaaaaaacgactcggaccgatg

SEQ ID NO: 8465 - DNA, 203 bp, Homo sapiens
ggcgcgccagtcctgaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagccccgactcggaccgatg

SEQ ID NO: 8466 - DNA, 203 bp, Homo sapiens
ggcgcgccagtcctttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctacgactcggaccgatg

SEQ ID NO: 8467 - DNA, 203 bp, Homo sapiens
ggcgcgccagtccttgactcataataattggacaatatatattacacctgttgtgccattggattatgtcaccggctcctccaccaatgttcctgttacaatttccattgcaccaatggcagcctctttttctggtttgcgcaatgctgttcaacctagttttagtgttcatacgcagggtgttcctgcgactcggaccgatg

SEQ ID NO: 8468 - DNA, 203 bp, Homo sapiens
ggcgcgccagtcctctgtttcctttacattggatgtttctaataatagtgtgtcaaatgctgccatagcccattgggatatggacatgggaagcgtgctgttttcaaccacctacatggcaaggtgtgccaaatggtactcccagcatcgtggagggatacgtgtgaccttcatgttctgtggctcagcgactcggaccgatg

SEQ ID NO: 8469 - DNA, 203 bp, Homo sapiens
ggcgcgccagtcctccatggcaactggcaagttgcttcttgcattcacaccacccggcggttcggcgccagccacccgcagggacgcaatgcttggcacacatgagatctgggatttgggcttgcaatcctccatcacactcgttgttccgtggatctcccagacggcttatcgctttaaccaaccttcgactcggaccgatg

SEQ ID NO: 8470 - DNA, 203 bp, Homo sapiens
ggcgcgccagtcctttggcgatgaacttggcaaagtcatcactgaagcagcccaacatgccctgcagcccctagatgttaaacctgtcaacggacccagcgtcccagctggcctgtccattcaggttggtgatgcatctgcactaacagcccccgagactggggcaacggctgcaacagaagcaccctcgactcggaccgatg

SEQ ID NO: 8471 - DNA, 203 bp, Homo sapiens
ggcgcgccagtcctctactccttgtgtgtatcaaaagtcaagtgctgatgcccccatttctttgcgacttccctttatgggcccagcctctgcttattgtgtgacctatgatggatatcccaattatcgtattggacaaaaatatggtgagtttcctggaaatgattttggtacaatttgttttagatcgactcggaccgatg

SEQ ID NO: 8472 - DNA, 203 bp, Homo sapiens
ggcgcgccagtcctttatcaatttgacgggcggtaaccaagtgcaggatattaaacatcgcattttgatgcttgcccgacccacccaggtctccgccttttgcccgcgaccaattgtttcacttgcgcaacatcgacctgctgctgttaccaatgggagaattgcatatgttagggatggacctgatgcgactcggaccgatg

SEQ ID NO: 8473 - DNA, 203 bp, Homo sapiens
ggcgcgccagtcctatgttgttccagaaggtgatggaaccgatagggttcttagagcagcaaattgtgggccccgtctgaaggtcggaaagagaatgaatccagagtgctgccctccccatttgtacagattttttgaggattgttatcagtgctgggatgttgataatgaagtttctttccattgctcgactcggaccgatg

SEQ ID NO: 8474 - DNA, 203 bp, Homo sapiens
ggcgcgccagtcctttcctctttcccctcgtgagtgcttgattcctgctcatctttatgttgctgatcttgtgttttccaagcatattgctgggcccagggcagagataccctatcgaaagaagtgggctgattataccatggatttggtttgcttggaacttgctgaagattattttcaaaccattgcgactcggaccgatg

SEQ ID NO: 8475 - DNA, 203 bp, Homo sapiens
ggcgcgccagtcctaaggtctccgtgatatgatgaatgatgttgcccgtgagctgggtcacagctttggtgattccaccatgactggtgtggcaaatgtgattgaagatgctgtcaagcagtatacctttaataaagccaatgcacaaatgtcttatgttaaacagattattaagtggcttgtgaaggcgactcggaccgatg

SEQ ID NO: 8476 - DNA, 203 bp, Homo sapiens
ggcgcgccagtccttccagtcattgacaaaaggtcggactgagcccgttgccatgcttgtccatggcacacctggctccggcaaatcccttgccacagaaattgttggccgcctgctttcccaaaggtatggcggctcccgaccctattcattgccaccagaccccaaacattttgatggatatgccccgactcggaccgatg

SEQ ID NO: 8477 - DNA, 203 bp, Homo sapiens
ggcgcgccagtcctttagacctcccactgtgtcagaaccccaagcccttaagcgtagattttttgtggatgttaatattgaagttcagaaggattatatggttcaaaatggtaaacttgctgctgatgttgccttgaccccctgcaatcatcaggcagcaaattttaaggtttgctgtcctatgatttcgactcggaccgatg

SEQ ID NO: 8478 - DNA, 203 bp, Homo sapiens
ggcgcgccagtcctagagtgattatgataggatgcctcctgtgcttaagacgtatgaagaattgagaaaggaagggattgaaaggcctgcgccaaaagaagtgcttgacttggttcgtgctgtgcccaccccagaggtttttgattattgtcgggttcagggttggatgctacccgttgaggtcagaccgactcggaccgatg

SEQ ID NO: 8479 - DNA, 203 bp, Homo sapiens
ggcgcgccagtccttgcgtcgggttgtcaagacacaaggacctgacatggaatttgtcaataagctgttcaagcagagcattttctccgtgaagacggagaaagggtggttctctggcttgggcttacactctcagtggcttttgcttcccaaacattctgagcctggatatgagattgagatgaatgcgactcggaccgatg

SEQ ID NO: 8480 - DNA, 203 bp, Homo sapiens
ggcgcgccagtcctttaaagatgaattaagacccaagaagaaaattgcagctgggaagtcaaggctgattgagtgttcatcactcaatgataccatccgcatgaagcgggtctttggccacctcttccaaacctttcacgcaaatcctggtaccgtgactggctctgctgttggctgcaatcctgatgcgactcggaccgatg

SEQ ID NO: 8481 - DNA, 203 bp, Homo sapiens
ggcgcgccagtccttcgttccggatgaggagtttccttttctgattcatccctgctttccaatgaaggaaatttacgagtccattcgttggtctcgttctgctgcagcaactgaagaacacgttcagtcattgtgttatcttgcctggcacaatggccgttctgtgtatgaggattttattgagaagacgactcggaccgatg

SEQ ID NO: 8482 - DNA, 203 bp, Homo sapiens
ggcgcgccagtcctttcgcactgtgcctgttggtagagccttgaaactcccttcgtacagtgtactgcgccagcaatggcttgatcagttttaagtagttaattgctagtgtagtttttaggcttaagtttagttgttaagtttaagcagtttgttatagtaagttaagtttaggtttaagttagtgtcgactcggaccgatg

SEQ ID NO: 8483 - DNA, 203 bp, Homo sapiens
ggcgcgccagtcctgataacccctgaccgggtgtgtaggataggaaaggtgcccactgtgggcgacaggttatggtagagtggatacctagccaggggcaatgggactgctttgcatatccctaatgaagtattgagatttctctgctcattacccggtgatggttgtgtggggggggccccatacaccgactcggaccgatg

SEQ ID NO: 8484 - DNA, 203 bp, Homo sapiens
ggcgcgccagtccttagatccatactgcctgatagggtcgcggctggccgaccataacctgtatagtcagttgaattcagccaagatgtgtttctttttccacacaaagaccaacgatattagcccaatgacaagaaagacttctgttgaacgcctcatgtccccagggcctaagtgcctagacatggcgactcggaccgatg

SEQ ID NO: 8485 - DNA, 203 bp, Homo sapiens
ggcgcgccagtcctgtggtaatattacgcagataaattactatggttcagactatgcgtcggctcatggtgctgcacagacccgcctagatcccgattctctggcacgacccttggctaaccttgctgatatgactggtcccgcattaaaatctcccacagtggaggaggctggcttctctgatcgcacgactcggaccgatg

SEQ ID NO: 8486 - DNA, 203 bp, Homo sapiens
ggcgcgccagtcctcaagaaccggtcttggctacggaataaagctgcctgcagctcttacagacttaggagtttttggtcagaattgccaatttcattttctgtgtcatactggttactgcgtccacgtgcaagtgaatgcatcgaaattccatcagggtatgctgttagtctgcgccatacccgattcgactcggaccgatg

SEQ ID NO: 8487 - DNA, 203 bp, Homo sapiens
ggcgcgccagtcctgtaaagttgatgggagagataatgctactgtttataatttggaagcaaaagatcttgaagattatccaaggtttcaattgactctttatcctcaccagtttataaacctgagaacaaataattctgcaacccttatactcccatatgttgctgcatcacctgctgaatccccaccgactcggaccgatg

SEQ ID NO: 8488 - DNA, 203 bp, Homo sapiens
ggcgcgccagtccttcacccataataattggactgtttatgttacatatatagtggagctttcatatatgaatgggtcctcaacggaagttccaattacagtttcagtggcacctatgtcatgctcatttagcgggttgcggtctaaggttacacgccctgaacatcaaggggtaccagtgtttgaagcgactcggaccgatg

SEQ ID NO: 8489 - DNA, 203 bp, Homo sapiens
ggcgcgccagtcctttcccgggtctggacagtttgtaacaacaatacgtaattcggggtttcctattttaccggattatgaggagaccccaaaccatggcattccaggccgtgtgagaaaccttatggaagtgtgtggggtggacacgttttgtaactgtgcgacctccaccaccactgatgaacaaccgactcggaccgatg

SEQ ID NO: 8490 - DNA, 203 bp, Homo sapiens
ggcgcgccagtcctcaggcaagctgctgttggcctacacccctccagggggagcagctcccgccacacgcaaagaggcaatgcttgggacacatgtggtgtgggatattggattgcagtcatccattacaatggttgttccctgggtttcccaaacagtatataggtataatcatccaaaagaagaaacgactcggaccgatg

SEQ ID NO: 8491 - DNA, 203 bp, Homo sapiens
ggcgcgccagtcctatatgttcacctatattaggtgcgcctttgatttggtcatagttacatctgtaaatggttcttctggcgcaaagaatggcctacccatggttcaggccctctactgtcctcctgggtgtccaacgcccactaaccaagacactatggagtggtatcttccgaccacccctagtgcgactcggaccgatg

SEQ ID NO: 8492 - DNA, 203 bp, Homo sapiens
ggcgcgccagtccttgattcccggtcatctttatgttgctgatcttaagtttcagaggacaaatggtgcttatccccatgagattccctataggaagaagtgggctgactggacaatggacctggtttgcctgcagctggaccgcgatttctttgaaaccagagtgcatctgtgtaagaggcaatgctcgactcggaccgatg

SEQ ID NO: 8493 - DNA, 203 bp, Homo sapiens
ggcgcgccagtcctgtaagaatacatggactgtctgtgatacaactgagcataatgttgcaatccgctgtggggatgcaacttttcaaaaggatgtttgggttgatggtcctgtcacatctagtggacattggcaaagaaatttgttacgtgttgagatccccatccgtcctggccattgtggtagcccgactcggaccgatg

SEQ ID NO: 8494 - DNA, 203 bp, Homo sapiens
ggcgcgccagtcctaacctgtggcagttttgattcatggggctcctggtttaggtaagtcattagtgacagaagttgtcggacgacaattgtcacgctactatggagctggacggccctactcattgccacctgatcccaagcattttgatggttatgcccagcaacctgttgtgattatggatgatccgactcggaccgatg

SEQ ID NO: 8495 - DNA, 203 bp, Homo sapiens
ggcgcgccagtccttgggacaaaacccagatggagaagattgtaagctgctgtgtcaaatggtatcctcaacagagtttataacccctatggcttctttggatgacaagggaatgccttttacatctgattttgttcttgcgtcaactaacctgtcagcccttaaaccacccactgtgtcagagccgacgactcggaccgatg

SEQ ID NO: 8496 - DNA, 203 bp, Homo sapiens
ggcgcgccagtcctatgctattcgacggcgattcttcattgatgctgccatcgaaccctcaaaggattaccttaaaccaagtgggcatcttgatgcggatacttcgcttacccaatgtgatcatgctgctgtgaattttgcaaaatgttgtccccttatttgtgggaaagccctggttttgaaagatccgactcggaccgatg

SEQ ID NO: 8497 - DNA, 203 bp, Homo sapiens
ggcgcgccagtcctatatggagtttgtaaataagctatttaagcagagcatcttttctgttaagactaagaagggctggttttctggacttggcttgcatactcagtggcttttacttccgaaacactctgaacccgaggatgttatagaaatgaatgatgtagagtataagtgtttagatatagtgacgactcggaccgatg

SEQ ID NO: 8498 - DNA, 203 bp, Homo sapiens
ggcgcgccagtccttagccttggggaaatctaggcttatcgagtgttcctcattgaatgataccatcctgatgaaaagagtatatggccgcttgtttcaaacattccatgcaaatccaggaaccattacaggatcagccgtggggtgtaacccagatgtggattggtcaaagttttatgcggagatggcgactcggaccgatg

SEQ ID NO: 8499 - DNA, 203 bp, Homo sapiens
ggcgcgccagtccttccttgtccatccctgttttccaatgaaggaggtttttgaatccattcgctggtgcaagtcagcggccgcaactgaagaacatgttcaatcgttgtgctatttagcctggcataatggagagcatgtgtataatgattttcttgataagattcgctctgtgcctgtaggtagagcgactcggaccgatg

SEQ ID NO: 8500 - DNA, 203 bp, Homo sapiens
ggcgcgccagtcctgaaattcaaccatcaccacccaggaggcagtaaatgcagtggtcgcgtatggttgttggccatcatttgactcaggagctggggaggccatagataagttaactgatccaggtccctctgtggacaggttctacactctggactcaattgagtggagcaccaccacacaaggctcgactcggaccgatg

SEQ ID NO: 8501 - DNA, 203 bp, Homo sapiens
ggcgcgccagtcctatagctattggaccctacttctagttcccctggttcctctcgagtatagttcaggggctacaactcggattcccgtgactatatcaattgcccctatgtgctcatcattttctggcctgaggaaccggataccccttgctcaaggtattccaacattccaagtaccgggatccgcgactcggaccgatg

SEQ ID NO: 8502 - DNA, 203 bp, Homo sapiens
ggcgcgccagtcctagcaatttgtcactaccctccgcaatcctggttacccactgtacccggagtaccagaagacaccaccccatcatataccaggtagggtaacaaatttgatggaggtggcggaggtggacactttatgcaatctatcagatactgaggtgttgtacatcaatgcaacagggtctgcgactcggaccgatg

SEQ ID NO: 8503 - DNA, 203 bp, Homo sapiens
ggcgcgccagtcctcaccattgggcgagaacctgggcacctgggatctttcattacagggtaatttattatcccccacctacctcggtcgcctgtcgagattctatacccattatagaggctctatcaacttgactttcatgttctgtggctcagccatggccacgggaaagttcctcatctcctatacgactcggaccgatg

SEQ ID NO: 8504 - DNA, 203 bp, Homo sapiens
ggcgcgccagtcctccctgtggtaccagaccgccgttgtcaccccaccaaattgtcccaatcagtgtgcgcttgtttgtttcgcttctgcctgcaaggactttgagatgagattgcctgttgattcagcctatttccaaggactaggtgatgacctttcgaaggtgataacaagtgtcacgaaggacacgactcggaccgatg

SEQ ID NO: 8505 - DNA, 203 bp, Homo sapiens
ggcgcgccagtccttcacccaaccacttatggagccggtaactggtactgtggcgtcactaccacaacagctctcactgcaggtgggtgacggctcggctctcgcagcacctgagactggggtctcggcgactactgagccggagcagatgatggagacgagggtttcaacagtgctatacagcaagtcgactcggaccgatg

SEQ ID NO: 8506 - DNA, 203 bp, Homo sapiens
ggcgcgccagtcctgcctcaaggctgccccagcctcctttagaataccctttatgggcatctcgtccgcttatgcctccttctacaatggttactccactttcacaccacaagctgcaaaatatggcgaatttccagggaactacctgggtgatctgtgggtgcgccttgttgctgataattcacgtccgactcggaccgatg

SEQ ID NO: 8507 - DNA, 203 bp, Homo sapiens
ggcgcgccagtcctctggtagtgcatccacggtggtggtcaatgtccaggcattctgccggccagtcaattttgagggctacctacctcgccctatagtttcactcaagcctaatgtcagggtggggccctccagggggcgtgttgaattcgttgagacaggtgtctccatggagattggggtcggcccgactcggaccgatg

SEQ ID NO: 8508 - DNA, 203 bp, Homo sapiens
ggcgcgccagtcctcaacaaacctcatgttttctcatggcgctgtgtaccacttctccgagtacaaaccagtgtggatgtccatgacttatgacgttgcagtcttgaagctagagaaacctaccttccattgtagcccccccatctgtctacatggttgtagatcaggatggctcaagtgtgtgactacgactcggaccgatg

SEQ ID NO: 8509 - DNA, 203 bp, Homo sapiens
ggcgcgccagtcctccacagcgaccaacaggaaacagtccttctttaccaagatgtctgagataccgtattttcaggcgatggagcagggccctggtgattggctagcgggcatctttgaaaatatggggggtgcttttggtgaggggctcatacaaccaattaaggacaaactggatgacatccgggcgactcggaccgatg

SEQ ID NO: 8510 - DNA, 203 bp, Homo sapiens
ggcgcgccagtcctccaacctcacgcccaataccatacggagtgaccttaccaagaccacgatcaccacccttgtaaagattatctgcgccatggtcctcatatccaaggcctacgacaaggtggagaccgcagcccttgtgggtacaatgttaggcgttgatttcctctctaaagacccatttgagtcgactcggaccgatg

SEQ ID NO: 8511 - DNA, 203 bp, Homo sapiens
ggcgcgccagtcctgacggacccacttcatcaagggcctggagaagctacccatgcttatggagacctttgataagatttccacctcccgtggacagtacagtccggaaaccgtcaagcgtgtttgcaccgctttccgtgagttgaagcgtggggctgacatttatggtggtgagaggaatttcgccacgactcggaccgatg

SEQ ID NO: 8512 - DNA, 203 bp, Homo sapiens
ggcgcgccagtcctcccatcctgcgaccaacttcaagaggtgctgcccacttatatgtggaaaggccgtgaaactgaaagatcggaagtcaggtatcacctactccgttgatgaccttctcacctgcctctatagggagtcagcgcgtcgtcagaggtgtggggataagctagacgctcttttccaggcgactcggaccgatg

SEQ ID NO: 8513 - DNA, 203 bp, Homo sapiens
ggcgcgccagtcctgtattgaagatgaaatcaggatgctgccagacgcttacagacaaaagatgaaggtaaaacatcagatccatgatggtgacctagggtttgagcgtgtacagatggtccctgacccagaggagtggttcgaaactgattgggataagatgcctcatatcctgaagacgatcgacgcgactcggaccgatg

SEQ ID NO: 8514 - DNA, 203 bp, Homo sapiens
ggcgcgccagtcctaacaggtggcaacgggactatcaatcctagcgagtatcgcaaccctcgcctccttcatatatttagcctataggatgtttgcctctaggcagggtccttattcaggagaatcacccgcccccctcaaggcaccagttccccgtagggttgtggtaacccaaggtcctgactctgcgactcggaccgatg

SEQ ID NO: 8515 - DNA, 203 bp, Homo sapiens
ggcgcgccagtcctacaatgagcaaggtgctctcgaactcaccttgatcagaatcaaccgtcccaccaaattcagagatattaggaaattcttcccccctgccttttcagcggagagagactgcacacttgttgtgaataacaagaacttccctagggtgatgctccccgtgggtgcagtcacggcctcgactcggaccgatg

SEQ ID NO: 8516 - DNA, 203 bp, Homo sapiens
ggcgcgccagtcctcgtttatggagggggccattgtgtccacatctcaggccccaaggcctatcaacctcaacacaaagaccaccctaaggccgtccgtgttctacgacacctttaaaggggagaaagaacctgcagccctacatgtcaaggacagacgcctcgaggtagaccttgagaaggccatgtcgactcggaccgatg

SEQ ID NO: 8517 - DNA, 203 bp, Homo sapiens
ggcgcgccagtccttctcaaagtacaagggcaaccttgacgttgagttcccaccagagctgtccctggctgtggaccaatacgttgagcagatcagaccattgatacccccggatgtgactgaccccctatccttggaggacgttgtttatggcattgacaacctcgagggacttgatttgaacacgtcgactcggaccgatg

SEQ ID NO: 8518 - DNA, 203 bp, Homo sapiens
ggcgcgccagtcctcatcggggtgttctggcacgtccatcttgaattcgataatcaacaacctcattatcaagaccctggtacttaggacttacaaaggtgtggatctggaccaaatgaagatcctagcctacggggatgacgttatagtgacctaccccttccagctggatgcatcgatagtggcagcgactcggaccgatg

SEQ ID NO: 8519 - DNA, 203 bp, Homo sapiens
ggcgcgccagtcctgacttcattgccaaggtgcgcactgtacctgtagggagggctttgtcattgcccacctaccgcgtgctgcgcgcattttggcttgatctattttgatccccatcaatactcaactaccagtccaatcataggctaatactgatagttgaagacatttaattgagattggcaattcgactcggaccgatg

SEQ ID NO: 8520 - DNA, 203 bp, Homo sapiens
ggcgcgccagtcctgaacgctccgccactgccatgtatagcgtgcaatgcataaatggtgcactacatgatacgagggaatgggaaaccctccatggccgaatgcagggtgacagcctgccggcggatgcctgttgttagtataatccgttgtttgccacatggattccacagtctcttttccagcatcgactcggaccgatg

SEQ ID NO: 8521 - DNA, 203 bp, Homo sapiens
ggcgcgccagtcctctctccaaggggcacaatgtaagaaacttaaggcctgccggccgaagatgtattgtgaccaggggtactgtcatgctagttgtcgaaggcataggtcggctttgaggtgttgtctttgcagcaaggcctatgaagaagaggacttgaaggttgaagcattagagtatccttgctcgactcggaccgatg

SEQ ID NO: 8522 - DNA, 203 bp, Homo sapiens
ggcgcgccagtcctggacacagatatatctgggtgatcggaaaatgcattggatatgtgatgcacatctaggatgtacgacgcattgctgttgttgtgatggtcagtttcagggacagttgtctagcaccatgtctggtaacaaacacataggggcttctggcggttccactgtgaattatattaactcgactcggaccgatg

SEQ ID NO: 8523 - DNA, 203 bp, Homo sapiens
ggcgcgccagtcctattatggtgctgagtatgcaaatgcagcgaatgcccccacccaaaacttggatccagcagccttcactgacccagtcacagagttagcttcctctagttttgtacccgatctacaaagcccatctgctgaacaatgtgggtactctgatcgaattttgatggttacggccggtacgactcggaccgatg

SEQ ID NO: 8524 - DNA, 203 bp, Homo sapiens
ggcgcgccagtcctgtgccacgcttgtgttgccatatcttaacatcacaccagcgtgtctacccaaaatccattgtccatggtcattgaacttgatcatcctggctgacctggactatgctgcaggcgctgccaccactattccaataacggtatcagttgccccccagtgttctgagttcgctggcccgactcggaccgatg

SEQ ID NO: 8525 - DNA, 203 bp, Homo sapiens
ggcgcgccagtccttttcaccaaatggttctgtggcgccccccgataccgaatcacaatgggcaacatcccttaacccagtgacaacatttagattgcagcaaaattggtctagtgtccgaatcccgtttttatctactgctcattatttctccaccttctttaacggttatggcacatttgataaaacgactcggaccgatg

SEQ ID NO: 8526 - DNA, 203 bp, Homo sapiens
ggcgcgccagtcctacctgattaagggaattgaaaagaccattctggcctttgaaccggaagatgacaatcatggggtcctcgatgtccttgagtgggtcacaaagttagtgtgcgcaacaacgataatcgtcagggggcaccatgacccagccatagtgacctcatgttgcgtaatgttgggtgtagcgactcggaccgatg

SEQ ID NO: 8527 - DNA, 203 bp, Homo sapiens
ggcgcgccagtcctttaaagagctgatagattgggtcaaggatctggttgtcaaaatgaagcaccaggaaactatggctgatgaattgaagttttatcttaatgagtggtttctgtatcagaaggacccatccaaatttacgcgtggttctgttatcaaattgtgtgataaattactagagattaaagcgactcggaccgatg

SEQ ID NO: 8528 - DNA, 203 bp, Homo sapiens
ggcgcgccagtcctgtaaggcattgtctaaattttatagagttcaagaaccctactcgctcccacctgatccaaagtattttgatggttataaagggcagatggtcacaatcatggatgacttgggacagaaccccgacggagcagatttccaattcttgtgtcagatgatttcgacagttgacttttcgactcggaccgatg

SEQ ID NO: 8529 - DNA, 203 bp, Homo sapiens
ggcgcgccagtcctacccaccgatggctgacttggcagataaaggagcaccatttattagtgattttgttctagcatccacgaatttgagaactttcaatcctccaacgatttcagacgtaggagcaataaaccggaggtttttcattgacacaaccattgatctgagtaaggactattgcaatgcagcgactcggaccgatg

SEQ ID NO: 8530 - DNA, 203 bp, Homo sapiens
ggcgcgccagtcctctgggaaattggatgtgcagaaggcattggcgaagtgtgatcatgaggtggatgtgctttacactaagcattgttgcccactactctgtgggaaagcggtaaagttggtggacaagaagggaaacaagttttcggtgaatgaagtgattggattactggtctcggaggctgagacgactcggaccgatg

SEQ ID NO: 8531 - DNA, 203 bp, Homo sapiens
ggcgcgccagtcctgaaaaagaaaagttgggatcaatgttgacggtttatttcagggaccaaccgctccaaaaccaattctggagactgtgacagttagtggttcagctttgcccgaggatgttgctgatgctttgatggccaatcaagccggagacaatttgattgatcaattggaacaggcaggatcgactcggaccgatg

SEQ ID NO: 8532 - DNA, 203 bp, Homo sapiens
ggcgcgccagtcctcacaactgcaaaaaccggtggttgggaccgttaatgtacaaggaccaggagcaccaaatccagatttccagtttgcccaaaagatccaaaagaagagcttacttccacttgtgactggagcaggcccctacacggcagtgggaatttttggtagaacagttctgctcccgaagccgactcggaccgatg

SEQ ID NO: 8533 - DNA, 203 bp, Homo sapiens
ggcgcgccagtcctactatgtggaacaactcaggcccctgttaccagaggatgtcactgagcccctgaccctagatcaggccattgaagggtaccatggattgcaaaaattggactcggccacaagtgctggttttccctacaacaccatgggaataacaaagaaacaattgatggcaaatgacaggacgactcggaccgatg

SEQ ID NO: 8534 - DNA, 203 bp, Homo sapiens
ggcgcgccagtccttcttttgtgaaaacccaggcacagcgaccgggatggctgttggatgcaatccagacagggattggactagatttcaagctgaatttgattcttcatatgtgataagctttgactacaaaaattttgatgctagtctatcaccaatgtggtttgccgccctgcaaggagtactgccgactcggaccgatg

SEQ ID NO: 8535 - DNA, 203 bp, Homo sapiens
ggcgcgccagtcctagggacttggatttgatgagaatgatgtcgaattcatcattgaccacatgtgcttttccgtccatttatggggtgacaccttcgtgcacattgaaggtggaatgccatcaggttgctccggaacatccatctttaacagcatgatcaacaatatcattttgaaaacaatcattccgactcggaccgatg

SEQ ID NO: 8536 - DNA, 203 bp, Homo sapiens
ggcgcgccagtcctccttggagctgcacaccttcctcaaacgcggcttcaagagagatgatgaatttgatttcttggtgcatccaaccatggacaagacagcaatctatgagtcgctgcgctggacgcgcgaccccaaggactttcaggaccatgtccgatgtctgtgtgaactgatgtggcaccatgcgactcggaccgatg

SEQ ID NO: 8537 - DNA, 203 bp, Homo sapiens
ggcgcgccagtccttaggagatgtctacaacaggctcgcccatgagtagagcatggactgcggtgcatgtgacttcggtcaccacgggcatagcattgctcacccgtgaatcaagtcatcgagatttctctgacctctgaagtgcactgtggttgcgtggctgggaatccacgcttgaccatgtactgcgactcggaccgatg

SEQ ID NO: 8538 - DNA, 203 bp, Homo sapiens
ggcgcgccagtcctcaatctatcatccacccttctaagcctgtccagaaggatcctgaggacatcctcgaggattccgaatggccagacaacatcttacaccctgaacccccttcttttactaccgatgctgagcaaaattggcatgaccgcttggcatctgcttccttgcctggacccacccaggcacgactcggaccgatg

SEQ ID NO: 8539 - DNA, 203 bp, Homo sapiens
ggcgcgccagtccttccaccgctcctgtggtctgtgcttaccctcccaccccttctgttcctcttcctaatccagatgctccctctgtccctggtccgtctggtgaccgtacttggctgttggacactctcgaatggaccactgagaatccacaactgtggaacttggctggtccaaacgggatgcaacgactcggaccgatg

SEQ ID NO: 8540 - DNA, 203 bp, Homo sapiens
ggcgcgccagtccttattctgctctccaaaacctcactttccctgtttcttcttctgctaattggggaacacaagataactccccacccactgcctaccctctccctttctcttttgtccacgcttatccagactgcccttggacggctatgcatgatacccactctatgtggaattgtggatggcgccgactcggaccgatg

SEQ ID NO: 8541 - DNA, 203 bp, Homo sapiens
ggcgcgccagtcctatccaagtggtggttaatggttctcagtttcatgctgggtgtttagcattggtcatggtccccgagtactccgccggagagctcgcccagggccgtctaaatgccatcttcacttttccctacgccctcctcaacctctaccaaggtaacaccgcctcaatagaggtcccttaccgactcggaccgatg

SEQ ID NO: 8542 - DNA, 203 bp, Homo sapiens
ggcgcgccagtcctaacactggtttttctcttctccttggtctgggcgctctcgccctcctgtctggttgcgcagccgtgcaagcgtcgaaaggacgcgtgacccgacagggcctcctctctcttgaagcccccccagaggtcgtccaggctgctaaccgtgtcgctgactccattgagaccactgcccgactcggaccgatg

SEQ ID NO: 8543 - DNA, 203 bp, Homo sapiens
ggcgcgccagtcctgtttcctccagcctgaacggtttcactgatatgctctcttccttttccaagaccttcactcaaggtgcttccaaagtgctgagagatggtatctctaccttccttacctgggtggccaaagtctttggttaccttcttgtcctctttggatctcccactccgatgtccatagctcgactcggaccgatg

SEQ ID NO: 8544 - DNA, 203 bp, Homo sapiens
ggcgcgccagtcctggtctattggtcatcatctgtgctgaccttgctcctcaagcctctgaatacttccactcttgtagctctgtccttggttccctttactactggattgctaccaagcttggtctctctgtcactcctgaggaggcacacgcagcaacggtagaacaccaaggtgttcgtgactaccgactcggaccgatg

SEQ ID NO: 8545 - DNA, 203 bp, Homo sapiens
ggcgcgccagtcctattctttctgagtctaaacctgtacccacttccctttcctttgagcgggctgtctcacagaatgctcctctttcggtggttaaccagctctggaactaccgaaaacccatctttgcctgtactactttccttactgtgattggtttcgttcttaccatcattgctgtggcgcgtcgactcggaccgatg

SEQ ID NO: 8546 - DNA, 203 bp, Homo sapiens
ggcgcgccagtcctgacaatgtctatcccattgctactgaatcccctactattggtcgcagcgcaagctgtggcttctttcttttctctcgattctttctagcccctactcatatcatcccggatgatacgacccgcatctctgtaggtccagatgtctttgactgggcgacactccaacacaaacgccgactcggaccgatg

SEQ ID NO: 8547 - DNA, 203 bp, Homo sapiens
ggcgcgccagtcctctgggaaaagaactcactatcatccattttcctactattcgccaacatcgtgacctccgtcgctttattggtgaacatccctaccctactggacatcttatttctactctttctggtcctcctgtctacctacgattctccaagaaccgttgggttactcttgaccttcctggccgactcggaccgatg

SEQ ID NO: 8548 - DNA, 203 bp, Homo sapiens
ggcgcgccagtcctcaggcagcaggttacccgtggaacaccatggggcgctcgcgccgttcactctttgtccaacagaatgggatgtggttacctcttccagagttggaagttgaaatcaacaaaactcttgaagatccctattacttctactctactttccttaaagatgaacttagacccacctctcgactcggaccgatg

SEQ ID NO: 8549 - DNA, 203 bp, Homo sapiens
ggcgcgccagtcctccgtcattcatcaaggagttttatgacaagcacacaccacttgttgtaactccagcaaataaaacagacaccttcccggaaaactccaccatctatgacgtcacgtttctgaaacgttggtttgtgcctgatgacattcgaccattctatatccacccggtcatggacccagaccgactcggaccgatg

SEQ ID NO: 8550 - DNA, 203 bp, Homo sapiens
ggcgcgccagtccttatcttcagacccgctggttaaacctcctggcagcgtgagacaccagatacactcttgctctgtatcgctttgtgtagaatagactcatgctttcctaagaccggaactctcatccggcactttcacccacctgccctgccttcattttgaagctgcacccagggaggtggtcccgactcggaccgatg

SEQ ID NO: 8551 - DNA, 203 bp, Homo sapiens
ggcgcgccagtcctgaaaccagtgacacggagagggtggccagtcagtgaggctttgactgctgtgggattgacattcgcgttggcaggaggaatagcccagtttgatgacagcagcatggcgattccattagccgttggcgggattatgctggtggtggcagtggtaacaggcttctctacagacttcgactcggaccgatg

SEQ ID NO: 8552 - DNA, 203 bp, Homo sapiens
ggcgcgccagtcctaagcaatgaaggtgttggcgacatttaagaaaattcttggaaatctgatgaaaacccttcaaacccggaaaaagagaccgaatagacgatctgctgggagtaatggaatgatgatgctagccttgattgggactgctatggcagccacgagtatgactaaagacgataccatctcgactcggaccgatg

SEQ ID NO: 8553 - DNA, 203 bp, Homo sapiens
ggcgcgccagtcctgtaaggggatttctgttgtactgacctatggaaggtgcaagactaattccactaccccggcacctcagcgtcgcagatcaagaagatctatcatgatacctacacacagtacgggtggattgcaccaaggaaccgaaggatggcacaggaccaataatgtgaagaacttcctcacgactcggaccgatg

SEQ ID NO: 8554 - DNA, 203 bp, Homo sapiens
ggcgcgccagtcctaaggggtgtcaggaggtacctgggtagatgtggtcttggaccgtaaaggatgcgtgacaatatcagcaaccggaaaaccgaccatagacgtacggatggttaagatggaagcctccaatttggcatccgtgcgaacatactgtctggaagcttccacctcggaaatttcatccgcgactcggaccgatg

SEQ ID NO: 8555 - DNA, 203 bp, Homo sapiens
ggcgcgccagtcctttgaatgcctgatggactttgggattgatttggatgacgtttacacggccgatatgtcaggaaagtggtggttggttaagcgtgattggtatcatgacattgctctcccatggacagcaccctccgctgacttttggcatgacatggacagattggtggaatttagcacaccaccgactcggaccgatg

SEQ ID NO: 8556 - DNA, 203 bp, Homo sapiens
ggcgcgccagtcctatgccactaagcagagtgtgtataccctaggtgaccaagaaggagccatgtccactgccctaggtgatgcggccgttattgaatacatgtcatcaggaagcaaggtggtctttcgtacagggttcctaaaatgtagagtcaagatggaaaatctgagattgaaaggctccacatcgactcggaccgatg

SEQ ID NO: 8557 - DNA, 203 bp, Homo sapiens
ggcgcgccagtcctatatgcaatgttccaaggagttctctattctgaagaggcccaccgccaccccgtatggaactgtcatcatgcaggtgaagtacgcgcagactgatgtcccgtgtcgtgtgccagtgggcgttcatgagaggccaggtggtgagcaagttggacgtattataacagcccatcctacgactcggaccgatg

SEQ ID NO: 8558 - DNA, 203 bp, Homo sapiens
ggcgcgccagtcctggaacacttttagggttgaggagtttggcacgggaatcatgaaaacaaaagtgtttttggatataaacccgactttaacgagatactgcgataccgaattgcttggagcagctgtgaaaggaaaccattctgctcatggtgatcctggtttgtggatggtctctgagaaagaagcgactcggaccgatg

SEQ ID NO: 8559 - DNA, 203 bp, Homo sapiens
ggcgcgccagtcctgaagtgagtggaaactcacgagcctgtcactatccgagagtaggaggtgtttgtggcctgattctcatactgtctggggacgtggagttgaagagaccaaactcatccttcctgccaatcttggagggccagtgtcacacatgaacactagatatggctactcaacccagatctcgactcggaccgatg

SEQ ID NO: 8560 - DNA, 203 bp, Homo sapiens
ggcgcgccagtcctctggaccatggaacaatgttccactagacgtggtctttgagacctgtcctggaacgacggttaatgtcactagaacatgtgtggggagatcggcatcggcaaggtcaacaactgacagtgggaagatcataccggagtggtgttgcagagcctgcaccatgcctcccttgacatcgactcggaccgatg

SEQ ID NO: 8561 - DNA, 203 bp, Homo sapiens
ggcgcgccagtccttccctggaatggtttcgaaagccttaccccttttatgttgtctggctccgttgcctttagctgttatgactaacgccacgagagctagtgtggcaactttggcagttggaaccatgttggccggtgccaagggcaagtcagtgaaaaaatccctaccatggttttcagctttgacgactcggaccgatg

SEQ ID NO: 8562 - DNA, 203 bp, Homo sapiens
ggcgcgccagtcctctgcggcccttatattcaccgcatatgccataagcggcaaggccaacgacatattccttgagaaagctggtgagatgacatggagccatgatgctcagctatctggatcaagtccaagagtggacgtcaaagttggtgagagtggggattttcggcttcgccacgagtctgaagcgactcggaccgatg

SEQ ID NO: 8563 - DNA, 203 bp, Homo sapiens
ggcgcgccagtcctactcgtggctgaaaacaggcgtaacagctggctgtctcatcatggccggcttccatccccttgccataccggttgcgggattgatttggtatggatatgtgaaacatgaccgtagaggtggagtcttgtgggacattccacacccatcaacatccaaagccggagacactgagacgactcggaccgatg

SEQ ID NO: 8564 - DNA, 203 bp, Homo sapiens
ggcgcgccagtcctgctatggtggaccatggagattgaatggaacgtgggacgggactactgaagtgcaacttatagcagtgtcacctggcaaagttcctatcaacgtccaaacgaaacctggaaaattcgtgctcactgatggacgtgagataggagcagttgtgttggactatccgcccggaacatcgactcggaccgatg

SEQ ID NO: 8565 - DNA, 203 bp, Homo sapiens
ggcgcgccagtcctatttgcatccaggcgctggtaagactaggcgagtcctacctgagatactgcgtgaagctgtgaagaaaaatctgaagacattggtccttgcacccacacgggttgttgcacgagagatggctgaagcattagctggactaccagtgcggtaccaaacaccatctgtcagtcaagcgactcggaccgatg

SEQ ID NO: 8566 - DNA, 203 bp, Homo sapiens
ggcgcgccagtcctactcaaccggtcgtgaactaatagacttgatgtgtcatgcaacattcacgtatcgtcagttgactcctggacggatggtgaattaccaattgtacgtcatggatgaggcccatttcacggatcctgcgagtattgccgcacggggaatcatttcaacaagagtcagtcttggggcgactcggaccgatg

SEQ ID NO: 8567 - DNA, 203 bp, Homo sapiens
ggcgcgccagtcctaagctgcagccatgttcatgacagccactcctccgggaacgacagacgctttccctgagtcaaacgggcatatagaagatgaagaaagggaagtgcctgatgctgcttggagtgctggctttgattggataaccgaattcaacggcaaaaccatttggttcgccccatccattacgactcggaccgatg

SEQ ID NO: 8568 - DNA, 203 bp, Homo sapiens
ggcgcgccagtcctatggagacatggcgcattggattgaggctaagattctcatggacaacatcacagtgcctgggggactttatcctcaattctatgaacctgagcgaatgaaatgtccagcgaccgatgggtttcacagacttgatgacaagaaaagggctgttcttcgcgatctcataaggcgcgcgactcggaccgatg

SEQ ID NO: 8569 - DNA, 203 bp, Homo sapiens
ggcgcgccagtcctaccaacgagtctaccaggaacgtgcttctttgaaaagtttcacggaatttgcagagggcagaaggagttacatgcctattttagatgtggttgggaaactgccccagcattttagtgatcgtgccattgatgcagctgacactattcgaactgttctcacagccaatcctgactcgactcggaccgatg

SEQ ID NO: 8570 - DNA, 203 bp, Homo sapiens
ggcgcgccagtcctcacgatcttaccgactggcaatagacaatctgccggaagcggctgaaactgctatgcttataggcatgctggtttctgtcaccatgggttccatcatgtttttgatgatgcccaaaggcataacccggatgtccttgggattgattgtcatgattatggcaacttggttcatgtcgactcggaccgatg

SEQ ID NO: 8571 - DNA, 203 bp, Homo sapiens
ggcgcgccagtcctcgttgatgcacttcgcccttatcctacccggattgaaagctaaagctgcccgggaagcacaaagtaggaccgccgctggaatctcaaaaaatcctttgatagatggtgtgaatactacggcgattccactcccatcagccattgaccctatgtttgagaaaaaactcggactgtcgactcggaccgatg

SEQ ID NO: 8572 - DNA, 203 bp, Homo sapiens
ggcgcgccagtcctggatgttgcttatagtttcgtctctagcggtgcttcttaatcgaagcacgctgcatatgactgaacttggaatccttggctcagctgctatatctcctctaatagagggacaagcttcggccatctggaacacttcagttgcagcctccgtgtgtaacttgatgcgtgggagctcgactcggaccgatg

SEQ ID NO: 8573 - DNA, 203 bp, Homo sapiens
ggcgcgccagtcctagaagaagattgtgcgcgtcaaaggatacacaaaaggtggaccaggacatgaggaaccagtgcccgttcaatcatacgggtggaacctcgtaacgatgaggtccaacgttgatgtgttctacttagggactgagaaatgcgacacgctggtttgtgacataggagaatcatcatcgactcggaccgatg

SEQ ID NO: 8574 - DNA, 203 bp, Homo sapiens
ggcgcgccagtccttagtgaaagagatgtcaaaaccgtgggacacgatttatggagttacaagtgtttgcatgacagacactactccattcggtcagcagcgcgtgtttaaggagaaggtggacaccaaggctagtgaaccaaaggcaggcatccgtgaggttatgcgcataactaaccgttggctcccgactcggaccgatg

SEQ ID NO: 8575 - DNA, 203 bp, Homo sapiens
ggcgcgccagtcctctaacctaaaagtccagcttatacgcatggctgaatctgaaggcgtcattcatggagatgacgttgaaacactatctagcagtgggcgtataaacttggaaatgtggcttgtcatgaacggggcagaccgtcttaagcgcatggcatgcagtggtgatgatgtcgttgtaaaaccgactcggaccgatg

SEQ ID NO: 8576 - DNA, 203 bp, Homo sapiens
ggcgcgccagtcctaggacatctcctgcggttcgctcatagggacacggtctagagctacctgggctgataacatcaagacagcagtcaatcaagtccgtggaatcataggaagggacgaaaagtatatggactatttggccattcaaaatcgcttcatgccccctctccaatttagattgggaagcgcgactcggaccgatg

SEQ ID NO: 8577 - DNA, 203 bp, Homo sapiens
ggcgcgccagtcctgatgttgggacctggttatccattaagacagcagtcgggaacggatcatgcatcgttatggctacagatgtggggacttggtgtgaagacactgttacgtatctttgtcccaaattggacggtgctgctgagcctgacgacattgattgttggtgtaaagttgtatcagtttatcgactcggaccgatg

SEQ ID NO: 8578 - DNA, 203 bp, Homo sapiens
ggcgcgccagtcctgttacctatggtaggtgtagacgagatggggtgagtagacgcagcagacgatctgttgctctcgcaccgcatgggacaggaaaccttcacacaggagaggcaccaatgtggaaatcacacactgacgctagtaaatacttgcagcgagtcgaacggtgggctctgagaaatccacgactcggaccgatg

SEQ ID NO: 8579 - DNA, 203 bp, Homo sapiens
ggcgcgccagtcctgttttggacgtgcacgggtgtgtgactattgcagcagaaggtaaaccaacagtggatttcaagttgacgaagttggagatgacgaaacttgcaaaggtgcgagcgtactgcctcactgcctccgtatcagacatcacagtcgaaagtggatgtccaggaacaggcgaaattcatcgactcggaccgatg

SEQ ID NO: 8580 - DNA, 203 bp, Homo sapiens
ggcgcgccagtcctgagcaagtcttgatcgtagacacagcctcacgctggtggatggtcaagagagactggttccaggacttagcacttccatggacatcaccgtcagcagacttctggcatgatcgtgaccggttagttgaatttggagttccgcatgctacgcgacaatctgtatactccattggacgactcggaccgatg

SEQ ID NO: 8581 - DNA, 203 bp, Homo sapiens
ggcgcgccagtcctgatcaagaaggagcatttttcactgccgtggcaaaagccccgtcagtcgagtggaactctgacaaagtcaagttagcgaccggattcctgaaatgcagaatcaagcttggcaacatgaagctgaaagggtcaacatacgtcacgtgtgcgcaagcgttcacctttgcgaagcggcgactcggaccgatg

SEQ ID NO: 8582 - DNA, 203 bp, Homo sapiens
ggcgcgccagtcctccagtggacacaggtcatgggacagtcgtgttccaagtatcatatgctggaacagatgcgccatgtaaaataccagtggccgtgactgacaaaccaaacggcgagcatgtcgggagattggtgacagcacacccattcatagcgaaacagaatgagaaggcagtcgttgaagttcgactcggaccgatg

SEQ ID NO: 8583 - DNA, 203 bp, Homo sapiens
ggcgcgccagtcctacccgaaacacaacaggactgcagtacggatggaagtcgtggggcaagacaatgtttgtttcagtgccaatagccgagaacactttcataatcgatggaaatgatgaaggagagtgtgcctcggacaaacgcgcttggaatacatttaagatagaggagtttggcacaggaatacgactcggaccgatg

SEQ ID NO: 8584 - DNA, 203 bp, Homo sapiens
ggcgcgccagtcctatgaaaaccaaagtcttcctggatttggctgacgcacaaacagaatactgcgacacggaactgttgggagctgctgtgaaaggcaacaagtctgttcatggcgaccccggattgtggatgactgcttctaaggaatcaggcgactggaaactggaatcattgtcaatgacggagcgactcggaccgatg

SEQ ID NO: 8585 - DNA, 203 bp, Homo sapiens
ggcgcgccagtccttcaccacgggaaagtaccattttggcttcagcagcagtcgttctgcaaatttgtgcggctgcatggcaatcaacaaagtctatgcaagtgctgaatgctcttgctatgggatggctgtacatcagagccattgtggtacccggagctctttccaaagcaatgcccctcatttgccgactcggaccgatg

SEQ ID NO: 8586 - DNA, 203 bp, Homo sapiens
ggcgcgccagtcctatgtgcgtcccaggcgtgttgagcctgacgccacatgctataagagtcagcatggttacaatagcggcaggcactctcatcaaaggcacgaagggaacatcagttcggaagcacatgccctattttttaggactagtaggagccgtggccggactggatccattaggtatgcttcgactcggaccgatg

SEQ ID NO: 8587 - DNA, 203 bp, Homo sapiens
ggcgcgccagtcctggttctacgcaagtaggagtgggagtgatgaaagactcagtgtttcacacaatgtggcacgtcacccgtggcgcctctctaacgagtggtaacggtagaatggatccatattgggcggatgttcgagaagatctcatcagctacggtgggccatggaagctcaacagcacttggcgactcggaccgatg

SEQ ID NO: 8588 - DNA, 203 bp, Homo sapiens
ggcgcgccagtcctggaactcttgatgcattcccagaatccaatagccatattgaagatgaggaaagggaaattccagacaaggcatggagcaccggattcgaatggattacagattacacaggcaaaactgtgtggtttgttccatcaattcgaactgggaacatcatagcgagctgcctcgcgaggcgactcggaccgatg

SEQ ID NO: 8589 - DNA, 203 bp, Homo sapiens
ggcgcgccagtcctgtcccttctgagagagtagtgttgggatctccaaaacccataagcccagctagtgcagcacagcgtagagggagagtgggtcgagaccccactcagcttggtgaccagtacatttacggaggcgaggttggtgacgacttctccaacatggtgcactggacagaagcgaagatccgactcggaccgatg

SEQ ID NO: 8590 - DNA, 203 bp, Homo sapiens
ggcgcgccagtcctttaatggacaacatcatggtaccaggcggtctgtacccacagttctacgagccggaggctgacatgctaagtgaaacggatggacacttcaggctggatatgaccaaacgtgacgtattcaaggatttggtgcgcaaggcagacttacccatatggctggcttatcaggtggcccgactcggaccgatg

SEQ ID NO: 8591 - DNA, 203 bp, Homo sapiens
ggcgcgccagtcctaagcatggtcatgaatacaaagacagaagctggtgccatagtgggccatctggacatctcatctacgatgattacggacagacagttgaatacaagcttgtgaatggcgagaggaagatactgcaaccaagatggattgaccaacgcacataccaggagaaaacagcactcaagcgactcggaccgatg

SEQ ID NO: 8592 - DNA, 203 bp, Homo sapiens
ggcgcgccagtcctgctttcatcgaatttgctgagggacgccgaagttatgttcctataatagaagtgctcggcaaacttccacagcatttcgccgacaaaactattgatgcggctgacaccttcaagactgtgcttacagccactccaggaagtagagcatacaggcttgcagttgacaacctaccccgactcggaccgatg

SEQ ID NO: 8593 - DNA, 203 bp, Homo sapiens
ggcgcgccagtcctgatgcagcagagacggcaatattcgtgacgatggtagggttcatgaccatgggaatactaattttcctgatggcacccaaaggcatgacacgcatgtcgctgggattcatgaccatcatggcagctacgtattttctgtgggcttcaggcatggctggatatcaaatagcggcacgactcggaccgatg

SEQ ID NO: 8594 - DNA, 203 bp, Homo sapiens
ggcgcgccagtcctcaagcaggaatactgctatcaatggataaaggaacgccatttttcaacttggactggggcgtcattctgttgggagtggggtgttggtctagcataacggggacaaccttgttgtgtgcgatcggactctcctgcgttcacttctcaatgactctacctggagtcagggctaaacgactcggaccgatg

SEQ ID NO: 8595 - DNA, 203 bp, Homo sapiens
ggcgcgccagtccttcgctaaaaggggttccccgtagaggagtcaccataagcaacacccgagggatggaatggaaacgcaaactaaacgcaatgaacaaggaaacctttcagagatacagacgagatgggatagttgaggtggacagaacagcagcgcgggaagctttaaagagtggaaatgtaacacgactcggaccgatg

SEQ ID NO: 8596 - DNA, 203 bp, Homo sapiens
ggcgcgccagtcctggaggtcacgctgtatcccggggttcagcaaagctcagatggctggtagataaaggatatttacgcctgatgggggatgtcacagacttgggatgcgggcgaggtggatggtgttattacgcagcagctcaaagaaacgttgtatctgtacgaggcttcaccaaaggaggtgaccgactcggaccgatg

SEQ ID NO: 8597 - DNA, 203 bp, Homo sapiens
ggcgcgccagtcctggacacgaagaacccattccggtgcagacttatggatggaacattgtcactctgcgtagcaaagtggacgttttctacatgcctacacacatgacagacactctattgtgtgacattggagagtcatcgtctaacatgctagtagaagaagagaggaccctacgcgtgctgaatcgactcggaccgatg

SEQ ID NO: 8598 - DNA, 203 bp, Homo sapiens
ggcgcgccagtcctctggttgaagagtggatcagaaagagtaagccaactcacttttgttgcaaggttcttgctccatacatgccaaatgtattggagaagatagacaagctaatgaaagttcatggaggtgctttagtgagagtgccactctcccgcaacagcacacatgagatgtattgggtatctcgactcggaccgatg

SEQ ID NO: 8599 - DNA, 203 bp, Homo sapiens
ggcgcgccagtcctctcacgtacatgaacaaggttgtgagagtgatgaggccaggcaagggaggaaagacgctaatggacatcattagcaggaaggaccagagaggtagcggacaggtcgtgacttaccccctcaacacgtggacaaacctcaaggtgcagttgattaggatggctgaaggcgaaggacgactcggaccgatg

SEQ ID NO: 8600 - DNA, 203 bp, Homo sapiens
ggcgcgccagtcctatggccaagatcagaaaagatatcaatgaatggaagccctcaacaggctggaacagttgggagggtgtgccgttttgttcacaccatttccacaagctcagcttaaaggatggaagaacactcacagttccatgcagagatcaggacgaacttattggaagagctagagtgtctcgactcggaccgatg

SEQ ID NO: 8601 - DNA, 203 bp, Homo sapiens
ggcgcgccagtcctcctggagcagggtggacgttgcgagaaaccgcaggactcagtaaggcgtatgcgcaaatgtggatgctgatccacttccacagaagggatctacgaaccatcgcgttcgcaatttgcagtgcagtgcctaaagactgggttcccacaggaaggacatcgtggtccatccatgctcgactcggaccgatg

SEQ ID NO: 8602 - DNA, 203 bp, Homo sapiens
ggcgcgccagtcctcccgagctggacaaggcatgtgtactagcggttagaggagacccccccaaaaatgaagggcactatatcgacacttgggaaagaccagaggtactcgctgattcaccgccaccagactacacggcacagcgcgccggaaaaggtagtttggaggttgtaaaacaacaagtatctcgactcggaccgatg

SEQ ID NO: 8603 - DNA, 203 bp, Homo sapiens
ggcgcgccagtcctgcttttgaccagtggctctgggttacttagccaagtccctttctcttattttcactagtttatgttgtgtgttgtctgttttgttttgtttaaattgtatacaagatccttcccgccgacacagacctcgacagtctggtgtaggagggttggtgatattaatttgccccaaaacgactcggaccgatg

SEQ ID NO: 8604 - DNA, 203 bp, Homo sapiens
ggcgcgccagtcctgagtgaccgtgatacgtggaaaccatgagtacatgtgtatccgtggaggatcgcccgggactggattccatatcccattgccatcccaacaaacggagggtatacccaccacgtgcgcgtttgcagtgggaatctgcaaatttagtcatactgcctgatagggtgtgggcctgccgactcggaccgatg

SEQ ID NO: 8605 - DNA, 203 bp, Homo sapiens
ggcgcgccagtccttgcttttggaagaatcggtcgtttcctgcttatggcacatcacgatattttcagttctttcgtggttcgttccatattaagattcaggtcaatgctgctgcaggttctgccggttcttttgtcgttgtctatgtgccaaatgaccattatcagagttggaataataaggatttgcgactcggaccgatg

SEQ ID NO: 8606 - DNA, 203 bp, Homo sapiens
ggcgcgccagtccttgtatttttgattggcaggctagccatgctccaacaaccaagtctccgatttttgggcgtggctataagatacgagagcttggtaatttgggtccattgtcaacagcctatcagttttggcgtggttctattattttcactctcaccatttttgctagcagttttcaccgtggccgactcggaccgatg

SEQ ID NO: 8607 - DNA, 203 bp, Homo sapiens
ggcgcgccagtcctaacgtgtatgttgaaacccgattggctcacaataatgcatcttccaacgttataaaatgcgcactttttgtgcgtggcggcgaggattttgagttcttggcgccatgcggtgacactgtcaagttccatggttggggatcggatatggatgaagctgatcctttggatgacatgcgactcggaccgatg

SEQ ID NO: 8608 - DNA, 203 bp, Homo sapiens
ggcgcgccagtcctatatttgccaaagatcatatgcaccttgattatttctttggtcgtggatggtatgtcatgaaacataactatgagggcgagagccgtgcccctttttatattgatgtggatgctccatcgtctatgccaggcgctgcaatgaatttcttttctttctgggctggggaggttaaccgactcggaccgatg

SEQ ID NO: 8609 - DNA, 203 bp, Homo sapiens
ggcgcgccagtcctttccatgttgtcaacaatagtgatgacccaatggctgtcactcatagttattcgcatgaggctagcactgttggtcccgctgaaggtctagggttgataattgtgccgcctcgtgagatgatatcatttgcagcccctttctattcctggtcgccattgcggactgtgcttgctcgactcggaccgatg

SEQ ID NO: 8610 - DNA, 203 bp, Homo sapiens
ggcgcgccagtccttctgaattttctagtgtaagacttgtgtcgtctcaaacagccgcttttgtggatgccctttttaatggtgatttgtataaactctctgaacaattcctttcaatgatggatattggttctgattctgactataaacaattaatcaaggagacgttgggatcgtaccctcctgaacgactcggaccgatg

SEQ ID NO: 8611 - DNA, 203 bp, Homo sapiens
ggcgcgccagtcctatgaacccatttgagtcacagagtttggctgcatttaatgctttgtccttgagtgctcgtaattgtacatggtggattgagctcttccagaaattgcacacgttcgtgcgtgacttattgaaaccagatacttcggcaaagtttcatgaatggtgtaggaaaaataagatgctccgactcggaccgatg

SEQ ID NO: 8612 - DNA, 203 bp, Homo sapiens
ggcgcgccagtcctgacatgcgtaagagcatgttagctgttaagctagggcaagaatatcagaatacgtgtgctcgtgaggagccccttggtgtgctgctacgtggcgaacctggacaaggaaaatcctttatgacacatctgctcgtgcgtagtgtttgcaatgctatgggctggaaggtttctgagcgactcggaccgatg

SEQ ID NO: 8613 - DNA, 203 bp, Homo sapiens
ggcgcgccagtcctagtgtgtttagccaccctacatcaagtgagttctttgatgggtatgctgggcaaccgattcatcttatcgatgattttgggcagaatgtggaggaacctgaatataaagttttgtgccagtgtatgtcttccataccattttctgtgcctatggcttcgcttgaggaaaagggtcgactcggaccgatg

SEQ ID NO: 8614 - DNA, 203 bp, Homo sapiens
ggcgcgccagtcctttgccttatacttcaaagttagttattgccacgacaaataaatcagattggtcatctcgtaccttgtgcgctccaggtgctttgaagcgccggtttcctattgtttataccgttcgcgcacggaggactttaaccaagaatggccttcttgatgtcaacgcacatatgagtgcacgactcggaccgatg

SEQ ID NO: 8615 - DNA, 203 bp, Homo sapiens
ggcgcgccagtcctgatatggtgtcccttcttggccctgctgttccagttgcttcagtgttcgactattgcgctagcactggtgttgtacccatgttaaagcaagcgtcggaatctgtccttaagtggtttgattcgtgtgttgacagcatggtgtcgtttgttacacgtaacaaaaagtggattgctcgactcggaccgatg

SEQ ID NO: 8616 - DNA, 203 bp, Homo sapiens
ggcgcgccagtccttttggtgctttaactatgagtgtgttaggtattgctatatctatgcttaaggaattggacagccagcgtccctataatcagaccgcccataagatgcctgttactaagctcacgcgtgggcgacgtgtgcttgtttcccaaggcccttataatgaattccagcattattctaaacgactcggaccgatg

SEQ ID NO: 8617 - DNA, 203 bp, Homo sapiens
ggcgcgccagtccttactgtgtttttctccattctgggtctattacacttcatggccttgcatttggtggtaattcttttttgttttacacacatggccttgctactcttgagcgctatgataattgggtgcttgactataatgggtccatgtttgatttagatattgaaactgtggatgagttataccgactcggaccgatg

SEQ ID NO: 8618 - DNA, 203 bp, Homo sapiens
ggcgcgccagtcctaagattgaacaaggccttacaaggtgcattgaaagtagcgattttgactatgtttttagtgccaaaagagtcttttgcaagctgttccggcaactttatgattctgaccctattgagactggatttgctgttggtatcaactgtattgctgactggaagaatttgttggacggccgactcggaccgatg

SEQ ID NO: 8619 - DNA, 203 bp, Homo sapiens
ggcgcgccagtcctatgtatgattacatttatgattttgatctgaaaggatatgatggttctataccacgtcagctcatgatagatgcttgtcgtgtcttgagtgaaagttgtagtgatgaagagttagcctacaatttactccacaaaactgtggattcacagcatgtggtaggtaaccagcttttgcgactcggaccgatg

SEQ ID NO: 8620 - DNA, 203 bp, Homo sapiens
ggcgcgccagtcctacagtttctggtggaatggcttcaggatcaccttttacaactattgtcaatacagcttgtaatatccttgcaaatatgactgttcttgaggaggagggtgttgagtatacgctagtgtgttatggtgatgatatactagtctccacctccgatcccatttctgtcaatgactatcgactcggaccgatg

SEQ ID NO: 8621 - DNA, 203 bp, Homo sapiens
ggcgcgccagtcctgttgacaaaatggggcaatattttgggttcactgtcaagcttgatggtgattatcccaagactaaaaataattttacttttctaaaacggagaactacttactggaacggcattccagttggagcgatggaagttggccttttgttgcaacatcttgggtattgtcggtcagtgcgactcggaccgatg

SEQ ID NO: 8622 - DNA, 203 bp, Homo sapiens
ggcgcgccagtccttccctacccaagccccagtacaccactatggagttctttatatcccagcgcgtggtggacgcactgtgaggtattccgataccaccccactcgcacttcctggatagtgcgttagatatgcccgacatatcgcttccaggaccaaagccccccttttctctttcccaaccagctcgactcggaccgatg

SEQ ID NO: 8623 - DNA, 203 bp, Homo sapiens
ggcgcgccagtccttcgccactcaagctgtaattccatgtccggtctttccggccttagtatcatggaaatgtggtcgtgctcaaatgaaattgagttgacattgatcaatgaaagttgcactgaactttgctaaactggctagcgccacctggtgtgtgccgttggtctcctcacatggtaacatgtcgactcggaccgatg

SEQ ID NO: 8624 - DNA, 203 bp, Homo sapiens
ggcgcgccagtccttatggatgaatgagtagaccccctgaaggtaccccattacatgggatctgatcagggccacattctgcgtgtctccccgcacttgtggttaaaaccatgaaagttcatcccaaacaatcttttcctcttctttttcttttagtggtgacaacctactggattggtgattaccaacgactcggaccgatg

SEQ ID NO: 8625 - DNA, 203 bp, Homo sapiens
ggcgcgccagtccttaacatataatgtaacaggaaataacaattcctttgacactgaccaaggattaatggcttctggatccgttgcagccactggacatggaaatgcttctgccactgatgtaacctcccctgaccccatccaagctaatgccacaaaacccactaaacccaagcccactcgctctacgactcggaccgatg

SEQ ID NO: 8626 - DNA, 203 bp, Homo sapiens
ggcgcgccagtccttcccctctaaagctgcttcttttgacgttattgctatgacctcctcccgcggtgtagatacccccccttcgacgacccgctctgctgagaaccctgcttcaatcctccaatcggcacgaactcgcaatcagactaatgctatggcatctgatgtaaaggctgaagaaactggttcgactcggaccgatg

SEQ ID NO: 8627 - DNA, 203 bp, Homo sapiens
ggcgcgccagtcctctgctcccaacacgcaaggactagtgaccatgcccgccgctggttccggcgatggttacacatattcagcccagacccgcgactttcatcccgtgatgcaagccccaccacccctcccgcatgtagatcaccttcccgggcaaatttcatctttttctgaattggcaatgtgtccgactcggaccgatg

SEQ ID NO: 8628 - DNA, 203 bp, Homo sapiens
ggcgcgccagtcctctcaaactgcatctggtagattgatagtgtcctacaccccccccggttttgctgccccatctaggcttactgatttatccccttctgctaaacatctttgggatttgacttcatgttcttctgtctccatccttatccccaactgtttccctggtggctgggtccctaccctcccgactcggaccgatg

SEQ ID NO: 8629 - DNA, 203 bp, Homo sapiens
ggcgcgccagtcctttttcaatttcaaaggatttggactcatgcctcagtattccccaatcaagaccaatactcccttctatcaacccccatgcttcctgagcaatgcccgcatcccctccaagcgccaaggaggtgaagccattgacatatctggtgaaccagtgtatgtgattcgggcacctcgcccgactcggaccgatg

SEQ ID NO: 8630 - DNA, 203 bp, Homo sapiens
ggcgcgccagtcctctttccgcaactgtacccactttgtagaagctttgactggatacaacctgcagaactcaggacttggcataactctaggattaggtgctgctgctgttgccactgcttcagtgggcgtcgcaaaaacgctccttgacgctcacttccgctccctccctcagccccgtccccgtccgactcggaccgatg

SEQ ID NO: 8631 - DNA, 203 bp, Homo sapiens
ggcgcgccagtcctttaggaattataatactaggatgactgccctcaccaacaatgtccccgccccccgtcccgagcccgttgtcctgtatatctatggtccccctggtactggaaaatctctgcttgctaccctccttgcttcgatttttgcttaccacctttccggtgatccgaacgatgtcttttcgactcggaccgatg

SEQ ID NO: 8632 - DNA, 203 bp, Homo sapiens
ggcgcgccagtcctcgcaacctcctggaagttatgagtactttgatggataccatggtcaatctgttcacattgtggatgatattggccaggcggtcgatggatccgactgggttcatttcccgcaaatggtgtctacctcacccttcaagccccccatggcggcgcttgaagataaggggatgctctcgactcggaccgatg

SEQ ID NO: 8633 - DNA, 203 bp, Homo sapiens
ggcgcgccagtcctacttcacctccgattgtcctttccttaggttagaaacttgtaggcttactgtagatatggccaatgtaggagataaaatggatttcaaatttaggcacgtagatcaaattgtagatgaggttctcttgatgattcaggctaaacaccataatatcaatacctttaaacacttgacgactcggaccgatg

SEQ ID NO: 8634 - DNA, 203 bp, Homo sapiens
ggcgcgccagtcctatgaggatgtgcaagtgcaatcctccattccgactgaagtcgaggaagcgattcgtgaaaacaaaccgctttctttcgtccagaaggtatggagttggcgcaagcccatctttgtcggtaccgctgttctgtccatgattacttctttgtctgtgctcttctctctgacctatacgactcggaccgatg

SEQ ID NO: 8635 - DNA, 203 bp, Homo sapiens
ggcgcgccagtccttgtgtggtgccccccttgttctttccactcctgctggccctcgccttgtcggtgtacatgtagccggtgtcgctggcgttaccggttacgccgatccacttgtggatcttctgcacgccttcaaggatgctatgccccaatccctaattgtagacattccccgctctggccctccgactcggaccgatg

SEQ ID NO: 8636 - DNA, 203 bp, Homo sapiens
ggcgcgccagtccttcgctggtagaatgatctttggccaactttttgccctcttccattccaatcctggtatgtttggctctgctgttggttgtgaccctgattttcattggactcccttcgcccattcctttaaacccttccggaatgtgtggtctcttgactattcctgttttgattctaccctcccgactcggaccgatg

SEQ ID NO: 8637 - DNA, 203 bp, Homo sapiens
ggcgcgccagtcctcctctatcttcaattcgatgatcaataacatttgtgtgttgtctgccctcatctcccgtcctgactttgttcccacccctaacaattataggattcttgcttatggtgatgatgttttgtatgcttgtaccccagacttccacccccgtgatcttaaggctttctatgataaatcgactcggaccgatg

SEQ ID NO: 8638 - DNA, 203 bp, Homo sapiens
ggcgcgccagtcctggaccccgctgcaagtgacccctgctactaaagaaggtgatttccctaactcctcttctctctctgatgtcacttttctgaagcgatggtttgtcccggatgaaactatcccttactactatcaccctgtgattgagcccgatacttatgaacagagtgttatgtggtctagggcgactcggaccgatg

SEQ ID NO: 8639 - DNA, 203 bp, Homo sapiens
ggcgcgccagtcctgtggcgaatttcaggataccgtcacttctctctgctttcttgctcaccacgctggtccccgcaactacaccaattggattgctgccgtccgtgatgcttgtaaacgcaatggctatgaccctcccattttcttagaatattcttatcttcagatgcgctggatgcaacttgtgtcgactcggaccgatg

SEQ ID NO: 8640 - DNA, 203 bp, Homo sapiens
ggcgcgccagtcctctggctaactgcctaggcctgcttggcagtataataaatcaggtgctctggccgagctaaatggctagttgtaggacttacaacctgcacctagggccgccgccatctgggttttcactcaggtggtacctcccatgcggtatctcatactcctaggtctatcccaatgagttccgactcggaccgatg

SEQ ID NO: 8641 - DNA, 203 bp, Homo sapiens
ggcgcgccagtcctagaaagtgtggttgtcccaatgcttaagccacatttaaacgctcattgggaagagttacctagggagcctgtatgtgttgtaggttatgagatttgttcaaaatgtagcatacaggataggtgttttagaacagtcgattggttacgtccccaagatgtagtgtgtaattcatgcgactcggaccgatg

SEQ ID NO: 8642 - DNA, 203 bp, Homo sapiens
ggcgcgccagtcctcagtgcggcttcacctaaatgtggtgaagagatggatacagaaagtagttgtgtccgagaagaaggtgaaatggatgtagattatagtgatcctttatctttgttatatgaaggaattcgtcacaattatatccccccagttgattatgagtatgaatgtggagatgataaggtcgactcggaccgatg

SEQ ID NO: 8643 - DNA, 203 bp, Homo sapiens
ggcgcgccagtccttatatgtactgtagtttgtggaggtatgcgttttgctgctttgggtgattctcattctgaagctcaagtgaatgctgttaaaaatttcttatctgttgttggtcatattatttgtcctgaaacccacatgtttgctttatctactatacctcaacgatcgagtgaatccttggacgactcggaccgatg

SEQ ID NO: 8644 - DNA, 203 bp, Homo sapiens
ggcgcgccagtcctcatctcttcaacattagcctcatttaagaatgttttagataagatttatgcatggcttccttctactaacccagacattattgcattagttaaggatatttttgtttcgcttttctttgctataatcactcgatctcttacacctttggttcaaggcatatctagttatgctttcgactcggaccgatg

SEQ ID NO: 8645 - DNA, 203 bp, Homo sapiens
ggcgcgccagtccttgcacctcgctctatccatagtgctgatgcctttttgcgtaggttggatatacaagtgcgtgtggatgtagatagtaagtttgctcggtatgtacccagcgtggcagctcagcggaaagttccagatgaaagtaaaatttggttgcatcagaatcctggtaaaacattgctagacgactcggaccgatg

SEQ ID NO: 8646 - DNA, 203 bp, Homo sapiens
ggcgcgccagtccttaagactgaagttccactccccgacttacctagtgaattggaagagtatgcaggagctttccctgcagcgcacggttcagcgacaatgtgctttgctactgactggttgggacagttcactaatctgaccgagtccctgaatttattgaacaaaacatttagccctcgtttcgtcgactcggaccgatg

SEQ ID NO: 8647 - DNA, 203 bp, Homo sapiens
ggcgcgccagtcctttgtaaggtaaaggcattgttgtctgaaggtggttcattgatgcaattagtaggtgctcgatcgtgtgtgttcgcgtgtgatttgtgcaagcgcgttaagaaaggtgatttaaatttgcgtgttcgtagtagatctgatggaaccataacctttgtgccgagtgacgttcgtcgcgactcggaccgatg

SEQ ID NO: 8648 - DNA, 203 bp, Homo sapiens
ggcgcgccagtcctaagtccaggtaaaccaggaaaacagacgtggctaggttcaggtgagttcatagtagataatgtggaccttaaaaaacatgttgatatgatagttgagaaagcacagaatggtgtagttgatgtaggtttaggtgtttttgcagcgaccttgaaggatgagcgtcgtcctttggacgactcggaccgatg

SEQ ID NO: 8649 - DNA, 203 bp, Homo sapiens
ggcgcgccagtcctgaaagtcgctgcaaataagactcgagtgtttgctgcttctaatcaagggttggctttggccattcgtagatattatctagcatttatggaacatgttatgactaacagaattgataatgaaattggtttgggagttaatgtttattcttatgattggacgcgtattgtgaataacgactcggaccgatg

SEQ ID NO: 8650 - DNA, 203 bp, Homo sapiens
ggcgcgccagtccttgtcttttatggtgatgattcattgtgttgtgtgtcagataaggtgtgtgagtggtttaatcagcatgtcatcacccgtttaatgttggtgactggacatgattacactgatgaaacaaagagtgggtctccacctccttatcgctctttgtctgaagtgtcgtttctaaagcgcgactcggaccgatg

SEQ ID NO: 8651 - DNA, 203 bp, Homo sapiens
ggcgcgccagtcctatggtttgttattcaacgtgcgtgtaccccaggcagccccgaaaacacgcgtcaggagacagttccaaccactttgggcgaagttggtggctacgcttgcgtagtggaacttatttattgcctgctattcctactgaaattaataatgatacttcttcctcttctgctggacttcgactcggaccgatg

SEQ ID NO: 8652 - DNA, 203 bp, Homo sapiens
ggcgcgccagtccttggcagactactgataaagagattgctcccactatgtctcatagtgaactagtatcagatttcaatcagcctttccttaaagaaatttctcttccggatgatattgtgcgtaaatctccttttatgtccgctaagcttgcaaatattgcttttgttcgcagtgattatgaaattcgactcggaccgatg

SEQ ID NO: 8653 - DNA, 203 bp, Homo sapiens
ggcgcgccagtcctggtctggatgaaatgtcgattgagtacctagctctgcgtccctatgtacttcagcgttacaccatcaaaggtggtgatacgcctgatcctactaaaactgtcatagctgatatccccattagtcctgttaatttttccttgtttggtgctgttataaagaactatcgtactcttcgactcggaccgatg

SEQ ID NO: 8654 - DNA, 203 bp, Homo sapiens
ggcgcgccagtcctcttgtgaccaatcatcctattatttctgaaccgattggaccttcttatgtggcgcaagatttttcatccggagatactattattattgctcaggataccctcgttacttgtgcttttgcccagtcgaccaccaatttcagtgtttctttaactaaagaggatgtttcaaccaatcgactcggaccgatg

SEQ ID NO: 8655 - DNA, 203 bp, Homo sapiens
ggcgcgccagtcctcgtagatcaagtccagttgatattgttcgtggtgcttctgttaccttacctggtatcaatttcggcactgacaattcgctgcgacagagtttggtgaatgtaatttcctatatgtaccgttttactcatggaagcatttcttataaaattatacctaaagagaagggagatctgcgactcggaccgatg

SEQ ID NO: 8656 - DNA, 203 bp, Homo sapiens
ggcgcgccagtccttacatcacgactgttagcccagatgtggtggagaagaatcctaatgcttatcagtttgatactaatcgtgctatgcactttatcaatacttctttgaacccaattgcccaagtcactcttcccttttatagcccggcagagaacttggtattggattcgcgctcttttccccaacgactcggaccgatg

SEQ ID NO: 8657 - DNA, 203 bp, Homo sapiens
ggcgcgccagtcctttgagtgatctagtcattggcaatttagacaggtctgaaaatgaatattttgttcttgctagtgctggtgatgatcatactttttctcaattggctggatgtcctgcttttacttatgggccatccaggacttaaatctccgatgggagtgcaccctatgggtgtttgacccgccgactcggaccgatg

SEQ ID NO: 8658 - DNA, 203 bp, Homo sapiens
ggcgcgccagtcctggaattgagtgtctggtacactctgtgtaacagtgaaaacaatgtgatcacttcggtgagctagtagcctgtggaccaacaactggtaacagttgcctcaggggccaaaagccacggtgtttacagcaccctactggtttgattggagcaatccaagatgtcacagagttagtacgactcggaccgatg

SEQ ID NO: 8659 - DNA, 203 bp, Homo sapiens
ggcgcgccagtcctattgccaagcagtccgtactggtatcttgacataccgtgcagttttggatagtgaaggatgccctgacggtacccataggtaacaagtgacactatggatctaagcaggggctcactctacgctgctttacagctggctgtgagttaaaaaacgtctagctatccacaacctagcgactcggaccgatg

SEQ ID NO: 8660 - DNA, 203 bp, Homo sapiens
ggcgcgccagtcctaattcaacacgctttcatggtggtgctttgggtgtttttatggtgccacagtttgtttacactagccaaactgatttgactggaccaaaacccttgatggcaacagattatccacttttcaaccagcaacagttgtttctgtttccacaccaaatcttgaatcctcggactaatcgactcggaccgatg

SEQ ID NO: 8661 - DNA, 203 bp, Homo sapiens
ggcgcgccagtcctcagggtgaggacacccagataacacctgccgaaactgggcagactcctgaggttacagctgaaaattccaaccagaatgtggtgccaattccatacgcacctcagaggatttcacatagcgctgtgcgcttttggtatgacagatttttcttagctgacagccttcaggtcaaccgactcggaccgatg

SEQ ID NO: 8662 - DNA, 203 bp, Homo sapiens
ggcgcgccagtcctatagttaaatggctgccgagccactgcaggacacaaccaccacctttcccctcttcagatgaaaacccagatgatggaagtaaagatattaagaaagaaagtgcctctagtggcttcagcctgctagttgtctttaaaaattcttctaaacctctttcagtgaattcaggtgaccgactcggaccgatg

SEQ ID NO: 8663 - DNA, 203 bp, Homo sapiens
ggcgcgccagtcctatcaaacctaaaacagatgatgtgccattgattgatttgaccaacatggggccaaagattgactaccccggctcccataatccatttggagaatcactggccgacaagctggttcaggaaaatgagagattagttgctgaagcgcaggctgagtatgcacgccgtagtgctaatcgactcggaccgatg

SEQ ID NO: 8664 - DNA, 203 bp, Homo sapiens
ggcgcgccagtcctggagtttggaagcaacaagaagaagatgcctccgaggaacgctttagggaaagaatgcaagtgtaccctcagatgatggaacagtatgaacagtacaagaattctcctagacaccagaaatggaatgactgcaagacatggtttgatgagatgcggaaacttgcagtattgcatcgactcggaccgatg

SEQ ID NO: 8665 - DNA, 203 bp, Homo sapiens
ggcgcgccagtccttgttcagcacccctccatatggtgaaagctgacatacatttgttctctagtgcgtgcttgaagtttaaagaccgcatggctagatgcgagtgtagtttggttggagtctatgatagggtgatgaactctcacaaaagaaggaatgatttggccaataaattagttgaaatttttcgactcggaccgatg

SEQ ID NO: 8666 - DNA, 203 bp, Homo sapiens
ggcgcgccagtcctcttgcagtgcgtggcaggctggttgtaatgaacttccacttgtggaatgatgcaacacacctgcagcttgatggagaatggatgccacgtgacaccatacccgcagtgagacccgctgcaaacggcatccccacagaacttgtcttcatgaactgggcaaaaaccccaggaaggcgactcggaccgatg

SEQ ID NO: 8667 - DNA, 203 bp, Homo sapiens
ggcgcgccagtcctgtactgaagtataaagcccaaacagcaccagggttttgtggcagtgttgttgttgttgacaacggcatctggaagaaagtatttggattgcattgtgctggagcacatggtgttgggatggcagcaattatctcgcgcgagatggttgatgctatttcacagcttgctgaattccgactcggaccgatg

SEQ ID NO: 8668 - DNA, 203 bp, Homo sapiens
ggcgcgccagtcctcacgttggtgaccgtactgatggaccattagccatgattagaggagcccgcttttatgcacgacttgtgcgagcaaagtgtggacaggtgaatgaacgactgtcgctgcacgaggcagtctttggaacagacaaccttgacccaatggaccagacgcgctctcctgggtggccgcgactcggaccgatg

SEQ ID NO: 8669 - DNA, 203 bp, Homo sapiens
ggcgcgccagtccttacatcggtaccaagagacgcccagacctgctttggcagacggatgaaggcttggacatggatccggtgctgcgtgccgaactgatgctcatgatggaaggaaatttttcccaccacaaatttgttacctttcttaaagatgagctcagggacaaagaaaaagtgaaacaaggccgactcggaccgatg

SEQ ID NO: 8670 - DNA, 203 bp, Homo sapiens
ggcgcgccagtccttttgttgatgtggattattcgggatttgatgcaacacactctaccttttcctttcaatgcctgaaaatttttcttcaggagcttggatttgatgatgtggccttgaaatatgtggattctttgtgtgattcaacccacatttgggatgatgagatttttaaaatttcaggaggacgactcggaccgatg

SEQ ID NO: 8671 - DNA, 203 bp, Homo sapiens
ggcgcgccagtcctactgtccaggagaagctgttgtccgttgcccgcttggcgcaacatcgtggcgagcaggactacaaggctcttatggaaccttttgagtcttgtggctattttgttcctagctttgatgaccttgaacttgagttcttttctcttttctttggttgagttaggtgatggagttttcgactcggaccgatg

SEQ ID NO: 8672 - DNA, 203 bp, Homo sapiens
ggcgcgccagtcctaggacataggacagatgttggatggactcaacaagagaggaaagaagaaaagaggaggaagcactggtggtttgcttttgattattagcttctcatgtgcgtgtgcccttaaggtgggatcgtacaatggaaagccgctgatcactgtaaaccaaacggacgtgcagaacccaacgactcggaccgatg

SEQ ID NO: 8673 - DNA, 203 bp, Homo sapiens
ggcgcgccagtcctgcacgccgacgagacatgccagacggtcaagaagagcgatcacagtccatcatcatggcgaaagcctattggaagcgaagaacacaccatggatggactcaacaaaagccacaaagtacttgactaaggttgagaactgggctattcgaaatccaggatacgctctagccgcagcgactcggaccgatg

SEQ ID NO: 8674 - DNA, 203 bp, Homo sapiens
ggcgcgccagtcctgtgtgactataacggcgaaagacaaaccaacaattgatgtcaaaatgatgaacatggaggcaactgacttggccctcgtccgctcttattgctatgaacccaaaataaccgatgtcagtacagagccacgctgcccaaccatgggagaggcccacaatacaaaggcatccagtccgactcggaccgatg

SEQ ID NO: 8675 - DNA, 203 bp, Homo sapiens
ggcgcgccagtccttgaccatgaacatgaagagctggctagtgaacagagactggttccatgatttaaatctgccatggaccggttcagcagcaggaaattggcaaaatagagagtcactagttgaatttgaggaggcgcacgccaccaagcaatcagtggttgctttggcctctcaagaaggagccccgactcggaccgatg

SEQ ID NO: 8676 - DNA, 203 bp, Homo sapiens
ggcgcgccagtccttgcacgcggcactggccggagcaattcctgtgaagtacacaagcagcaagctggaaatgacatcaggacacttgaaatgtagggtaaaattgcaaggattgaagttaaaaggaatgacttacccaatgtgctctaacaaattcagcctagctaggaatcccacagacacggggccgactcggaccgatg

SEQ ID NO: 8677 - DNA, 203 bp, Homo sapiens
ggcgcgccagtcctcctttggcgactcgttcatcctagttggtagtggagaaaatcaaattaaatatcagtggcataagagtgggagctcaattggtaaagcatttgtttccaccctcaagggagcccagcgtatggtggcacttggggatactgcctgggatttcggatcagtaggaggtttctttacgactcggaccgatg

SEQ ID NO: 8678 - DNA, 203 bp, Homo sapiens
ggcgcgccagtcctggaaaggaatatgtggagtcagatcagtgagccggttggaacacaacatgtgggattcgatcaagcatgaactcaatgccattctggaagacaacggggaggatttgacagtcgtggtggaaccaattgtgggacgtctcaggtcgacacagcgaagattgacgtggacggaagcgactcggaccgatg

SEQ ID NO: 8679 - DNA, 203 bp, Homo sapiens
ggcgcgccagtcctaagagttggaatatggatggaagaaatgggggaaaaccctctttacgagtccaggcatgtcaaacagaacttttgtggtggatgggccaaaaacgaaagagtgtcccgatgacaagagagcttggaacagcttgtacgttgaggactttggatttggcatcacatccactagagcgactcggaccgatg

SEQ ID NO: 8680 - DNA, 203 bp, Homo sapiens
ggcgcgccagtcctcaacagtgaaagtgacttcgacctgccatgacagggcagcatcagctcgaaccaccactgccagcgggaagctcattcaagactggtgttgcaggtcatgcacactcccaccattgagatacatgacaaaaagtggatgctggtatgccatggaaatccggccgacaacacacgcgactcggaccgatg

SEQ ID NO: 8681 - DNA, 203 bp, Homo sapiens
ggcgcgccagtcctgtgaggacacccttatcaagtctaaggtgagcgcattcagaggcgatggcatggaaccatttcaactgggggttctcttgatgtttgtggccacacaggaagtcttgcggaagagatggacagcaggcatggcattaccagcaatgctcatgtttttatgtgctttgatctttgcgactcggaccgatg

SEQ ID NO: 8682 - DNA, 203 bp, Homo sapiens
ggcgcgccagtcctttttggttggaattgccctttcaatgttgaccttggccatgcaagattgggacatgacaatcccgagcctgcttaactcgggagcggccgcttggttgctgctgagagctgtgagtgagggaacagtaagtgccgtctgcattccagtgctgggcatgctggctcctggacttccgactcggaccgatg

SEQ ID NO: 8683 - DNA, 203 bp, Homo sapiens
ggcgcgccagtcctgcatcgcgggaattgacgtggttcgcataggattgctgatcatagggattatgtcgctgatgagggaacgcaacaatgcagcagcaaaaaagaaaggaggattgttgataggactggccctagcagaatctgggttgatcagccctcttgtttatgccggactaaccttggcaccgactcggaccgatg

SEQ ID NO: 8684 - DNA, 203 bp, Homo sapiens
ggcgcgccagtccttaaaaccaaacatgaggagaggatggccggtgagtgaagcactgacagccgttggattgacgttcgcactggctggtggcatcgcacattttgatgaaggaaatatggccattccgttagcagtgggcggcataatgttggttgtggcagttgtgacagggttcacaacagatccgactcggaccgatg

SEQ ID NO: 8685 - DNA, 203 bp, Homo sapiens
ggcgcgccagtcctacaacccttatctccttccagtgacgttgggagcttattggctcacagtcaaggctccgaaacgtagcggagcgatttgggatgttccagcaccaaaggaaagaaggaaagcagaaattagcacgggggtgtttagaatcatggccagaggaatttttggaaaataccaagctgcgactcggaccgatg

SEQ ID NO: 8686 - DNA, 203 bp, Homo sapiens
ggcgcgccagtcctggttgttaacaccacaaagggtgcctaactacaacttattcgttatggatgaagcacatttcactgacccagccagcattgcggctcgtgggtacatttccacaaaagttgacctaggagaagcggcagccatattcatgactgcgacaccaccaggaacgagagatgcctttccgactcggaccgatg

SEQ ID NO: 8687 - DNA, 203 bp, Homo sapiens
ggcgcgccagtcctaattaaatgggccagttcccatcacagcggctagtgcagcacaaaggaggggaagagtgggcagaaatccagtgcaagttggggatgaataccactttgctggaccgaccagtgaggatgatcacgatttcgcccattggaaggaagcgaagatcttgctagacaacatcaacccgactcggaccgatg

SEQ ID NO: 8688 - DNA, 203 bp, Homo sapiens
ggcgcgccagtccttaccaaacggactggtggcgcaattgtatgagcctgaacgagagaaggtcttttccattgatggggagtacaggctgagaactgagcaacggaaaaactttgtagagttcttgagaacgggagacctgccagtttggatatcgcacaaactggctgacgctggaatagcttacacgactcggaccgatg

SEQ ID NO: 8689 - DNA, 203 bp, Homo sapiens
ggcgcgccagtccttaggaaaagggatgccctttgtgtccatggacctgtcagtgcctcttcttttactcggatgttggggacagttcaccatgaccaccacactcacgacaatcgtgttgttgattgtgcactatgcattcctcgtgccaggatggcaagctgaagcaatgcgtgcagcgcaaaggacgactcggaccgatg

SEQ ID NO: 8690 - DNA, 203 bp, Homo sapiens
ggcgcgccagtcctggacagctgctggagtgatgaagaatccagtggtggatggaatagtcgccacagacatacctgatctagacgccagtactccgattacagagaagaaattcggccaagttattctaatagttgtgggagtctgtgcagttttcctaaaaccagggaccatgtcgctaacagagtcgactcggaccgatg

SEQ ID NO: 8691 - DNA, 203 bp, Homo sapiens
ggcgcgccagtcctccgcaaaactacggtggatggtcgagagaggttttgtgaagccacacggaaaggttatagacttgggctgcggcagaggaggctggagttattactgcgccaccttaaaattagttcaagaggtgaagggttacacaaaagggggaccaggtcatgaagaacctgtgatgatgccgactcggaccgatg

SEQ ID NO: 8692 - DNA, 203 bp, Homo sapiens
ggcgcgccagtcctgagttgaagatttctgtgtaaaaattctttgtccatacatgcccaaggtgcttaaagagctggaaaagatgcaattaagatggggaggtggcctgatccgggttccactttcgaggaattccaaccatgagatgtactgggtgagtggagccagtggaaacatcacaaattccgcgactcggaccgatg

SEQ ID NO: 8693 - DNA, 203 bp, Homo sapiens
ggcgcgccagtcctccaccacatggcactatgactcggagcacccttacaaaacttggaactatcatggaagttatgaagtcaaagcgaccggatcagctagctccatggtgaatggggtggtccgggtgctctcgaaaccatgggacacactgcagagtgtggtgaacatggccatgactgacacaacgactcggaccgatg

SEQ ID NO: 8694 - DNA, 203 bp, Homo sapiens
ggcgcgccagtcctgtgaatttggaaaagcaaaaggtagccgggccatctggtacatgtggttaggttcaagatatcttgaatttgaagctctggggttcttaaacgaagaccattggatgagcagagagaacacacttggaggagtcgagggcttaggcctgcagaagcttggatacgtgctgagagcgactcggaccgatg

SEQ ID NO: 8695 - DNA, 203 bp, Homo sapiens
ggcgcgccagtcctaagtaatgagaccaggagctgatggcataacagtgatggacgtcatctcacgggaagaccagagagggagtggacaggtggtaacatatgcactcaacacgttcaccaacctttgtgtgcagctcatacgatgcatggaaggagagggtttgctgaagccagaggaggtggagacgactcggaccgatg

SEQ ID NO: 8696 - DNA, 203 bp, Homo sapiens
ggcgcgccagtcctttgttttagaccttagaagatagatttagatttattttagggcgatagtcaggccaggcaatgcctgccaccggaagttggatgacggtgctgtctgcgctccaaccccaggcggactgggttaacaaagtggtgatccaggagacgcaaagcgttcactaccgtttcggagaacgactcggaccgatg

SEQ ID NO: 8697 - DNA, 203 bp, Homo sapiens
ggcgcgccagtcctctccctggcgttcgaatggaacactgcccaaagtcaggccgtaggttttacgccactagcatgcagtgctgcctgagacaagacatgccccaggaggactgggaaaacaaagccgttaaggcccccgcggcccaagcaagggaatggtgtgccccttgtggaaggtctagaggtcgactcggaccgatg

SEQ ID NO: 8698 - DNA, 203 bp, Homo sapiens
ggcgcgccagtcctaaaacaaagccgttaaggcccccgcggcccaagcaagggaatggtgtgccccttgtggaaggtctagaggttagaggagaccccgcggaaatcaaagcaaggcccaacctggcaaagctgtaaaccaggggaaggactagaggttagaggagaccccttgcgagtgaacaccaccgactcggaccgatg

SEQ ID NO: 8699 - DNA, 203 bp, Homo sapiens
ggcgcgccagtcctagaacagtcgtcagtagttcaacgctggtaaaccccagccttgagatgctacgtggacgagggcatgcccaagacacaccttaacctggacgggggtcgtccaggtgaaagtacccatctttgggtgctgggagtacagcctgatagggcgctgcagaggcccactgacaggctcgactcggaccgatg

SEQ ID NO: 8700 - DNA, 203 bp, Homo sapiens
ggcgcgccagtcctatgacaggggtaggggggaggtgaggacaactctggaaaaacttccacgtaagggagattgtaggagtggcaatcaactaggaccggtaagtggaatttacataaaaccaggtccgatttactaccaagattatgcaggcccagtctaccacagagcaccattagaactatttgcgactcggaccgatg

SEQ ID NO: 8701 - DNA, 203 bp, Homo sapiens
ggcgcgccagtcctgggatagaccaacaaccctaacggggtgcaagaagggtaagaagttttcttttgcgggtatcattatggagagcccctgcaacttcaacgtctctgcggaggacatcttatatggggataatgggtgtggtaacctcttccaggacacggctttgtacgtcgttgacggagtcacgactcggaccgatg

SEQ ID NO: 8702 - DNA, 203 bp, Homo sapiens
ggcgcgccagtccttatacttggttcttcatttcaccatcccccagtcttatgagaaccccaaagactgtgataagaatcagttaaacctgaccattggtcttagaacagaagacgtcgtgccctcatcagtctggaacattggtaagtatgtttgcatcaggccggactggtggccttacgagacaacgactcggaccgatg

SEQ ID NO: 8703 - DNA, 203 bp, Homo sapiens
ggcgcgccagtcctgggcgcaagggcaatttacttgtgagaaaaactataggtatgctatagcaaaaacaactgatgtggggttgcttggtgctgaaggcttgaccaccacttggagggaatacaaaaacaattttgaacttgatgatggattactgagagcagtatgcaaatctggtttcttcacttcgactcggaccgatg

SEQ ID NO: 8704 - DNA, 203 bp, Homo sapiens
ggcgcgccagtcctggaagtataacgcaacccttctgaacggtagtgctttcaatctcgtttgcccaattgggtggactggggtagtggaatgtacagtgataagtgagtccactctgcacaccgaagtcgtgaaggtgttcaggagagataagccattcccatctaggaaatactgtgttgacaccacgactcggaccgatg

SEQ ID NO: 8705 - DNA, 203 bp, Homo sapiens
ggcgcgccagtcctatgaaactggatatagactggtggatggaaccacatgtaacagacatggggtgataatagaccagacaggtagccatgagtgcctaataggcaagaccaaaataaaagtgtatccagttgatgacaaactggggccaatgccttgcagacctaaggagattatatccagtgaagcgactcggaccgatg

SEQ ID NO: 8706 - DNA, 203 bp, Homo sapiens
ggcgcgccagtcctctgttggcatagtagtgtcgatgctgattgccagaagagaccccacgacaataccacttataataactgttgtaaccttgaggactacggggctggcaggtgggctagcaacagacttggccatagcgaccgtaacaacagtgctactaatgtggaccttcattagtgattactcgactcggaccgatg

SEQ ID NO: 8707 - DNA, 203 bp, Homo sapiens
ggcgcgccagtccttactagagatatcctactatctccacaggaagatcatagaagaagttgcagggggaacaaacttgctatccagatttatggcagcattgatagagactaactggactcttgataacaacgaggtcagggggttaaaaaaattctacctactatccagcagagtcaggagccttacgactcggaccgatg

SEQ ID NO: 8708 - DNA, 203 bp, Homo sapiens
ggcgcgccagtccttgcctagaggtacgacaccaagggcaccggtgaggttccctacgtcactgctgaaaatcaggagggggctagaaactggatgggcgtacactcaccaaggcggcatcagttcagttgaccacgttacatttggaaaagacctgcttgtttgtgattccatgggtaggacaagggcgactcggaccgatg

SEQ ID NO: 8709 - DNA, 203 bp, Homo sapiens
ggcgcgccagtcctccacagatttaacagacttggtgaggaagataacagctatgaatagaggagaatttaaacagataaccttagcaacaggtgcaggaaagaccactgagctccctaggtcagtcatagaagaaataggtcggcacaagaggatactcgtcttgatcccactaagagcagcagcagcgactcggaccgatg

SEQ ID NO: 8710 - DNA, 203 bp, Homo sapiens
ggcgcgccagtcctagtctgtataccagtatatgaggcaaaagcaccccagtatatcattcaatctgagaattggcgagatgaaggaaggagacatggctactggtataacctatgcttcttatggatacttctgtcagatgcctcagcccaagcttagagcagccatggttgagtattcttacatctcgactcggaccgatg

SEQ ID NO: 8711 - DNA, 203 bp, Homo sapiens
ggcgcgccagtcctggctggcttttgggggggagacactgtccgaccatataaaacaagctgccactgatctagtagtctattatatcatcaatagaccccagttcccgggggatactgagacccaacaggaagggaggaaatttgtggctagcctcttggtgtcagcccttgctacatacacgtacacgactcggaccgatg

SEQ ID NO: 8712 - DNA, 203 bp, Homo sapiens
ggcgcgccagtccttattaggcactggagttagcgcagcaatggaaataatgtcacaaaatcctgtatcggttggaattgctgtgatgctgggagtgggtgcagtggccgcccacaatgccatagagtcaagtgaacagaaaaggacactattgatgaaagtatttgtaaaaaactttcttgaccaggcgactcggaccgatg

SEQ ID NO: 8713 - DNA, 203 bp, Homo sapiens
ggcgcgccagtcctctgccactgatgaattggtgaaagagagccctgaaaagataataatggccctgtttgaagcagtgcaaacggtaggaaaccctcttaggttgatttaccatctgtacggggtcttctacaaaggatgggaagctaaggaactagcagaaaggacagcaggaagaaacctattcacgactcggaccgatg

SEQ ID NO: 8714 - DNA, 203 bp, Homo sapiens
ggcgcgccagtccttggccgaggtggaagtagacctactgagatacgtggactacaaaggtacattccttactagagagaccctggaggctctaagcctggggagaccaaaaccaaaagatctaacgaaagcagaagcaatgaggttgctccatccggaatcagggctggtagagttgcctgactggtcgactcggaccgatg

SEQ ID NO: 8715 - DNA, 203 bp, Homo sapiens
ggcgcgccagtcctttatgcaagtagagaacaagcacaacaacttgacccctctgttcgaagagctcatgcttcgatgcccgcctgggaaacagatgaggtccgagcacatggtcaccgcataccaattggcccagggcaactggatgccaaccagctgtaatgtattcttagggacaataccggccacgactcggaccgatg

SEQ ID NO: 8716 - DNA, 203 bp, Homo sapiens
ggcgcgccagtcctgagtagctgaacagctccagagggaaggccacaagcacaacgtgtacaacaagattataggctctaccatgacggcagtggggattaggctagaaagattaccggtagtgagagctcaaactgacaccaccagtttccaccaggctataagagataagatagacaagagggaaacgactcggaccgatg

SEQ ID NO: 8717 - DNA, 203 bp, Homo sapiens
ggcgcgccagtcctacttgcaaaccccaggcctacacggcaagctgctggaaatattcaacaccctgaagaaaaatgatttggcacaaacatatgatgctgtagaatgggaagaactagaacgtggagtaaaccgaaagggtgctgctggattcttcgagcataaaaacataggagaagttttgaacacgactcggaccgatg

SEQ ID NO: 8718 - DNA, 203 bp, Homo sapiens
ggcgcgccagtccttcagactggcaatcacaaaagtgatgtataagtgggtgaaacagaagccggtggtaatacctgggtatgaaggcaagacgcccttgtttgaggtctttgacaaggtaaagaaagagtgggaccagttccacaacccagtggccgtaagttttgacacaaaagcatgggacacaccgactcggaccgatg

SEQ ID NO: 8719 - DNA, 203 bp, Homo sapiens
ggcgcgccagtccttggcaaccaggttggactctagtggagaaagagggacaacggcatatgaaaaagccgttgcgttcagttttctattgatgtactcatggaaccccttggttaggaggatttgcttgctcacgttgtctactgagccagaagtgaagccaagcaaggcgacaacttattactacgcgactcggaccgatg

SEQ ID NO: 8720 - DNA, 203 bp, Homo sapiens
ggcgcgccagtcctaaatcccggccgcgtgttgtgattgtgttagggcaggtgacagtcggcagggtcgaccccctgcttcaggaccactgtcttcctggacgaccgttgctgaaaaagggccgccacggtctgtagctcgccgacgcttctaattcaggccggaggaccacgctccgtaatcgagcccgactcggaccgatg

SEQ ID NO: 8721 - DNA, 203 bp, Homo sapiens
ggcgcgccagtcctcaagtactcaaaccccagcacccctgggtcacgccctacgccgcccttttaacgcttcggctaatagggtctatccggcgggttgacaaagggcgcagggttacctggtactacgagcttgggtgtccctgggagtaatcccagggtgccatgctgcagcgcaggcgggcgaggcgactcggaccgatg

SEQ ID NO: 8722 - DNA, 203 bp, Homo sapiens
ggcgcgccagtcctgtggtgcctcggcctaggggaagagcgcaagtgaccccgtgctgcataaatccccccccttttttctacatgggtgttccatgtgccgccaagatggcgctgttgttgcttttcctggccggcgtggctgctgccccctcgcatctctgcgagtgggaaggcaaaccttacttgcgactcggaccgatg

SEQ ID NO: 8723 - DNA, 203 bp, Homo sapiens
ggcgcgccagtcctcattcatggcttgcttacgttgcaggtgttgggggcgtcggggagctgtatggcgcggggctcatcgcgggtctcgctgctgtttcagctgtcccggcttctactccccctttaaactgctctgttgagtgcgcttgggggtatgaggtaatgcttggcccggtcaggtcctggcgactcggaccgatg

SEQ ID NO: 8724 - DNA, 203 bp, Homo sapiens
ggcgcgccagtcctctccttgagcttggttcctcttccgggttttggctgcttcagcttcctggcgctctctggtcttttgttgcaagtgttagtcctgtttttcttgttctgttggccttgctcttcttggaggggcgctggcctctaattgtagctcttgtcgccatccggttgctagtttgcccgcgactcggaccgatg

SEQ ID NO: 8725 - DNA, 203 bp, Homo sapiens
ggcgcgccagtcctgcatctttgcgcatgggagagaatgagtcttgcatttgtggccctaaaatttctgaccatctacgagctatccaatatgtcaactacactcctggccttcgcatccagctgcgtgcgtccccccaggttgcgttacacggagcgcttgttccgttgacgctgacctacgggccgcgactcggaccgatg

SEQ ID NO: 8726 - DNA, 203 bp, Homo sapiens
ggcgcgccagtcctctcaggggtggtattgtttgggcttaccctcttgatggcatggcttggttccctgtggaatccttttctgttcctcccaccggttgggactgcactgtcaatactgattatcagttttgggagtgcgtcgactccacacgataccggcgggctatagtgtgccgtgcattcacgcgactcggaccgatg

SEQ ID NO: 8727 - DNA, 203 bp, Homo sapiens
ggcgcgccagtcctaccactacctccagtaacacctcttcccctacccaactttgctttgactatgtcggcccatcccaggatccttgcaagatctatgcttggcaaaacatctctgcttgctttcgaagaggctggggcaacctgacctctgcgtttgctggccttgctggggtgccgggtgccttgcgactcggaccgatg

SEQ ID NO: 8728 - DNA, 203 bp, Homo sapiens
ggcgcgccagtcctttggctatcctcgccatcgcggttcttggtcggccggggaggtctgccttgggcttggaggtgtgctttgatgtgtcagggcccgggtgggatgtgccggatggaattctaccatggtgctttgctggtgttgtgtccgggctgttaattcacctggccacattcaaccactggcgactcggaccgatg

SEQ ID NO: 8729 - DNA, 203 bp, Homo sapiens
ggcgcgccagtccttattgctttgttgctatttgctttgatctctttgatatgttccttgaagcttgcctctgttctcaaccctctgtgtcgagtgtggctgctcttttggaggttgccgcgcgcgcccgcagcagtagtctagttcgctggattattgtgcgggcgcgtgcgaggggtgtgttgctccgactcggaccgatg

SEQ ID NO: 8730 - DNA, 203 bp, Homo sapiens
ggcgcgccagtccttatcaacatcggggtgatgtgccctggagggctgtctcgttcctgaaggaattggagtgcgcgctggagcccgtttctgtctctgctgaggatctggaagtcgtgcgtgacgcggcaggtgtcctggagtgcggtaagttcttcaggggtaagcctgtcgtcgcgcgccgcggccgactcggaccgatg

SEQ ID NO: 8731 - DNA, 203 bp, Homo sapiens
ggcgcgccagtcctgctgcgagccggtctatgggtacctgtgtggggggtgtcatgttcacaacgtggcactcctcgcaggggcgcacattggctggtccgactggtcctctcaatccgcggtggtggtcggtcagtgacgacactgccgcttacccaattcccttaggttccagatgtatggacgtccgactcggaccgatg

SEQ ID NO: 8732 - DNA, 203 bp, Homo sapiens
ggcgcgccagtccttgcacctgtggcacccggagcgcatgggtaatgcgtcgtgatgggggcctagcccatggagagttgtcaccagtgaatgaagtcaggttggatgtctctggcagggtccgtgctttccgcggggcctccggcagtcctgtcatgtgtgaccaggggcacgtggtgggcatgatgcgactcggaccgatg

SEQ ID NO: 8733 - DNA, 203 bp, Homo sapiens
ggcgcgccagtcctgtgtcggtcctccatcgagggcctgatgccttcgctgtccgctatgttgagccctggaaggccttacctgcagatgttcagagcccactgtcccccctctctcctcctccggtcccagcaatgggagcctatgaggagaggtcgctgttcgtgccgacggggtccggaaagtcccgactcggaccgatg

SEQ ID NO: 8734 - DNA, 203 bp, Homo sapiens
ggcgcgccagtcctaccctggtccctgccagttacgccaaggaagggcacaaggtccttgttctaaatcctagcgtggccacgaccgcgtcgatgctcgattacatgaaggagctgactggtgtcagccccagcgtgttttgcgggcacggggcgaacgcgatcacgcggcggacgcagagcaagattcgactcggaccgatg

SEQ ID NO: 8735 - DNA, 203 bp, Homo sapiens
ggcgcgccagtcctgccgtgtcttggtataatatgacctctgaccaggcagcgcgcctcctgcgggcctacgcaggttgcgcgtatacttgtcacatctctacacacattgaggatgccacgcgtgcagttgcggcgctgagcgctttctccacgcaccctcaagtcactcggttgcgcaatgcatcccgactcggaccgatg

SEQ ID NO: 8736 - DNA, 203 bp, Homo sapiens
ggcgcgccagtcctgcgatcgctgaggctcttggtgagagtgtcacggagacggctgctggaccgattctgttggtgggcttggctgcggctgcggccctggccattggggattataccggaagcctggtcgtggtagccgaagtggtggttgagcccggagggaatccagtccccccttctgggccccgactcggaccgatg

SEQ ID NO: 8737 - DNA, 203 bp, Homo sapiens
ggcgcgccagtcctgtgaagaatacatctgttggtcagggcttcctgcgagcgtggacggcgcttacaggaaatatcggccctgtggtgtccctggtgacggcggcgtgggcggcggggcggtcccccccccttgcctgcgcggcctccctcctacttggtctgcaagctgctctcccgctggagacgcgactcggaccgatg

SEQ ID NO: 8738 - DNA, 203 bp, Homo sapiens
ggcgcgccagtcctcgactgccttgcgcaattctggccggggctatcggtacttgtactggtacccccgaagcagggttgggcatgatgggagcgtttatggttggaggtgcagtggggtctcttagcgtcttcggcttcctcttggaggtcttgggcggctgggaggccacagctactactgcttctcgactcggaccgatg

SEQ ID NO: 8739 - DNA, 203 bp, Homo sapiens
ggcgcgccagtcctccaagagggcaagtcctgccagacggatatttccttgaggaggacgtcactgctcgtgcaagcgaactccttaagcggatgtccatctccagggctgtcatgagtgtgctggaatgtgttcatcagcagtatgagactaggacagatggcagtgtgttttggacgatcgttgcccgactcggaccgatg

SEQ ID NO: 8740 - DNA, 203 bp, Homo sapiens
ggcgcgccagtcctgcttgccttgacggtgcgaggcggtttcttgactggatcattgcttatgtgaaggacaggataccatcagtggctatccctctcgtgtcatgtcaacgaggctacaccggcccttgggttggttcgggggcagttacagctaactgcacctgcggagcactcttcacggcgcatcgactcggaccgatg

SEQ ID NO: 8741 - DNA, 203 bp, Homo sapiens
ggcgcgccagtcctaccgttcgagaggcgggagttccgctagatgaccgaggcatgcccgagattatcccccctccccccccaacgcctgcgttgcaggggggtgcggtggctaatactcctgacaatatcttgttggctccacctctatcacaggccactcctcagtatgttaccagaattttcacccgactcggaccgatg

SEQ ID NO: 8742 - DNA, 203 bp, Homo sapiens
ggcgcgccagtcctcatcgggctcttgcggctactggagccctggaggtcgccaccggcgtcacccccacgcagtccgggtcgagcaccgacggggacactcctgcctcggcagaggcgggtcgtgtttctcgcgtgatgcaggccgttcggtctgcattcgattccgtgctgggtgatggaggcgtccgactcggaccgatg

SEQ ID NO: 8743 - DNA, 203 bp, Homo sapiens
ggcgcgccagtccttcatcaatcactcccagtgatgtggagagagagatggagatcttcgcgtgcaaccatgctaatgcgccactggtccgtgctttggggaaatactatgcatcaggtcccatggtgaacgggagcggtgtggaagtcggagttcggcattgccgggcttccggagtttacaccactcgactcggaccgatg

SEQ ID NO: 8744 - DNA, 203 bp, Homo sapiens
ggcgcgccagtccttcctctgcaaattcaattacatgttggcttaaggtttctgctgcctgtcgcaagataggcttgcaaaacccgtccttccttatccatggagatgactgcctcatcatttgtgagcgtaccgatgagccttgcgctgcgcgtctgaaagcggcgctcgcctcatacggttatgcccgactcggaccgatg

SEQ ID NO: 8745 - DNA, 203 bp, Homo sapiens
ggcgcgccagtccttacacgttgagctacccttggcatccattgactaggcatgtgttgattccgacactgcttacccctttgtttgccgctgggaagtctccacgtgagactatctgttgtgaggtcgcgggcaaccgcatccactttccgctcttatcattaccatcgattttggtctcgttgcaccgactcggaccgatg

SEQ ID NO: 8746 - DNA, 203 bp, Homo sapiens
ggcgcgccagtcctggccaggacgtcctagatgttcgggccgattcaacaaagacactgtcagaagcacaaaaagcattgcaggccttgtcgatgcgggggctgagctggtaccgcaagagggctaccatcctgcgcacccgcctcatcagggctgggggagagtgggcctacctcgcacgcacgttgcgactcggaccgatg

SEQ ID NO: 8747 - DNA, 203 bp, Homo sapiens
ggcgcgccagtcctgggctcgacacggctatagagctaatgacgcgccatgcccacttaattgtggggatgtcgtggatggcctatttccttgcggctctggtgtgactccagccgatgcccttacagggcattcttccttcctgctcccctaactctgcgtgagatcggggcaggtactgtgcgcttcgactcggaccgatg

SEQ ID NO: 8748 - DNA, 203 bp, Homo sapiens
ggcgcgccagtcctctctctaactcttcgtgagattgaggggcttgcagtctttccgccaatctaactctacgtgagattttggcgggcctccctgctcccctaactctgcgtgagatcggggcaggctctgttcgcttctctctaactcttcgtgagattgaggagcttgcagttcttccgccaatccgactcggaccgatg

SEQ ID NO: 8749 - DNA, 203 bp, Homo sapiens
ggcgcgccagtcctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggcgactcggaccgatg

SEQ ID NO: 8750 - DNA, 203 bp, Homo sapiens
ggcgcgccagtcctatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctcgactcggaccgatg

SEQ ID NO: 8751 - DNA, 203 bp, Homo sapiens
ggcgcgccagtcctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgactcggaccgatg

SEQ ID NO: 8752 - DNA, 203 bp, Homo sapiens
ggcgcgccagtcctcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacccgactcggaccgatg

SEQ ID NO: 8753 - DNA, 203 bp, Homo sapiens
ggcgcgccagtcctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcacgactcggaccgatg

SEQ ID NO: 8754 - DNA, 203 bp, Homo sapiens
ggcgcgccagtcctaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggcgactcggaccgatg

SEQ ID NO: 8755 - DNA, 203 bp, Homo sapiens
ggcgcgccagtcctcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagacgactcggaccgatg

SEQ ID NO: 8756 - DNA, 203 bp, Homo sapiens
ggcgcgccagtcctatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctcgactcggaccgatg

SEQ ID NO: 8757 - DNA, 203 bp, Homo sapiens
ggcgcgccagtcctgtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgcgactcggaccgatg

SEQ ID NO: 8758 - DNA, 203 bp, Homo sapiens
ggcgcgccagtcctcgacgccccacgtacgggaacgccgccaaaaccttcgggacagctatgcgggttgacaatcccagtggggggccggggaccagctgattacttgtcctgcgagttcctcttgagactggccgaaaggcagccacggggccaccaaggcggcgcagcgctgcatgcggcaaggggcgactcggaccgatg

SEQ ID NO: 8759 - DNA, 203 bp, Homo sapiens
ggcgcgccagtcctgttgttcccgagacgaggtttacttctgtttcggggacggatgtctggtggcttatggctgtactgtttgcacacagtcttgctggaagctctaccggcctggggtggctactcggcccgggtccgaaccaggtgagctgctggggagatttgggagtgtaattggtccggtgtcgactcggaccgatg

SEQ ID NO: 8760 - DNA, 203 bp, Homo sapiens
ggcgcgccagtcctcggcttcggcttacaccgctggagtcctcgggttgggtgaaccttacagtttggccttcttggggacgttcctcaccagtcgcctctcacggattcccaacgtcacctgcgtgaaggcttgtgaccttgagtttacctacccaggcttgtccatcgattttgactgggcgtttacgactcggaccgatg

SEQ ID NO: 8761 - DNA, 203 bp, Homo sapiens
ggcgcgccagtcctcaccttgtgcttcttgcgtcgttgaccagaggccgctgaaatgtggttcctgcgtccgcgactgctgggagacggggggtcctgggttcgatgagtgcggtgtcggtactcggatgacgaagcacctcgaggccgtcctggttgatggaggtgtggagtccaaggtgacaacgccgactcggaccgatg

SEQ ID NO: 8762 - DNA, 203 bp, Homo sapiens
ggcgcgccagtcctaaggcaacagacagcaggtttacagtggtcagcgaaggtcttcgccggcttggttgcttactgacatggtcctggccctgttggtggtgatgaagttggctgaggctagagttgtccccctgtttatgctggcaatgtggtggtggttgaatggagcatctgctgccactattgcgactcggaccgatg

SEQ ID NO: 8763 - DNA, 203 bp, Homo sapiens
ggcgcgccagtcctctctcggcaaggtggtggatttagatatgcccgctgagttgtcagactttcgcgggtcttctggatcaccaatcttgtgcgatgagggtcatgctgttggcatgctgatttcggtgcttcatagggggagtagggtttcctcggtgcggtataccaaaccttgggaaactctcccgactcggaccgatg

SEQ ID NO: 8764 - DNA, 203 bp, Homo sapiens
ggcgcgccagtcctagttgcacgtcaccgacccgacctcaattttggggatgggtcgggcgaggttactcgctcgcgagtgcggcgtacgcctcctgcttttcgctacggcgaccccaccggtctctccgatggcgaagcatgaatctattcatgaggagatgttgggcagtgagggggaggtcccctcgactcggaccgatg

SEQ ID NO: 8765 - DNA, 203 bp, Homo sapiens
ggcgcgccagtcctgcgccacagacgcactttccactggttacactggcaattttgacaccgtaacagactgtggtttaatggttgaggaggtagtggaagtgaccctggacccgaccatcactatcggtgtgaagaccgtcccggcccctgccgaactgagggctcagaggcgtggtaggtgtggcccgactcggaccgatg

SEQ ID NO: 8766 - DNA, 203 bp, Homo sapiens
ggcgcgccagtcctacctacattatacctccctactgtgcagacattactacaagaggacagtgcctgttggcgtcatgggcaatgctgagggagcagtcccccttgtgcctactggcggtggaatcaggacttaccaaattgggacttctgactggtttgaggctgtggtcgtgcatgggacaatcacgactcggaccgatg

SEQ ID NO: 8767 - DNA, 203 bp, Homo sapiens
ggcgcgccagtcctcggtgcacgccaccagttgctatgagttgaaagctgctgacgttcggagggcggtgcgagccggcccgacttacgttggtggcgtaccttgcagctggagcgcgccgtgtactgcgcctgcgctcgtttacaggctaggccagggcatcaaaatcgatggagcgcgccgactgtcgactcggaccgatg

SEQ ID NO: 8768 - DNA, 203 bp, Homo sapiens
ggcgcgccagtccttgccctgtgacttagcacagggagcgcgccaccccccggtatctggcagtgttgccggtagtggttggacagatgaggacgagagggacttggtggaaaccaaggctgccgccatcgaggccattggggcggccttgcacctcccttcaccggaggctgctcaggccgctctagcgactcggaccgatg

SEQ ID NO: 8769 - DNA, 203 bp, Homo sapiens
ggcgcgccagtcctacccggacggtcaccaactgtttgacgagcgaggtccgatagaggtatctactcctatatgtgaagtgattggggacatcaggcttcagtgtgaccaaattgaggaaactccaacatcttactcttacatctggtcaggggcgcccttgggtactgggagaagtgtcccccaaccgactcggaccgatg

SEQ ID NO: 8770 - DNA, 203 bp, Homo sapiens
ggcgcgccagtcctccatgacgcgccctatagggacccatctgacttgtgacactaccaaagtttatgttactgaccctgatcgggccgctgagcgggccgagaaggttacaatctggaggggtgataggaagtatgacaagcattatgaggctgtcgttgaggctgtcctgaaaaaggcagccgcgacgactcggaccgatg

SEQ ID NO: 8771 - DNA, 203 bp, Homo sapiens
ggcgcgccagtcctcgaagtctcatggctggacctattcccaggctatagctaaagttaggcgccgagcagccgctggatacggcagcaaggtgaccgcctccacattggccactggttggcctcacgtggaggagatgctggacaaaatagccaggggacaggaagttcctttcacttttgtgaccacgactcggaccgatg

SEQ ID NO: 8772 - DNA, 203 bp, Homo sapiens
ggcgcgccagtcctagcgagaggttttcttctccaaaactacccgtaagcccccaagattcatagttttcccacctttggacttcaggatagctgaaaagatgattctgggtgaccccggcatcgttgcaaagtcaattctgggtgacgcttatctgttccagtacacgcccaatcagagggtcaaagcgactcggaccgatg

SEQ ID NO: 8773 - DNA, 203 bp, Homo sapiens
ggcgcgccagtcctctatggtttccccagatggggttcccttggggtaccgccagtgtaggtcgtcgggcgtgttaacaactagctcggcgaacagcatcacttgttacattaaggtcagcgcggcctgcaggcgggtggggattaaggcaccatcattctttatagctggagatgattgcttgatcacgactcggaccgatg

SEQ ID NO: 8774 - DNA, 203 bp, Homo sapiens
ggcgcgccagtcctccccccccccggcactgggtgcaagccccagaaaccgacgcctactgaagtagacgtaatggccccgcgccgaaccggcgaccggccaaaaggtggtggatgggtgatgacagggttggtaggtcgtaaatcccggtcatcctggtagccactataggtgggtcttaaggggagcgactcggaccgatg

SEQ ID NO: 8775 - DNA, 203 bp, Homo sapiens
ggcgcgccagtcctgctacggtccctcttgcgcatatggaggaaaagcgcacggtccacaggtgttggtcctaccggtgtaataaggacccggcgctaggcacgccgttaaaccgagcccgttactcccctgggcaaacgacgcccacgtacggtccacgtcgcccttcaatgtctctcttgaccaatcgactcggaccgatg

SEQ ID NO: 8776 - DNA, 203 bp, Homo sapiens
ggcgcgccagtcctgccttactcctctcttggtgtgcgtggcggccctcctcctgctggagcagcgtattgtcatggtcttcctcctggtcactatggcgggcatgtcgcaacgcgcgcccgcctcagtgttggggtcacggcctttcgaggccgggttgacttggcagtcttgttcttgcaggtcgacgactcggaccgatg

SEQ ID NO: 8777 - DNA, 203 bp, Homo sapiens
ggcgcgccagtcctacgggtcccgcgtgccgacgggggagagggtttgggaacgtgggaacgtcacacttttgtgtgactgccccaacggtccttgggtgtgggtcccggccctttgccaggcaatcggatggggcgaccctatcactcattggagccacggacaaaatcagtggcccctttcttgtccgactcggaccgatg

SEQ ID NO: 8778 - DNA, 203 bp, Homo sapiens
ggcgcgccagtcctcccaatttgtctacggcgccgtttcagtgacctgcgtgtggggttctgtgtcttggtttgcttccactgggggtcgcgactccaaggttgatgtgtggagtttggttccagttggctctgccagctgcaccatagccgcactgggatcttcggatcgcgacacagtggttgagccgactcggaccgatg

SEQ ID NO: 8779 - DNA, 203 bp, Homo sapiens
ggcgcgccagtccttctccgagtggggaattccctgcgccacttgtatcctggacaggcggcctgcctcgtgtggcacctgtgtgagggactgctggcccgagaccgggtcggtacgtttcccattccacaggtgtggcgcgggaccgaggctgaccagagaccttgaggctgtgcccttcgtcaatacgactcggaccgatg

SEQ ID NO: 8780 - DNA, 203 bp, Homo sapiens
ggcgcgccagtcctctgatgggttcatacatgttcagggccacttgcaggaggtggatgcgggcaacttcattccgcccccacgctggttgctcttggactttgtatttgtcctgttatacctgatgaagctggcagaggcacggttggtcccgctgatcctcctcctgctatggtggtgggtgaacccgactcggaccgatg

SEQ ID NO: 8781 - DNA, 203 bp, Homo sapiens
ggcgcgccagtccttgtggaagctcgctcggggggctttcccgctggcattactgatggggatttccgccactcgcggccgcacctctgtgcttggcgccgaattctgctttgatgtcacctttgaagtggacacgtcagtcttgggttgggtggttgctagtgtggtggcttgggccatagcgctcccgactcggaccgatg

SEQ ID NO: 8782 - DNA, 203 bp, Homo sapiens
ggcgcgccagtccttgatgttggtggttgtggccatggtcctcctcttcggccttttcgacgcgctcgattgggccttggaggagctccttgtgtcgcggccttcgttgcgtcgtttggcaagggtggtggagtgttgtgtgatggcgggcgagaaggccactaccgtccggcttgtgtccaagatgtcgactcggaccgatg

SEQ ID NO: 8783 - DNA, 203 bp, Homo sapiens
ggcgcgccagtcctggaaaagcacacgcgtccctttggagtatggaaacatggggcacaaggtcctgattctcaacccgtcggttgccactgtgagggccatgggcccttacatggagaggctggcggggaaacatcctagcattttctgtggacacgacacaacagctttcacacggatcacggactcgactcggaccgatg

SEQ ID NO: 8784 - DNA, 203 bp, Homo sapiens
ggcgcgccagtcctctactgcgactcccccgggctcgcctatgactcagcatccatccataattgagacaaagctggacgttggtgagatccccttttatgggcatggtatccccctcgagcgtatgaggactggtcgccaccttgtattctgccattccaaggcggagtgcgagagattggccggcccgactcggaccgatg

SEQ ID NO: 8785 - DNA, 203 bp, Homo sapiens
ggcgcgccagtcctagttctccgcgcggggggttaatgccatcgcctattataggggtaaggacagttccatcatcaaagacggagacctggtggtttgtgcgacagacgcgctctctaccgggtacacaggaaacttcgattctgtcaccgactgtgggttggtggtggaggaggtcgttgaggtgacgactcggaccgatg

SEQ ID NO: 8786 - DNA, 203 bp, Homo sapiens
ggcgcgccagtcctcccttgatcccaccattaccatttccttgcggactgtccctgcttcggctgaattgtcgatgcagcggcgcggacgcacggggagaggtcggtcgggccgctactactacgctggggtcggtaaggctcccgcgggggtggtgcggtctggtccggtctggtcggcagtggaagcgactcggaccgatg

SEQ ID NO: 8787 - DNA, 203 bp, Homo sapiens
ggcgcgccagtcctgtggtgaccaggccacccctcaacccgtggtgcaggtccccccggtagaccatcggccggggggggagtctgcgccacgggatgccaagacagtgacagatgcggtggcagccatccaggtgaactgcgattggtctgtgatgaccctgtcgatcggggaagtcctcaccttggcgactcggaccgatg

SEQ ID NO: 8788 - DNA, 203 bp, Homo sapiens
ggcgcgccagtcctctcaggctaagacagccgaggcctacgcagctacttccaggtggctcgctggctgctacacggggacgcgggccgtccccactgtatcaattgttgacaagctcttcgccgggggttgggccgccgtggtgggtcactgtcacagcgtcattgctgcggcggtggctgcctatgcgactcggaccgatg

SEQ ID NO: 8789 - DNA, 203 bp, Homo sapiens
ggcgcgccagtcctccctggtcaacagggagcctaaggtggatgaggtccaggtggggtacgtctgggatctgtgggagtgggtgatgcgccaggtgcgcatggtgatgtctagactccgggccctctgccctgtggtgtcactccccttgtggcactgcggggaggggtggtccggtgaatggcttccgactcggaccgatg

SEQ ID NO: 8790 - DNA, 203 bp, Homo sapiens
ggcgcgccagtcctacaccccgaaggtggtacccttcgggacgtcggggtgggctgaggtggtggtgacccctacccacgtggtgatcaggcgcacgtcctgttacaaactgcttcgccagcaaattctttcagcagctgtagctgagccctactacgttgatggcattccggtctcttgggaggctgcgactcggaccgatg

SEQ ID NO: 8791 - DNA, 203 bp, Homo sapiens
ggcgcgccagtcctacgcgagagcgccggccatggtctagggtccgggccaaagtgttaccattgatggggagcgctacacccttccgcaccagttgcggatgcggaatgtggcgccctctgaggtttcatctgaggtcagcatcgagatcgggacggagactgaagactcagaactgactgaggccgcgactcggaccgatg

SEQ ID NO: 8792 - DNA, 203 bp, Homo sapiens
ggcgcgccagtcctcggttacggagagcagctcagatgagaagaccctgtcggtgacctcctcgcaggaggacaccccgtcctcagactcatttgaagtcatccaagagtctgatactgctgaatcagaggaaagcgtcttcaacgtggctctttccgtactaaaagccttatttccacagagcgatgcgactcggaccgatg

SEQ ID NO: 8793 - DNA, 203 bp, Homo sapiens
ggcgcgccagtccttggtgggcaatgaacttacctttgaatgtgacaagtgtgaggcacgccaagagacccttgcctccttctcctacatatggtccggggtcccacttactcgggccactccggccaaaccaccagtggtgaggccggtggggtccttgttggtggcagacaccaccaaggtctacgcgactcggaccgatg

SEQ ID NO: 8794 - DNA, 203 bp, Homo sapiens
ggcgcgccagtccttcattgtgttcccccccctggacttccggatagctgaaaagctcattctgggagacccggggcgggttgcaaaggccggtgttgggggggcttacgccttccagtacacccccaaccagcgggttaaggagatgctaaagctgtgggaatcaaagaagaccccgtgcgccatctcgactcggaccgatg

SEQ ID NO: 8795 - DNA, 203 bp, Homo sapiens
ggcgcgccagtcctttaaaactggatccaggttgttcccacctggatttcccacagggagtggtactctgttattacggtaactttgtacgccagttttatctcccttcccccatgtaacttagaagtttttcacaaagaccaatagccggtaatcagccagattactgaaggtcaagcacttctgttcgactcggaccgatg

SEQ ID NO: 8796 - DNA, 203 bp, Homo sapiens
ggcgcgccagtccttagcctgcgtggctgcctgcacaccctatgggtgtgaagccaaacaatggacaaggtgtgaagagccccgtgtgctcgctttgagtcctccggcccctgaatgtggctaaccttaaccctgcagctagagcacgtaacccaatgtgtatctagtcgtaatgagcaattgcgggacgactcggaccgatg

SEQ ID NO: 8797 - DNA, 203 bp, Homo sapiens
ggcgcgccagtcctgggttggtggtggaaactacctgatgcactcaaggacatgggtatttttggtgaaaacatgttttatcattacctgggtaggagtggatacacaatacatgtgcagtgtaatgctagtaaatttcaccagggtacactaattgttgctctgatacctgagcatcagattgcaagcgactcggaccgatg

SEQ ID NO: 8798 - DNA, 203 bp, Homo sapiens
ggcgcgccagtccttttcacccactggacagggagtctccgtttcagcttcatgttttgtggtactgccaacactactgttaagcttttgttggcatacacaccacctggtatcgcagaacccaccacaagaaaggatgcaatgctaggcactcatgttatatgggatgtggggttgcagtctacaatcgactcggaccgatg

SEQ ID NO: 8799 - DNA, 203 bp, Homo sapiens
ggcgcgccagtcctatcaatggtagtgccatggattagcgctagtcattatagaaacacatcaccaggtagatctacatctgggtacataacatgctggtatcagactagattagtcattccacctcagaccccaccaacagctagattgttatgttttgtatctgggtgcaaagacttttgcttgcgcgactcggaccgatg

SEQ ID NO: 8800 - DNA, 203 bp, Homo sapiens
ggcgcgccagtcctcatggcacgagatactaacctacacctgcaaagtggtgcaatagcacagaaccctgttgagaattatatagatgaagttcttaatgaagttttagttgtcccaaatattaatagtagtaaccccacaacatcaaattctgccccagcattagatgctgcagaaacagggcacaccgactcggaccgatg

SEQ ID NO: 8801 - DNA, 203 bp, Homo sapiens
ggcgcgccagtccttctacaagaaatggctcaaattagaaggaaatttgaattgttcacctatactaggtttgattctgaaataaccctagttccatgcatttccgcccttagtcaggacattggacacatcacaatgcaatacatgtatgttccaccaggtgcaccggtgcccaatagtagggacgacgactcggaccgatg

SEQ ID NO: 8802 - DNA, 203 bp, Homo sapiens
ggcgcgccagtccttgtgaccagaccaattatcactacagctggccccagtgacatgtatgttcatgtaggtaaccttatttatagaaatcttcatcttttcaactctgagatgcatgaatctattttggtatcttattcatcagatttaatcatttaccgaacaaacactgtaggtgatgattacatcgactcggaccgatg

SEQ ID NO: 8803 - DNA, 203 bp, Homo sapiens
ggcgcgccagtcctacatatacatgccataaacccagtaggaaatatcagcaagaaaattattaaatggatgttgagaataatatcagcaatggtcataataattagaaactcttctgacccccaaactatattagcaacactcacactgattgggtgttctggatcaccctggagatttttaaaggacgactcggaccgatg

SEQ ID NO: 8804 - DNA, 203 bp, Homo sapiens
ggcgcgccagtccttgaccaacagagtgtagtaataatggatgacattatgcagaatccagccggggatgacatgacactgttctgccaaatggtttctagtgttacatttataccaccaatggctgatctaccagataaaggcaaggcttttgattctaggtttgtattatgcagcacaaatcattccgactcggaccgatg

SEQ ID NO: 8805 - DNA, 203 bp, Homo sapiens
ggcgcgccagtcctatttgtgtgtggaaaagcagtttctttcaaagatcgtaactcttgcaacaaatacagccttgcgcaggtgtacaacataatgattgaagaagacagacggagaagacaagtggttgatgtcatgacagctatattccaagggccaattgatatgaaaaacccaccaccacctgccgactcggaccgatg

SEQ ID NO: 8806 - DNA, 203 bp, Homo sapiens
ggcgcgccagtccttattactgacttgctccagtctgttagaacccctgaagttattaagtattgtgagggtaatagatggataattccagcagaatgcaagatagaaaaggagttgaacttggctaacacaatcataacaatcattgcaaatgttattggtatggcgagaataatatatgttatttacgactcggaccgatg

SEQ ID NO: 8807 - DNA, 203 bp, Homo sapiens
ggcgcgccagtcctcaaaaccaaattgcagcctagtgttttctatgatgtattccctggttcaaaagaaccagctgtgttgtctgaaaaagatgcccggttacaagttgatttcaatgaagcactattttctaaatacaaagggaatacagattgctccattaatgaccacataagaattgcatcatccgactcggaccgatg

SEQ ID NO: 8808 - DNA, 203 bp, Homo sapiens
ggcgcgccagtcctacattatgcagcacaactcattaccttagatattgacccaaaacctattacacttgaggacagtgtctttggcactgatggattagaggctcttgatttgaacactagcgcaggatttccatatattgcaatgggagttaaaaagagagatttaataaacaacaagaccaaggacgactcggaccgatg

SEQ ID NO: 8809 - DNA, 203 bp, Homo sapiens
ggcgcgccagtcctttcaaagttccacttgaatcctggaattgttactggatcagcagttggatgtgatccagaggtgttttggtcaaaaataccagcaatgttggatgataaatgtattatggcttttgattatacaaattatgatggtagtatacaccctatttggtttgaagctcttaaacaggtcgactcggaccgatg

SEQ ID NO: 8810 - DNA, 203 bp, Homo sapiens
ggcgcgccagtcctactggtagatctatcatttaatccaacattaatagatagactatgcaagtctaaacacatcttcaaaaatacatactatgaagtggagggaggtgtaccatctgggtgttcaggtactagtatttttaacactatgatcaataatattatcataaggaccttagtgttagatgccgactcggaccgatg

SEQ ID NO: 8811 - DNA, 203 bp, Homo sapiens
ggcgcgccagtcctatacaagaatatagatctagataagcttaagataattgcctatggtgatgatgtcatattctcatacatacatgaactggacatggaggctatagcaatagagggtgttaaatatggtttgactataactcctgctgataaatctaacacatttgtaaaattagactatagcaacgactcggaccgatg

SEQ ID NO: 8812 - DNA, 203 bp, Homo sapiens
ggcgcgccagtcctaaagaaaacctcctgtacattcaactacacaaaaactttgaagaacaggtactatgagcccagggacagctacttccagcaatatatgcttaagggtgagtatcagtactggtttgacctggatgcgactgaccgccactcagattacttcgcagaatttgttgtcttggtggtcgactcggaccgatg

SEQ ID NO: 8813 - DNA, 203 bp, Homo sapiens
ggcgcgccagtcctttatgaaggagacccgatatctgcctacaaggaagtcatcggccacaacctttttgatcttaagagaacaagctttgagaagctggccaagttaaatcttagcatgtctgtactcggggcctggactagacacaccagtaaaagactactacaagactgtgtcaatataggtgtcgactcggaccgatg

SEQ ID NO: 8814 - DNA, 203 bp, Homo sapiens
ggcgcgccagtcctcacctacggaaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaacgactcggaccgatg

SEQ ID NO: 8815 - DNA, 203 bp, Homo sapiens
ggcgcgccagtcctaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcgactcggaccgatg

SEQ ID NO: 8816 - DNA, 203 bp, Homo sapiens
ggcgcgccagtcctcgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgaccccgactcggaccgatg

SEQ ID NO: 8817 - DNA, 203 bp, Homo sapiens
ggcgcgccagtcctttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgcgactcggaccgatg

SEQ ID NO: 8818 - DNA, 203 bp, Homo sapiens
ggcgcgccagtccttagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctccgactcggaccgatg

SEQ ID NO: 8819 - DNA, 203 bp, Homo sapiens
ggcgcgccagtcctcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctcgttcatggggcgactcggaccgatg

SEQ ID NO: 8820 - DNA, 203 bp, Homo sapiens
ggcgcgccagtcctcccggcggggccgatccgagggcctcactaaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcacgactcggaccgatg

SEQ ID NO: 8821 - DNA, 203 bp, Homo sapiens
ggcgcgccagtcctggcctcactaaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgcccgactcggaccgatg

SEQ ID NO: 8822 - DNA, 203 bp, Homo sapiens
ggcgcgccagtcctaaccatccaatcggtagtagcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgccggcgtagggtcgactcggaccgatg

SEQ ID NO: 8823 - DNA, 203 bp, Homo sapiens
ggcgcgccagtcctcgacgggcggtgtgtacaaagggcagggacttaatcaacgcaagcttatgacccgcacttactgggaattcctcgttcatggggaataattgcaatccccgatccccatcacgaatggggttcaacgggttacccgcgcctgccggcgtagggtaggcacacgctgagccagtccgactcggaccgatg

SEQ ID NO: 8824 - DNA, 203 bp, Homo sapiens
ggcgcgccagtcctgggcagggacttaatcaacgcaagcttatgacccgcacttactgggaattcctcgttcatggggaataattgcaatccccgatccccatcacgaatggggttcaacgggttacccgcgcctgccggcgtagggtaggcacacgctgagccagtcagtgtagcgcgcgtgcagcccgactcggaccgatg

SEQ ID NO: 8825 - DNA, 203 bp, Homo sapiens
ggcgcgccagtcctcaagcttatgacccgcacttactgggaattcctcgttcatggggaataattgcaatccccgatccccatcacgaatggggttcaacgggttacccgcgcctgccggcgtagggtaggcacacgctgagccagtcagtgtagcgcgcgtgcagccccggacatctaagggcatcacgactcggaccgatg

SEQ ID NO: 8826 - DNA, 203 bp, Homo sapiens
ggcgcgccagtcctactgggaattcctcgttcatggggaataattgcaatccccgatccccatcacgaatggggttcaacgggttacccgcgcctgccggcgtagggtaggcacacgctgagccagtcagtgtagcgcgcgtgcagccccggacatctaagggcatcacagacctgttattgctcaatcgactcggaccgatg

SEQ ID NO: 8827 - DNA, 203 bp, Homo sapiens
ggcgcgccagtccttacccgcgcctgccggcgtagggtaggcacacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaaccgactcggaccgatg

SEQ ID NO: 8828 - DNA, 203 bp, Homo sapiens
ggcgcgccagtcctgggtaggcacacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaactagttagcatgccagagtctcgactcggaccgatg

SEQ ID NO: 8829 - DNA, 203 bp, Homo sapiens
ggcgcgccagtcctacgctgagccagtcagtgtagcgcgcgtgcagccccggacatctaagggcatcacagacctgttattgctcaatctcgggtggctgaacgccacttgtccctctaagaagttgggggacgccgaccgctcgggggtcgcgtaactagttagcatgccagagtctcgttcgttatcgactcggaccgatg

SEQ ID NO: 8830 - DNA, 203 bp, Homo sapiens
ggcgcgccagtcctagccccggacatctaagggcatcacagacctgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaacgactcggaccgatg

SEQ ID NO: 8831 - DNA, 203 bp, Homo sapiens
ggcgcgccagtcctatcacagacctgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccacgactcggaccgatg

SEQ ID NO: 8832 - DNA, 203 bp, Homo sapiens
ggcgcgccagtccttgttattgctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccaccacccacggcgactcggaccgatg

SEQ ID NO: 8833 - DNA, 203 bp, Homo sapiens
ggcgcgccagtcctcaatctcgggtggctgaacgccacttgtccctctaagaagttgggggacgccgaccgctcgggggtcgcgtaactagttagcatgccagagtctcgttcgttatcggaattaaccagacaaatcgctccaccaactaagaacggccatgcaccaccacccacggaatcgagaaacgactcggaccgatg

SEQ ID NO: 8834 - DNA, 203 bp, Homo sapiens
ggcgcgccagtcctgtctcgttcgttatcggaattaaccagacaaatcgctccaccaactaagaacggccatgcaccaccacccacggaatcgagaaagagctatcaatctgtcaatcctgtccgtgtccgggccgggtgaggtttcccgtgttgagtcaaattaagccgcaggctccactcctggtgcgactcggaccgatg

SEQ ID NO: 8835 - DNA, 203 bp, Homo sapiens
ggcgcgccagtccttaaccagacaaatcgctccaccaactaagaacggccatgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctcgactcggaccgatg

SEQ ID NO: 8836 - DNA, 203 bp, Homo sapiens
ggcgcgccagtcctacggccatgcaccaccacccacggaatcgagaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactcccccgactcggaccgatg

SEQ ID NO: 8837 - DNA, 203 bp, Homo sapiens
ggcgcgccagtcctgaaagagctatcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaacgactcggaccgatg

SEQ ID NO: 8838 - DNA, 203 bp, Homo sapiens
ggcgcgccagtccttcaatctgtcaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggccgactcggaccgatg

SEQ ID NO: 8839 - DNA, 203 bp, Homo sapiens
ggcgcgccagtcctaatcctgtccgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggcgggtcatgggcgactcggaccgatg

SEQ ID NO: 8840 - DNA, 203 bp, Homo sapiens
ggcgcgccagtcctgtgtccgggccgggtgaggtttcccgtgttgagtcaaattaagccgcaggctccactcctggtggtgcccttccgtcaattcctttaagtttcagctttgcaaccatactccccccggaacccaaagactttggtttcccggaagctgcccggcgggtcatgggaataacgccgcgactcggaccgatg

SEQ ID NO: 8841 - DNA, 203 bp, Homo sapiens
ggcgcgccagtcctctccactcctggtggtgcccttccgtcaattcctttaagtttcagctttgcaaccatactccccccggaacccaaagactttggtttcccggaagctgcccggcgggtcatgggaataacgccgccgcatcgccggtcggcatcgtttatggtcggaactacgacggtatctgacgactcggaccgatg

SEQ ID NO: 8842 - DNA, 203 bp, Homo sapiens
ggcgcgccagtcctttcagctttgcaaccatactccccccggaacccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaacgactcggaccgatg

SEQ ID NO: 8843 - DNA, 203 bp, Homo sapiens
ggcgcgccagtcctcaaccatactccccccggaacccaaagactttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcgactcggaccgatg

SEQ ID NO: 8844 - DNA, 203 bp, Homo sapiens
ggcgcgccagtcctttggtttcccggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccgactcggaccgatg

SEQ ID NO: 8845 - DNA, 203 bp, Homo sapiens
ggcgcgccagtcctggaagctgcccggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagacgactcggaccgatg

SEQ ID NO: 8846 - DNA, 203 bp, Homo sapiens
ggcgcgccagtcctcggcgggtcatgggaataacgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctccgactcggaccgatg

SEQ ID NO: 8847 - DNA, 203 bp, Homo sapiens
ggcgcgccagtcctgccgccgcatcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgccgactcggaccgatg

SEQ ID NO: 8848 - DNA, 203 bp, Homo sapiens
ggcgcgccagtcctcgccggtcggcatcgtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtcgactcggaccgatg

SEQ ID NO: 8849 - DNA, 203 bp, Homo sapiens
ggcgcgccagtcctggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcacgactcggaccgatg

SEQ ID NO: 8850 - DNA, 203 bp, Homo sapiens
ggcgcgccagtcctacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaacgactcggaccgatg

SEQ ID NO: 8851 - DNA, 203 bp, Homo sapiens
ggcgcgccagtcctctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatcgactcggaccgatg

SEQ ID NO: 8852 - DNA, 203 bp, Homo sapiens
ggcgcgccagtccttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggcgactcggaccgatg

SEQ ID NO: 8853 - DNA, 203 bp, Homo sapiens
ggcgcgccagtcctgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccgactcggaccgatg

SEQ ID NO: 8854 - DNA, 203 bp, Homo sapiens
ggcgcgccagtcctttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctccgactcggaccgatg

SEQ ID NO: 8855 - DNA, 203 bp, Homo sapiens
ggcgcgccagtcctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctcgactcggaccgatg

SEQ ID NO: 8856 - DNA, 203 bp, Homo sapiens
ggcgcgccagtcctgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcacgactcggaccgatg

SEQ ID NO: 8857 - DNA, 203 bp, Homo sapiens
ggcgcgccagtcctcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcgactcggaccgatg

SEQ ID NO: 8858 - DNA, 203 bp, Homo sapiens
ggcgcgccagtcctccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgaggggcgactcggaccgatg

SEQ ID NO: 8859 - DNA, 203 bp, Homo sapiens
ggcgcgccagtccttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgagggggcgccgagagcgactcggaccgatg

SEQ ID NO: 8860 - DNA, 203 bp, Homo sapiens
ggcgcgccagtcctctcagttccgaaaaccaacaaaatagaaccgcggtcctattccattattcctagctgcggtatccaggcggctcgggcctgctttgaacactctaattttttcaaagtaaacgcttcgggccccgcgggacactcagctaagagcatcgagggggcgccgagaggcaaggggcgcgactcggaccgatg

SEQ ID NO: 8861 - DNA, 203 bp, Homo sapiens
ggcgcgccagtcctctagctgcggtatccaggcggctcgggcctgctttgaacactctaattttttcaaagtaaacgcttcgggccccgcgggacactcagctaagagcatcgagggggcgccgagaggcaaggggcggggacgggcggtggctcgcctcgcgggggaccgcccgcccgctcccaagacgactcggaccgatg

SEQ ID NO: 8862 - DNA, 203 bp, Homo sapiens
ggcgcgccagtcctttcaaagtaaacgcttcgggccccgcgggacactcagctaagagcatcgagggggcgccgagaggcaaggggcggggacgggcggtggctcgcctcgcgggggaccgcccgcccgctcccaagatccaactacgagctttttaactgcagcaactttaatatacgctattggagcgactcggaccgatg

SEQ ID NO: 8863 - DNA, 203 bp, Homo sapiens
ggcgcgccagtcctcactcagctaagagcatcgagggggcgccgagaggcaaggggcggggacgggcggtggctcgcctcgcgggggaccgcccgcccgctcccaagatccaactacgagctttttaactgcagcaactttaatatacgctattggagctggaattaccgcggctgctggcaccagaccgactcggaccgatg

SEQ ID NO: 8864 - DNA, 203 bp, Homo sapiens
ggcgcgccagtcctagagcatcgagggggcgccgagaggcaaggggcggggacgggcggtggctcgcctcgcgggggaccgcccgcccgctcccaagatccaactacgagctttttaactgcagcaactttaatatacgctattggagctggaattaccgcggctgctggcaccagacttgccctccacgactcggaccgatg

SEQ ID NO: 8865 - DNA, 203 bp, Homo sapiens
ggcgcgccagtcctgggggcgccgagaggcaaggggcggggacgggcggtggctcgcctcgcgggggaccgcccgcccgctcccaagatccaactacgagctttttaactgcagcaactttaatatacgctattggagctggaattaccgcggctgctggcaccagacttgccctccaatggatcctccgactcggaccgatg

SEQ ID NO: 8866 - DNA, 203 bp, Homo sapiens
ggcgcgccagtcctagaggcaaggggcggggacgggcggtggctcgcctcgcgggggaccgcccgcccgctcccaagatccaactacgagctttttaactgcagcaactttaatatacgctattggagctggaattaccgcggctgctggcaccagacttgccctccaatggatcctcgttaaaggatcgactcggaccgatg

SEQ ID NO: 8867 - DNA, 203 bp, Homo sapiens
ggcgcgccagtccttacgagctttttaactgcagcaactttaatatacgctattggagctggaattaccgcggctgctggcaccagacttgccctccaatggatcctcgttaaaggatttaaagtggactcattccaattacagggcctcgaaagagtcctgtattgttatttttcgtcactacctcccgactcggaccgatg

SEQ ID NO: 8868 - DNA, 203 bp, Homo sapiens
ggcgcgccagtcctatacgctattggagctggaattaccgcggctgctggcaccagacttgccctccaatggatcctcgttaaaggatttaaagtggactcattccaattacagggcctcgaaagagtcctgtattgttatttttcgtcactacctccccgggtcgggagtgggtaatttgcgcgcctcgactcggaccgatg

SEQ ID NO: 8869 - DNA, 203 bp, Homo sapiens
ggcgcgccagtcctggagctggaattaccgcggctgctggcaccagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttcccgactcggaccgatg

SEQ ID NO: 8870 - DNA, 203 bp, Homo sapiens
ggcgcgccagtcctagacttgccctccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaggctccccgactcggaccgatg

SEQ ID NO: 8871 - DNA, 203 bp, Homo sapiens
ggcgcgccagtccttccaatggatcctcgttaaaggatttaaagtggactcattccaattacagggcctcgaaagagtcctgtattgttatttttcgtcactacctccccgggtcgggagtgggtaatttgcgcgcctgctgccttccttggatgtggtagccgtttctcaggctccctctccggaatcgactcggaccgatg

SEQ ID NO: 8872 - DNA, 203 bp, Homo sapiens
ggcgcgccagtcctggcctcgaaagagtcctgtattgttatttttcgtcactacctccccgggtcgggagtgggtaatttgcgcgcctgctgccttccttggatgtggtagccgtttctcaggctccctctccggaatcgaaccctgattccccgtcacccgtggtcaccatggtaggcacggcgactcgactcggaccgatg

SEQ ID NO: 8873 - DNA, 203 bp, Homo sapiens
ggcgcgccagtccttcgtcactacctccccgggtcgggagtgggtaatttgcgcgcctgctgccttccttggatgtggtagccgtttctcaggctccctctccggaatcgaaccctgattccccgtcacccgtggtcaccatggtaggcacggcgactaccatcgaaagttgatagggcagacgttcgcgactcggaccgatg

SEQ ID NO: 8874 - DNA, 203 bp, Homo sapiens
ggcgcgccagtcctgtggtagccgtttctcaggctccctctccggaatcgaaccctgattccccgtcacccgtggtcaccatggtaggcacggcgactaccatcgaaagttgatagggcagacgttcgaatgggtcgtcgccgccacggggggcgtgcgatcggcccgaggttatctagagtcaccaacgactcggaccgatg

SEQ ID NO: 8875 - DNA, 203 bp, Homo sapiens
ggcgcgccagtcctgaatcgaaccctgattccccgtcacccgtggtcaccatggtaggcacggcgactaccatcgaaagttgatagggcagacgttcgaatgggtcgtcgccgccacggggggcgtgcgatcggcccgaggttatctagagtcaccaaagccgccggcgcccgccccccggccggggccgactcggaccgatg

SEQ ID NO: 8876 - DNA, 203 bp, Homo sapiens
ggcgcgccagtcctctgattccccgtcacccgtggtcaccatggtaggcacggcgactaccatcgaaagttgatagggcagacgttcgaatgggtcgtcgccgccacggggggcgtgcgatcggcccgaggttatctagagtcaccaaagccgccggcgcccgccccccggccggggccggagaggggcgactcggaccgatg

SEQ ID NO: 8877 - DNA, 203 bp, Homo sapiens
ggcgcgccagtcctgtcaccatggtaggcacggcgactaccatcgaaagttgatagggcagacgttcgaatgggtcgtcgccgccacggggggcgtgcgatcggcccgaggttatctagagtcaccaaagccgccggcgcccgccccccggccggggccggagaggggctgaccgggttggttttgatcgactcggaccgatg

SEQ ID NO: 8878 - DNA, 203 bp, Homo sapiens
ggcgcgccagtcctcacggggggcgtgcgatcggcccgaggttatctagagtcaccaaagccgccggcgcccgccccccggccggggccggagaggggctgaccgggttggttttgatctgataaatgcacgcatcccccccgcgaagggggtcagcgcccgtcggcatgtattagctctagaattaccgactcggaccgatg

SEQ ID NO: 8879 - DNA, 203 bp, Homo sapiens
ggcgcgccagtcctcccgaggttatctagagtcaccaaagccgccggcgcccgccccccggccggggccggagaggggctgaccgggttggttttgatctgataaatgcacgcatcccccccgcgaagggggtcagcgcccgtcggcatgtattagctctagaattaccacagttatccaagtaggagcgactcggaccgatg

SEQ ID NO: 8880 - DNA, 203 bp, Homo sapiens
ggcgcgccagtcctggggctgaccgggttggttttgatctgataaatgcacgcatcccccccgcgaagggggtcagcgcccgtcggcatgtattagctctagaattaccacagttatccaagtaggagaggagcgagcgaccaaaggaaccataactgatttaatgagccattcgcagtttcactgtacgactcggaccgatg

SEQ ID NO: 8881 - DNA, 203 bp, Homo sapiens
ggcgcgccagtccttcccccccgcgaagggggtcagcgcccgtcggcatgtattagctctagaattaccacagttatccaagtaggagaggagcgagcgaccaaaggaaccataactgatttaatgagccattcgcagtttcactgtaccggccgtgcgtactcagacatgcatggcttaatctttgacgactcggaccgatg

SEQ ID NO: 8882 - DNA, 203 bp, Homo sapiens
ggcgcgccagtcctgggcggcccgccggcggggacaggcgggggaccggctatccgaggccaaccgaggctccgcggcgctgccgtatcgttccgcctgggcgggattctgacttagaggcgttcagtcataatcccacagatggtagcttcgccccattggctcctcagccaagcacatacaccaaacgactcggaccgatg

SEQ ID NO: 8883 - DNA, 203 bp, Homo sapiens
ggcgcgccagtcctccggcggggacaggcgggggaccggctatccgaggccaaccgaggctccgcggcgctgccgtatcgttccgcctgggcgggattctgacttagaggcgttcagtcataatcccacagatggtagcttcgccccattggctcctcagccaagcacatacaccaaatgtctgaacccgactcggaccgatg

SEQ ID NO: 8884 - DNA, 203 bp, Homo sapiens
ggcgcgccagtcctcaggcgggggaccggctatccgaggccaaccgaggctccgcggcgctgccgtatcgttccgcctgggcgggattctgacttagaggcgttcagtcataatcccacagatggtagcttcgccccattggctcctcagccaagcacatacaccaaatgtctgaacctgcggttcctcgactcggaccgatg

SEQ ID NO: 8885 - DNA, 203 bp, Homo sapiens
ggcgcgccagtcctcgaggctccgcggcgctgccgtatcgttccgcctgggcgggattctgacttagaggcgttcagtcataatcccacagatggtagcttcgccccattggctcctcagccaagcacatacaccaaatgtctgaacctgcggttcctctcgtactgagcaggattaccatggcaacacgactcggaccgatg

SEQ ID NO: 8886 - DNA, 203 bp, Homo sapiens
ggcgcgccagtcctcggcgctgccgtatcgttccgcctgggcgggattctgacttagaggcgttcagtcataatcccacagatggtagcttcgccccattggctcctcagccaagcacatacaccaaatgtctgaacctgcggttcctctcgtactgagcaggattaccatggcaacaacacatcatccgactcggaccgatg

SEQ ID NO: 8887 - DNA, 203 bp, Homo sapiens
ggcgcgccagtcctgtatcgttccgcctgggcgggattctgacttagaggcgttcagtcataatcccacagatggtagcttcgccccattggctcctcagccaagcacatacaccaaatgtctgaacctgcggttcctctcgtactgagcaggattaccatggcaacaacacatcatcagtagggtaacgactcggaccgatg

SEQ ID NO: 8888 - DNA, 203 bp, Homo sapiens
ggcgcgccagtcctgcctgggcgggattctgacttagaggcgttcagtcataatcccacagatggtagcttcgccccattggctcctcagccaagcacatacaccaaatgtctgaacctgcggttcctctcgtactgagcaggattaccatggcaacaacacatcatcagtagggtaaaactaacctgcgactcggaccgatg

SEQ ID NO: 8889 - DNA, 203 bp, Homo sapiens
ggcgcgccagtcctgcacatacaccaaatgtctgaacctgcggttcctctcgtactgagcaggattaccatggcaacaacacatcatcagtagggtaaaactaacctgtctcacgacggtctaaacccagctcacgttccctattagtgggtgaacaatccaacgcttggtgaattctgcttcacaatcgactcggaccgatg

SEQ ID NO: 8890 - DNA, 203 bp, Homo sapiens
ggcgcgccagtccttcctctcgtactgagcaggattaccatggcaacaacacatcatcagtagggtaaaactaacctgtctcacgacggtctaaacccagctcacgttccctattagtgggtgaacaatccaacgcttggtgaattctgcttcacaatgataggaagagccgacatcgaaggatcaaacgactcggaccgatg

SEQ ID NO: 8891 - DNA, 203 bp, Homo sapiens
ggcgcgccagtcctgtaaaactaacctgtctcacgacggtctaaacccagctcacgttccctattagtgggtgaacaatccaacgcttggtgaattctgcttcacaatgataggaagagccgacatcgaaggatcaaaaagcgacgtcgctatgaacgcttggccgccacaagccagttatccctgtgcgactcggaccgatg

SEQ ID NO: 8892 - DNA, 203 bp, Homo sapiens
ggcgcgccagtccttagtgggtgaacaatccaacgcttggtgaattctgcttcacaatgataggaagagccgacatcgaaggatcaaaaagcgacgtcgctatgaacgcttggccgccacaagccagttatccctgtggtaacttttctgacacctcctgcttaaaacccaaaaggtcagaaggatcgcgactcggaccgatg

SEQ ID NO: 8893 - DNA, 203 bp, Homo sapiens
ggcgcgccagtcctgcttggtgaattctgcttcacaatgataggaagagccgacatcgaaggatcaaaaagcgacgtcgctatgaacgcttggccgccacaagccagttatccctgtggtaacttttctgacacctcctgcttaaaacccaaaaggtcagaaggatcgtgaggccccgctttcacggtcgactcggaccgatg

SEQ ID NO: 8894 - DNA, 203 bp, Homo sapiens
ggcgcgccagtcctcaatgataggaagagccgacatcgaaggatcaaaaagcgacgtcgctatgaacgcttggccgccacaagccagttatccctgtggtaacttttctgacacctcctgcttaaaacccaaaaggtcagaaggatcgtgaggccccgctttcacggtctgtattcgtactgaaaatccgactcggaccgatg

SEQ ID NO: 8895 - DNA, 203 bp, Homo sapiens
ggcgcgccagtcctcgtcgctatgaacgcttggccgccacaagccagttatccctgtggtaacttttctgacacctcctgcttaaaacccaaaaggtcagaaggatcgtgaggccccgctttcacggtctgtattcgtactgaaaatcaagatcaagcgagcttttgcccttctgctccacgggaggtcgactcggaccgatg

SEQ ID NO: 8896 - DNA, 203 bp, Homo sapiens
ggcgcgccagtcctcagttatccctgtggtaacttttctgacacctcctgcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacgactcggaccgatg

SEQ ID NO: 8897 - DNA, 203 bp, Homo sapiens
ggcgcgccagtcctctcctgcttaaaacccaaaaggtcagaaggatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtaccgcccgactcggaccgatg

SEQ ID NO: 8898 - DNA, 203 bp, Homo sapiens
ggcgcgccagtcctggtcagaaggatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctgcgactcggaccgatg

SEQ ID NO: 8899 - DNA, 203 bp, Homo sapiens
ggcgcgccagtcctatcgtgaggccccgctttcacggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctggcactgtccccgactcggaccgatg

SEQ ID NO: 8900 - DNA, 203 bp, Homo sapiens
ggcgcgccagtcctcccgctttcacggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctggcactgtccccggagcgggtcgactcggaccgatg

SEQ ID NO: 8901 - DNA, 203 bp, Homo sapiens
ggcgcgccagtcctcggtctgtattcgtactgaaaatcaagatcaagcgagcttttgcccttctgctccacgggaggtttctgtcctccctgagctcgccttaggacacctgcgttaccgtttgacaggtgtaccgccccagtcaaactccccacctggcactgtccccggagcgggtcgcgcccggccgactcggaccgatg

SEQ ID NO: 8902 - DNA, 203 bp, Homo sapiens
ggcgcgccagtcctcggggacaccgggggggcgccgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctccgactcggaccgatg

SEQ ID NO: 8903 - DNA, 203 bp, Homo sapiens
ggcgcgccagtcctgggggggcgccgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccatcgactcggaccgatg

SEQ ID NO: 8904 - DNA, 203 bp, Homo sapiens
ggcgcgccagtcctcgggggcctcccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcgactcggaccgatg

SEQ ID NO: 8905 - DNA, 203 bp, Homo sapiens
ggcgcgccagtcctccacttattctacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagcgactcggaccgatg

SEQ ID NO: 8906 - DNA, 203 bp, Homo sapiens
ggcgcgccagtccttacacctctcatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggccgactcggaccgatg

SEQ ID NO: 8907 - DNA, 203 bp, Homo sapiens
ggcgcgccagtcctatgtctcttcaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccgactcggaccgatg

SEQ ID NO: 8908 - DNA, 203 bp, Homo sapiens
ggcgcgccagtcctaccgtgccagactagagtcaagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccttaagagagcgactcggaccgatg

SEQ ID NO: 8909 - DNA, 203 bp, Homo sapiens
ggcgcgccagtcctagctcaacagggtcttctttccccgctgattccgccaagcccgttcccttggctgtggtttcgctggatagtaggtagggacagtgggaatctcgttcatccattcatgcgcgtcactaattagatgacgaggcatttggctaccttaagagagtcatagttactcccgccgttcgactcggaccgatg

SEQ ID NO: 8910 - DNA, 203 bp, Homo sapiens
ggcgcgccagtcctccccgctgattccgccaagcccgttcccttggctgtggtttcgctggatagtaggtagggacagtgggaatctcgttcatccattcatgcgcgtcactaattagatgacgaggcatttggctaccttaagagagtcatagttactcccgccgtttacccgcgcttcattgaattcgactcggaccgatg

SEQ ID NO: 8911 - DNA, 203 bp, Homo sapiens
ggcgcgccagtcctccgttcccttggctgtggtttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagacgactcggaccgatg

SEQ ID NO: 8912 - DNA, 203 bp, Homo sapiens
ggcgcgccagtcctggctgtggtttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcacgactcggaccgatg

SEQ ID NO: 8913 - DNA, 203 bp, Homo sapiens
ggcgcgccagtccttcgctggatagtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcagaaatcacatcgactcggaccgatg

SEQ ID NO: 8914 - DNA, 203 bp, Homo sapiens
ggcgcgccagtcctgtaggtagggacagtgggaatctcgttcatccattcatgcgcgtcactaattagatgacgaggcatttggctaccttaagagagtcatagttactcccgccgtttacccgcgcttcattgaatttcttcactttgacattcagagcactgggcagaaatcacatcgcgtcaacacgactcggaccgatg

SEQ ID NO: 8915 - DNA, 203 bp, Homo sapiens
ggcgcgccagtcctgcgtcactaattagatgacgaggcatttggctaccttaagagagtcatagttactcccgccgtttacccgcgcttcattgaatttcttcactttgacattcagagcactgggcagaaatcacatcgcgtcaacacccgccgcgggccttcgcgatgctttgttttaattaaacacgactcggaccgatg

SEQ ID NO: 8916 - DNA, 203 bp, Homo sapiens
ggcgcgccagtcctctaccttaagagagtcatagttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctacgactcggaccgatg

SEQ ID NO: 8917 - DNA, 203 bp, Homo sapiens
ggcgcgccagtcctagagtcatagttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctgccgactcggaccgatg

SEQ ID NO: 8918 - DNA, 203 bp, Homo sapiens
ggcgcgccagtcctttactcccgccgtttacccgcgcttcattgaatttcttcactttgacattcagagcactgggcagaaatcacatcgcgtcaacacccgccgcgggccttcgcgatgctttgttttaattaaacagtcggattcccctggtccgcaccagttctaagtcggctgctaggcgccggcgactcggaccgatg

SEQ ID NO: 8919 - DNA, 203 bp, Homo sapiens
ggcgcgccagtcctgcgcctcgtccagccgcggcgcgcgcccagccccgcttcgcgccccagcccgaccgacccagcccttagagccaatccttatcccgaagttacggatccggcttgccgacttcccttacctacattgttccaacatgccagaggctgttcaccttggagacctgctgcggatatcgactcggaccgatg

SEQ ID NO: 8920 - DNA, 203 bp, Homo sapiens
ggcgcgccagtcctcagccgcggcgcgcgcccagccccgcttcgcgccccagcccgaccgacccagcccttagagccaatccttatcccgaagttacggatccggcttgccgacttcccttacctacattgttccaacatgccagaggctgttcaccttggagacctgctgcggatatgggtacggcccgactcggaccgatg

SEQ ID NO: 8921 - DNA, 203 bp, Homo sapiens
ggcgcgccagtcctcgccccagcccgaccgacccagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggacgactcggaccgatg

SEQ ID NO: 8922 - DNA, 203 bp, Homo sapiens
ggcgcgccagtcctcgaccgacccagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggattttcaagggcgactcggaccgatg

SEQ ID NO: 8923 - DNA, 203 bp, Homo sapiens
ggcgcgccagtcctagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggattttcaagggccagcgagagcgactcggaccgatg

SEQ ID NO: 8924 - DNA, 203 bp, Homo sapiens
ggcgcgccagtcctttcccttacctacattgttccaacatgccagaggctgttcaccttggagacctgctgcggatatgggtacggcccggcgcgagatttacaccctctcccccggattttcaagggccagcgagagctcaccggacgccgccggaaccgcgacgctttccaaggcacgggcccctccgactcggaccgatg

SEQ ID NO: 8925 - DNA, 203 bp, Homo sapiens
ggcgcgccagtcctcaacatgccagaggctgttcaccttggagacctgctgcggatatgggtacggcccggcgcgagatttacaccctctcccccggattttcaagggccagcgagagctcaccggacgccgccggaaccgcgacgctttccaaggcacgggcccctctctcggggcgaacccattcccgactcggaccgatg

SEQ ID NO: 8926 - DNA, 203 bp, Homo sapiens
ggcgcgccagtcctaccttggagacctgctgcggatatgggtacggcccggcgcgagatttacaccctctcccccggattttcaagggccagcgagagctcaccggacgccgccggaaccgcgacgctttccaaggcacgggcccctctctcggggcgaacccattccagggcgccctgcccttcacacgactcggaccgatg

SEQ ID NO: 8927 - DNA, 203 bp, Homo sapiens
ggcgcgccagtcctggcccggcgcgagatttacaccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgcgactcggaccgatg

SEQ ID NO: 8928 - DNA, 203 bp, Homo sapiens
ggcgcgccagtcctgagatttacaccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgactcggaccgatg

SEQ ID NO: 8929 - DNA, 203 bp, Homo sapiens
ggcgcgccagtcctccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgggatcggtcgactcggaccgatg

SEQ ID NO: 8930 - DNA, 203 bp, Homo sapiens
ggcgcgccagtcctagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgccgactcggaccgatg

SEQ ID NO: 8931 - DNA, 203 bp, Homo sapiens
ggcgcgccagtcctggacgccgccggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgcctcgcggcgcccatctccgccgactcggaccgatg

SEQ ID NO: 8932 - DNA, 203 bp, Homo sapiens
ggcgcgccagtcctggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgcctcgcggcgcccatctccgccactccggatcgactcggaccgatg

SEQ ID NO: 8933 - DNA, 203 bp, Homo sapiens
ggcgcgccagtcctcctctctcggggcgaacccattccagggcgccctgcccttcacaaagaaaagagaactctccccggggctcccgccggcttctccgggatcggtcgcgttaccgcactggacgcctcgcggcgcccatctccgccactccggattcggggatctgaacccgactccctttcgatcgactcggaccgatg

SEQ ID NO: 8934 - DNA, 203 bp, Homo sapiens
ggcgcgccagtcctccctgcccttcacaaagaaaagagaactctccccggggctcccgccggcttctccgggatcggtcgcgttaccgcactggacgcctcgcggcgcccatctccgccactccggattcggggatctgaacccgactccctttcgatcggccgagggcaacggaggccatcgcccgtcgactcggaccgatg

SEQ ID NO: 8935 - DNA, 203 bp, Homo sapiens
ggcgcgccagtcctccccggggctcccgccggcttctccgggatcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcacgactcggaccgatg

SEQ ID NO: 8936 - DNA, 203 bp, Homo sapiens
ggcgcgccagtcctcccgccggcttctccgggatcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcaggaccgactgcgactcggaccgatg

SEQ ID NO: 8937 - DNA, 203 bp, Homo sapiens
ggcgcgccagtccttctccgggatcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcaggaccgactgacccatgttccgactcggaccgatg

SEQ ID NO: 8938 - DNA, 203 bp, Homo sapiens
ggcgcgccagtcctcggtcgcgttaccgcactggacgcctcgcggcgcccatctccgccactccggattcggggatctgaacccgactccctttcgatcggccgagggcaacggaggccatcgcccgtcccttcggaacggcgctcgcccatctctcaggaccgactgacccatgttcaactgctgttcgactcggaccgatg

SEQ ID NO: 8939 - DNA, 203 bp, Homo sapiens
ggcgcgccagtcctcgatcggccgagggcaacggaggccatcgcccgtcccttcggaacggcgctcgcccatctctcaggaccgactgacccatgttcaactgctgttcacatggaacccttctccacttcggccttcaaagttctcgtttgaatatttgctactaccaccaagatctgcacctgcggcgactcggaccgatg

SEQ ID NO: 8940 - DNA, 203 bp, Homo sapiens
ggcgcgccagtcctagggcaacggaggccatcgcccgtcccttcggaacggcgctcgcccatctctcaggaccgactgacccatgttcaactgctgttcacatggaacccttctccacttcggccttcaaagttctcgtttgaatatttgctactaccaccaagatctgcacctgcggcggctccacccgactcggaccgatg

SEQ ID NO: 8941 - DNA, 203 bp, Homo sapiens
ggcgcgccagtcctccgtcccttcggaacggcgctcgcccatctctcaggaccgactgacccatgttcaactgctgttcacatggaacccttctccacttcggccttcaaagttctcgtttgaatatttgctactaccaccaagatctgcacctgcggcggctccacccgggcccgcgccctaggcttcgactcggaccgatg

SEQ ID NO: 8942 - DNA, 203 bp, Homo sapiens
ggcgcgccagtcctggaacggcgctcgcccatctctcaggaccgactgacccatgttcaactgctgttcacatggaacccttctccacttcggccttcaaagttctcgtttgaatatttgctactaccaccaagatctgcacctgcggcggctccacccgggcccgcgccctaggcttcaaggctcaccgactcggaccgatg

SEQ ID NO: 8943 - DNA, 203 bp, Homo sapiens
ggcgcgccagtcctactgacccatgttcaactgctgttcacatggaacccttctccacttcggccttcaaagttctcgtttgaatatttgctactaccaccaagatctgcacctgcggcggctccacccgggcccgcgccctaggcttcaaggctcaccgcagcggccctcctactcgtcgcggcgtacgactcggaccgatg

SEQ ID NO: 8944 - DNA, 203 bp, Homo sapiens
ggcgcgccagtcctccacttcggccttcaaagttctcgtttgaatatttgctactaccaccaagatctgcacctgcggcggctccacccgggcccgcgccctaggcttcaaggctcaccgcagcggccctcctactcgtcgcggcgtagcgtccgcggggctccgggggcggggagcggggcgtgggccgactcggaccgatg

SEQ ID NO: 8945 - DNA, 203 bp, Homo sapiens
ggcgcgccagtcctctcgtttgaatatttgctactaccaccaagatctgcacctgcggcggctccacccgggcccgcgccctaggcttcaaggctcaccgcagcggccctcctactcgtcgcggcgtagcgtccgcggggctccgggggcggggagcggggcgtgggcgggaggaggggaggaggcgtcgactcggaccgatg

SEQ ID NO: 8946 - DNA, 203 bp, Homo sapiens
ggcgcgccagtcctcacccgggcccgcgccctaggcttcaaggctcaccgcagcggccctcctactcgtcgcggcgtagcgtccgcggggctccgggggcggggagcggggcgtgggcgggaggaggggaggaggcgtgggggggggggcgggggaaggaccccacacccccgccgccgccgccgccgcgactcggaccgatg

SEQ ID NO: 8947 - DNA, 203 bp, Homo sapiens
ggcgcgccagtccttccgacgcacaccacacgcgcgcgcgcgcgcgccgcccccgccgctcccgtccactctcgactgccggcgacggccgggtatgggcccgacgctccagcgccatccattttcagggctagttgattcggcaggtgagttgttacacactccttagcggattccgacttccatggcgactcggaccgatg

SEQ ID NO: 8948 - DNA, 203 bp, Homo sapiens
ggcgcgccagtcctcgccgcccccgccgctcccgtccactctcgactgccggcgacggccgggtatgggcccgacgctccagcgccatccattttcagggctagttgattcggcaggtgagttgttacacactccttagcggattccgacttccatggccaccgtcctgctgtctatatcaaccaacacgactcggaccgatg

SEQ ID NO: 8949 - DNA, 203 bp, Homo sapiens
ggcgcgccagtccttccactctcgactgccggcgacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgacgactcggaccgatg

SEQ ID NO: 8950 - DNA, 203 bp, Homo sapiens
ggcgcgccagtcctactgccggcgacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgagcgtcggcatcgactcggaccgatg

SEQ ID NO: 8951 - DNA, 203 bp, Homo sapiens
ggcgcgccagtcctacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgagcgtcggcatcgggcgccttcgactcggaccgatg

SEQ ID NO: 8952 - DNA, 203 bp, Homo sapiens
ggcgcgccagtcctccatccattttcagggctagttgattcggcaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgcccgactcggaccgatg

SEQ ID NO: 8953 - DNA, 203 bp, Homo sapiens
ggcgcgccagtccttcagggctagttgattcggcaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgccagttctgcttcgactcggaccgatg

SEQ ID NO: 8954 - DNA, 203 bp, Homo sapiens
ggcgcgccagtcctaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgccagttctgcttaccaaaagtggcccactaggcgactcggaccgatg

SEQ ID NO: 8955 - DNA, 203 bp, Homo sapiens
ggcgcgccagtccttccgacttccatggccaccgtcctgctgtctatatcaaccaacaccttttctggggtctgatgagcgtcggcatcgggcgccttaacccggcgttcggttcatcccgcagcgccagttctgcttaccaaaagtggcccactaggcactcgcattccacgcccggctccacgccacgactcggaccgatg

SEQ ID NO: 8956 - DNA, 203 bp, Homo sapiens
ggcgcgccagtcctaacaccttttctggggtctgatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggcgactcggaccgatg

SEQ ID NO: 8957 - DNA, 203 bp, Homo sapiens
ggcgcgccagtcctctggggtctgatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtcgactcggaccgatg

SEQ ID NO: 8958 - DNA, 203 bp, Homo sapiens
ggcgcgccagtcctatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtttcggccccacgactcggaccgatg

SEQ ID NO: 8959 - DNA, 203 bp, Homo sapiens
ggcgcgccagtcctccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtttcggccccaagacctctaatcattcgcttcgactcggaccgatg

SEQ ID NO: 8960 - DNA, 203 bp, Homo sapiens
ggcgcgccagtcctcatcccgcagcgccagttctgcttaccaaaagtggcccactaggcactcgcattccacgcccggctccacgccagcgagccgggcttcttacccatttaaagtttgagaataggttgagatcgtttcggccccaagacctctaatcattcgctttaccggataaaactgcgtggcgactcggaccgatg

SEQ ID NO: 8961 - DNA, 203 bp, Homo sapiens
ggcgcgccagtcctcattccacgcccggctccacgccagcgagccgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttccgactcggaccgatg

SEQ ID NO: 8962 - DNA, 203 bp, Homo sapiens
ggcgcgccagtcctgccagcgagccgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagacgactcggaccgatg

SEQ ID NO: 8963 - DNA, 203 bp, Homo sapiens
ggcgcgccagtcctcgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattcgactcggaccgatg

SEQ ID NO: 8964 - DNA, 203 bp, Homo sapiens
ggcgcgccagtcctacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgccgactcggaccgatg

SEQ ID NO: 8965 - DNA, 203 bp, Homo sapiens
ggcgcgccagtcctagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctataccccgactcggaccgatg

SEQ ID NO: 8966 - DNA, 203 bp, Homo sapiens
ggcgcgccagtccttaggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgcgactcggaccgatg

SEQ ID NO: 8967 - DNA, 203 bp, Homo sapiens
ggcgcgccagtccttcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgccgactcggaccgatg

SEQ ID NO: 8968 - DNA, 203 bp, Homo sapiens
ggcgcgccagtcctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctagggaccgactcggaccgatg

SEQ ID NO: 8969 - DNA, 203 bp, Homo sapiens
ggcgcgccagtcctgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagacgactcggaccgatg

SEQ ID NO: 8970 - DNA, 203 bp, Homo sapiens
ggcgcgccagtcctataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagagtttcctctgcgactcggaccgatg

SEQ ID NO: 8971 - DNA, 203 bp, Homo sapiens
ggcgcgccagtcctgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagagtttcctctggcttcgccctcgactcggaccgatg

SEQ ID NO: 8972 - DNA, 203 bp, Homo sapiens
ggcgcgccagtcctcttcggagggaaccagctactagatggttcgattagtctttcgcccctatacccaggtcggacgaccgatttgcacgtcaggaccgctacggacctccaccagagtttcctctggcttcgccctgcccaggcatagttcaccatctttcgggtcctaacacgtgcgctcgtgctcgactcggaccgatg

SEQ ID NO: 8973 - DNA, 203 bp, Homo sapiens
ggcgcgccagtccttagatggttcgattagtctttcgcccctatacccaggtcggacgaccgatttgcacgtcaggaccgctacggacctccaccagagtttcctctggcttcgccctgcccaggcatagttcaccatctttcgggtcctaacacgtgcgctcgtgctccacctccccggcgcggcggcgactcggaccgatg

SEQ ID NO: 8974 - DNA, 203 bp, Homo sapiens
ggcgcgccagtccttcgcccctatacccaggtcggacgaccgatttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgccgactcggaccgatg

SEQ ID NO: 8975 - DNA, 203 bp, Homo sapiens
ggcgcgccagtcctgacgaccgatttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgcgccctcggcggactggagagcgactcggaccgatg

SEQ ID NO: 8976 - DNA, 203 bp, Homo sapiens
ggcgcgccagtcctttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgcgccctcggcggactggagaggcctcgggatcgactcggaccgatg

SEQ ID NO: 8977 - DNA, 203 bp, Homo sapiens
ggcgcgccagtcctgcatagttcaccatctttcgggtcctaacacgtgcgctcgtgctccacctccccggcgcggcgggcgagacgggccggtggtgcgccctcggcggactggagaggcctcgggatcccacctcggccggcgagcgcgccggccttcaccttcattgcgccacggcggctttcgtgcgactcggaccgatg

SEQ ID NO: 8978 - DNA, 203 bp, Homo sapiens
ggcgcgccagtcctgtgcgccctcggcggactggagaggcctcgggatcccacctcggccggcgagcgcgccggccttcaccttcattgcgccacggcggctttcgtgcgagcccccgactcgcgcacgtgttagactccttggtccgtgtttcaagacgggtcgggtgggtagccgacgtcgccgcccgactcggaccgatg

SEQ ID NO: 8979 - DNA, 203 bp, Homo sapiens
ggcgcgccagtcctagaggcctcgggatcccacctcggccggcgagcgcgccggccttcaccttcattgcgccacggcggctttcgtgcgagcccccgactcgcgcacgtgttagactccttggtccgtgtttcaagacgggtcgggtgggtagccgacgtcgccgccgaccccgtgcgctcgctccgcgactcggaccgatg

SEQ ID NO: 8980 - DNA, 203 bp, Homo sapiens
ggcgcgccagtccttcggccggcgagcgcgccggccttcaccttcattgcgccacggcggctttcgtgcgagcccccgactcgcgcacgtgttagactccttggtccgtgtttcaagacgggtcgggtgggtagccgacgtcgccgccgaccccgtgcgctcgctccgccgtccccctcttcgggggacgactcggaccgatg

SEQ ID NO: 8981 - DNA, 203 bp, Homo sapiens
ggcgcgccagtcctcattgcgccacggcggctttcgtgcgagcccccgactcgcgcacgtgttagactccttggtccgtgtttcaagacgggtcgggtgggtagccgacgtcgccgccgaccccgtgcgctcgctccgccgtccccctcttcgggggacgcgcgcgtggccccgagagaacctccccccgactcggaccgatg

SEQ ID NO: 8982 - DNA, 203 bp, Homo sapiens
ggcgcgccagtcctgcggggaggaggggtgggagagcggtcgcgccgtgggaggggtggcccggcccccccacgaggagacgcccgcgcgcccccgcgggggagacccccctcgcgggggattccccgcgggggtgggcgccgggaggggggagagcgcggcgacgggtctcgctccctcggccccggcgactcggaccgatg

SEQ ID NO: 8983 - DNA, 203 bp, Homo sapiens
ggcgcgccagtcctcgcgggggagacccccctcgcgggggattccccgcgggggtgggcgccgggaggggggagagcgcggcgacgggtctcgctccctcggccccgggattcggcgagtgctgctgccgggggggctgtaacactcggggggggtttcggtcccgccgccgccgccgccgccgccaccgactcggaccgatg

SEQ ID NO: 8984 - DNA, 203 bp, Homo sapiens
ggcgcgccagtcctagcgcggcgacgggtctcgctccctcggccccgggattcggcgagtgctgctgccgggggggctgtaacactcggggggggtttcggtcccgccgccgccgccgccgccgccaccgccgccgccgccgccgccccgacccgcgcgccctcccgagggaggacgcggggccggggcgactcggaccgatg

SEQ ID NO: 8985 - DNA, 203 bp, Homo sapiens
ggcgcgccagtcctcgccgccgccgccccgacccgcgcgccctcccgagggaggacgcggggccggggggcggagacgggggaggaggaggacggacggacggacggacggggccccccgagccaccttccccgccgggccttcccagccgtcccggagccggtcgcggcgcaccgccgcggtggaaacgactcggaccgatg

SEQ ID NO: 8986 - DNA, 203 bp, Homo sapiens
ggcgcgccagtcctggggaagggagggcgggtggaggggtcgggaggaacggggggcgggaaagatccgccgggccgccgacacggccggacccgccgccgggttgaatcctccgggcggactgcgcggaccccacccgtttacctcttaacggtttcacgccctcttgaactctctcttcaaagttccgactcggaccgatg

SEQ ID NO: 8987 - DNA, 203 bp, Homo sapiens
ggcgcgccagtcctggcgggaaagatccgccgggccgccgacacggccggacccgccgccgggttgaatcctccgggcggactgcgcggaccccacccgtttacctcttaacggtttcacgccctcttgaactctctcttcaaagttcttttcaactttcccttacggtacttgttgactatcggtctcgactcggaccgatg

SEQ ID NO: 8988 - DNA, 203 bp, Homo sapiens
ggcgcgccagtcctgccgccgggttgaatcctccgggcggactgcgcggaccccacccgtttacctcttaacggtttcacgccctcttgaactctctcttcaaagttcttttcaactttcccttacggtacttgttgactatcggtctcgtgccggtatttagccttagatggagtttaccacccgctcgactcggaccgatg

SEQ ID NO: 8989 - DNA, 203 bp, Homo sapiens
ggcgcgccagtccttgaatcctccgggcggactgcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcacgactcggaccgatg

SEQ ID NO: 8990 - DNA, 203 bp, Homo sapiens
ggcgcgccagtcctcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactcccgactcggaccgatg

SEQ ID NO: 8991 - DNA, 203 bp, Homo sapiens
ggcgcgccagtcctctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggcccggcgcgactcggaccgatg

SEQ ID NO: 8992 - DNA, 203 bp, Homo sapiens
ggcgcgccagtccttttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggccccgcgcgccgggggccgactcggaccgatg

SEQ ID NO: 8993 - DNA, 203 bp, Homo sapiens
ggcgcgccagtccttcttgaactctctcttcaaagttcttttcaactttcccttacggtacttgttgactatcggtctcgtgccggtatttagccttagatggagtttaccacccgctttgggctgcattcccaagcaacccgactccgggaagacccgggccccgcgcgccgggggccgctaccggccgactcggaccgatg

SEQ ID NO: 8994 - DNA, 203 bp, Homo sapiens
ggcgcgccagtcctttgactatcggtctcgtgccggtatttagccttagatggagtttaccacccgctttgggctgcattcccaagcaacccgactccgggaagacccgggccccgcgcgccgggggccgctaccggcctcacaccgtccacgggctgggcctcgatcagaaggacttgggccccccacgactcggaccgatg

SEQ ID NO: 8995 - DNA, 203 bp, Homo sapiens
ggcgcgccagtcctgtctcgtgccggtatttagccttagatggagtttaccacccgctttgggctgcattcccaagcaacccgactccgggaagacccgggccccgcgcgccgggggccgctaccggcctcacaccgtccacgggctgggcctcgatcagaaggacttgggccccccacgagcggcgccgactcggaccgatg

SEQ ID NO: 8996 - DNA, 203 bp, Homo sapiens
ggcgcgccagtcctcgctttgggctgcattcccaagcaacccgactccgggaagacccgggccccgcgcgccgggggccgctaccggcctcacaccgtccacgggctgggcctcgatcagaaggacttgggccccccacgagcggcgccggggagcgggtcttccgtacgccacatgtcccgcgcccccgactcggaccgatg

SEQ ID NO: 8997 - DNA, 203 bp, Homo sapiens
ggcgcgccagtccttgcattcccaagcaacccgactccgggaagacccgggccccgcgcgccgggggccgctaccggcctcacaccgtccacgggctgggcctcgatcagaaggacttgggccccccacgagcggcgccggggagcgggtcttccgtacgccacatgtcccgcgccccgccgcggggccgactcggaccgatg

SEQ ID NO: 8998 - DNA, 203 bp, Homo sapiens
ggcgcgccagtcctgggccgctaccggcctcacaccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgagggaacgactcggaccgatg

SEQ ID NO: 8999 - DNA, 203 bp, Homo sapiens
ggcgcgccagtcctccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgagggaatcctggttagtttcttctcccgactcggaccgatg

SEQ ID NO: 9000 - DNA, 203 bp, Homo sapiens
ggcgcgccagtcctacttgggccccccacgagcggcgccggggagcgggtcttccgtacgccacatgtcccgcgccccgccgcggggcggggattcggcgctgggctcttccctgttcactcgccgttactgagggaatcctggttagtttcttctcctccgctgactaatatgcttaaattcagcggcgactcggaccgatg

SEQ ID NO: 9001 - DNA, 203 bp, Homo sapiens
ggcgcgccagtcctcccacgagcggcgccggggagcgggtcttccgtacgccacatgtcccgcgccccgccgcggggcggggattcggcgctgggctcttccctgttcactcgccgttactgagggaatcctggttagtttcttctcctccgctgactaatatgcttaaattcagcgggtcgccacgtcgactcggaccgatg

SEQ ID NO: 9002 - DNA, 203 bp, Homo sapiens
ggcgcgccagtcctgcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacgactcggaccgatg

SEQ ID NO: 9003 - DNA, 203 bp, Homo sapiens
ggcgcgccagtcctgattacagtgccaaccttactcccaaagtttgccacgaaatatctcgcttctgttattttcgcatggttctggtatattgacttttgaaacaaaagacatcattctgtttatagcattctgtttttagtagtgggatttccatctacaaaatatagtaattctcgatcgctgaacgactcggaccgatg

SEQ ID NO: 9004 - DNA, 203 bp, Homo sapiens
ggcgcgccagtcctatgtcctacaactgctgctgtggaaacttctcctcccattcctgtgagggctacctgtgctactcaggctactcccgtggtggctcctcgtaccccagcaacctggtctacagcactgaacctttgatctcccagcacctgccagctgggttcctctctctgcaagggctttcacgactcggaccgatg

SEQ ID NO: 9005 - DNA, 203 bp, Homo sapiens
ggcgcgccagtcctagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgaggtgtgttctactccctcttctgggacgactcggaccgatg

SEQ ID NO: 9006 - DNA, 203 bp, Homo sapiens
ggcgcgccagtcctgcccccgccccctactcccttccctcaggccccaggaagttgcaagagtaccatttgtcgcacactcggggaccgcgggtggccggaggagatgaaaccgtcttggctgcagtgtcgtaaagtcaccagcgccggggggctcggagggcccttgcctgggtcctctccggcccgcgactcggaccgatg

SEQ ID NO: 9007 - DNA, 203 bp, Homo sapiens
ggcgcgccagtcctggaatacctaggcctccagactactccccctaactcatatttagattcctgaagcttctgcacatgtagttcctagagctgctgcttattaaaatgtcaacatcttcatcttctagctgggacaacctcttagagtctctctctctcagcacagtatggaattggatacaagcacgactcggaccgatg

SEQ ID NO: 9008 - DNA, 203 bp, Homo sapiens
ggcgcgccagtcctgcgggattccaaggcctcatcgagtgcgggtatctggctgtggattcgccgccgtcctgctggacgcctggaggctcgaaccccgccgcccccctaccccaggctttactcccaccccggcttccgcccactgtgctgcccttcctcggacctgggctgtcgggagagctggagcgactcggaccgatg

SEQ ID NO: 9009 - DNA, 203 bp, Homo sapiens
ggcgcgccagtcctggctaccatggtaacaggttccagggtaacagaggagggagctgggtcctgtttactcccagtcctgccgatgaggattctgaccgtagacactgaattgtcccgtacctatccgtgctctttctgtgttctcaccagggctgagctcgaactgccacctctgccagcaggacccgactcggaccgatg

SEQ ID NO: 9010 - DNA, 203 bp, Homo sapiens
ggcgcgccagtcctacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctcgactcggaccgatg

SEQ ID NO: 9011 - DNA, 203 bp, Homo sapiens
ggcgcgccagtcctagatgtccccggccggcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatccccgactcggaccgatg

SEQ ID NO: 9012 - DNA, 203 bp, Homo sapiens
ggcgcgccagtcctcgaggctgcaccagcgcctggcaccatgaggacgcctgggcctctgcccgtgctgctgctgctcctggcgggagcccccgccgcgcggcccactcccccgacctgctactcccgcatgcgggccctgagccaggagatcacccgcgacttcaacctcctgcaggtctcggagcccgactcggaccgatg

SEQ ID NO: 9013 - DNA, 203 bp, Homo sapiens
ggcgcgccagtcctcctctcttccagggctgccgtccacactctcccggtcagagtcctgggaccacatggggacgctgccatggcttcttgccttcttcattctgggtctccaggcttgggatactcccaccatcgtctcccgcaaggagtggggggcaagaccgctcgcctgcagggccctgctgacgactcggaccgatg

SEQ ID NO: 9014 - DNA, 203 bp, Homo sapiens
ggcgcgccagtccttaattttgccctaggtctggccaggaggcctcacatccagagacctgcccccgctcttgcagtgccagggccatggggctccggagccaccacctcagcctgggccttctgcttctgtttctactccctgcagagtgcctgggagctgagggccggctggctctcaagctgttccgactcggaccgatg

SEQ ID NO: 9015 - DNA, 203 bp, Homo sapiens
ggcgcgccagtcctcccgctgcctgcaagtcagcctggctccgagtcacgtgtcagtgcctgaggcagagactgcgagaaaaaaacgcgcttcattccttcttccaccgccatactgtattttatactaaatctcatttttattccaacattttactcccgctcggattaaagcaaggagagccaatccgactcggaccgatg

SEQ ID NO: 9016 - DNA, 203 bp, Homo sapiens
ggcgcgccagtccttcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcaggggcgactcggaccgatg

SEQ ID NO: 9017 - DNA, 203 bp, Homo sapiens
ggcgcgccagtcctgaaacagattcggaatatgtgaagctcgcgaaacaaggtggcaggcccgatttgttgaagcactttgcccctggaaccaggaaaggctctccagtggcctactccctgccagactggtatatccaccacagcaagccaccgacagccagccagcaagaagtgcgggctgtctcccgactcggaccgatg

SEQ ID NO: 9018 - DNA, 203 bp, Homo sapiens
ggcgcgccagtcctagtaggagtggagagcgtgcgtgagtgagtgtgtgtgtgtgtgtgtgtgtgtgtgcatgcgtgtgtgaagaatgcacactatctcctgttggtaagtgtgtgcttactccctgaccagatgctgcggtgcacggggcagccaccatctctgcatgcatgtctgtgatgtcttcccgactcggaccgatg

SEQ ID NO: 9019 - DNA, 203 bp, Homo sapiens
ggcgcgccagtcctgctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaacccgactcggaccgatg

SEQ ID NO: 9020 - DNA, 203 bp, Homo sapiens
ggcgcgccagtcctgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggaaccataaatcccgactcggaccgatg

SEQ ID NO: 9021 - DNA, 203 bp, Homo sapiens
ggcgcgccagtcctagtttgcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggacgactcggaccgatg

SEQ ID NO: 9022 - DNA, 203 bp, Homo sapiens
ggcgcgccagtcctgcccatggctgagacctctctcccagagctggggggagaggacaaagccacgccttgccccagcatcctggagctggaggagctcctgcgggcagggaagtcttcttgcagccgtgtggacgaagtttggcccaaccttttcataggagatgcagctggtccttactccctgcccgactcggaccgatg

SEQ ID NO: 9023 - DNA, 203 bp, Homo sapiens
ggcgcgccagtcctgacctgcggctccgccccagaggccgccatcttcctgaccacccgaaaggccggacctactccccggtgcatcttgggatcagggcggggccctgagcgccgccatgcttttgtacggcaggatcgcaaagcacgccgggaccggttggtttggttttgaagacgtggatggcgcgactcggaccgatg

SEQ ID NO: 9024 - DNA, 203 bp, Homo sapiens
ggcgcgccagtcctagcttcttctagaagcaggccctgaacaggacgtgggtaagagatccgctgtcccttgagacttggcctactcccggcactccgcggacagccccagcctgcggacagccccagcctgcgtcacttgtccgcatgccagctccacccgggcggacccacacatggttcctacttcgactcggaccgatg

SEQ ID NO: 9025 - DNA, 203 bp, Homo sapiens
ggcgcgccagtcctggcccgcagtcctactcccgccgagacccgccgctccggtcctgccccgaactgcccacggccggcagcgcttccaggccctgaaaaaaactctcttcctgtgtctggccagaggtatagagagagacaggttcaactctaaggcctgaaaaggaacaaggcccaccggaagcacgactcggaccgatg

SEQ ID NO: 9026 - DNA, 203 bp, Homo sapiens
ggcgcgccagtcctggccgcaggtttgactcccgtgcggtgcggcccagcagccacaaagctcccgctgccattgctccttgtactcccgccgtcactgccgctgtccaacccctcccccggggcttgcgcggcggctcccacacccctcggcccgtgtacgcgctctgcacctgcctgcccgaaaaccgactcggaccgatg

SEQ ID NO: 9027 - DNA, 203 bp, Homo sapiens
ggcgcgccagtcctattggactcctagatccgcgagggcgcggcgcagccgagcagcggctctttcagcattggcaaccccaggggccaatatttcccacttagccacagctccagcatcctctctgtgggctgttcaccaactgtacaaccaccatttcactgtggacattactccctcttacagatcgactcggaccgatg

SEQ ID NO: 9028 - DNA, 203 bp, Homo sapiens
ggcgcgccagtcctctttccgacactctttgggaagagaatctctaatgacggcaacagtggagaacctaacgttccagaaggacactttgggaaatgctgttgacaaaaacacatccagattggagctccgttcttactcccttgcagggcgccacggctcgacagagccactcgtcctcgcctggtcgactcggaccgatg

SEQ ID NO: 9029 - DNA, 203 bp, Homo sapiens
ggcgcgccagtcctcccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcacgactcggaccgatg

SEQ ID NO: 9030 - DNA, 203 bp, Homo sapiens
ggcgcgccagtcctaagtgttgcgcaggcgcatccgatcgactcggtaggtggggatctcttggagacggcgacccaggcatctggggagccacagaagtcgtactcccttaaaccctgctttgctccccctgtggatgtaaccccttagctggcattttgcatctcaattggcttgtgatggaggcgcgactcggaccgatg

SEQ ID NO: 9031 - DNA, 203 bp, Homo sapiens
ggcgcgccagtcctgagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttccgactcggaccgatg

SEQ ID NO: 9032 - DNA, 203 bp, Homo sapiens
ggcgcgccagtcctccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccacgactcggaccgatg

SEQ ID NO: 9033 - DNA, 203 bp, Homo sapiens
ggcgcgccagtccttttttcacccgcgctctccccccttactccctcagcctcccacccgggatggagccatgtgcggcgtggagtccccgcggtgggagagagaatgtaatggacatcggtctgaccaacgagaagcccaacccggaactctcttactccggctccttccagccagcccccggcaaccgactcggaccgatg

SEQ ID NO: 9034 - DNA, 203 bp, Homo sapiens
ggcgcgccagtcctaatctctacgttcaaagtctaactttgacagacaaccttacttccagcgaagtctactcccctccctccggagggaagaatgggctgcggttaagcgtttgccctggtgtcagggccaactgcttcgaagcgccagactttcggagactgtgggtggggagcattaagcgggaacgactcggaccgatg

SEQ ID NO: 9035 - DNA, 203 bp, Homo sapiens
ggcgcgccagtcctagcggggagagacaagaaaggggtcaagttagctcagctgggcccagcctctcctctgtctctcctcggtctcagctctgggcgagcagcggcctgtctgaagagcatgcagcccccttactccccgcctggcctcgccatccctgcccccccagcctgacccccggccccagccgactcggaccgatg

SEQ ID NO: 9036 - DNA, 203 bp, Homo sapiens
ggcgcgccagtcctcagggcgacgggagctttccggagctgctggtactcccgattggagacgtagaaccgttacttgtcgagggccttagcggccgccgtgaccctctcggggatcccacgatgttcttctacctgagcaagaaaatttccattcccaataacgtgaagctgcagtgtgtatcctggcgactcggaccgatg

SEQ ID NO: 9037 - DNA, 203 bp, Homo sapiens
ggcgcgccagtcctttgctgagcgcagtccagagggctgcgctgctcgtcccctcggctggcagaagggggtgacgctgggcagcggcgaggagcgcgccgctgcctctggcgggctttcggcttgaggggcaaggtgaagagcgcaccggccgtggggtttaccgagctggatttgtatgttgcacccgactcggaccgatg

SEQ ID NO: 9038 - DNA, 203 bp, Homo sapiens
ggcgcgccagtcctgttttgactgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccacgactcggaccgatg

SEQ ID NO: 9039 - DNA, 203 bp, Homo sapiens
ggcgcgccagtcctgcagcgccgagggaggctgccagtgcgtgaggaagagagctagagactggacaggggagacagagcagcgtcggagccgcgcaggggacgggagtgagagcgggagtgagagcaggaacgacgcagagcggccgtcgccgtgcccgggtctcagggcgcctggctgaagtgagccgactcggaccgatg

SEQ ID NO: 9040 - DNA, 203 bp, Homo sapiens
ggcgcgccagtcctgcagcgcaaggttggataagacgccgccgctcacgcccgctatcaggttctcataccggacgtggcggaataccgtgctccacgccgacgacccggacgccgactggccctggcccgtcataggctcggggcccgtcgacaccacggcgcccagggccgcggaggtgggacgcgcgactcggaccgatg

SEQ ID NO: 9041 - DNA, 203 bp, Homo sapiens
ggcgcgccagtcctggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggcgactcggaccgatg

SEQ ID NO: 9042 - DNA, 203 bp, Homo sapiens
ggcgcgccagtcctatggcctcgctggacctgccgtaccgctgcccccgctgcggggagcacaagcgcttccggagcctgtcgtcgctgcgcgcgcacctggagtacagccacacctacgagacgctctacatcctctccaagaccaacagcatctgcgacggcgccgccgccgccgcggccgccgcccgactcggaccgatg

SEQ ID NO: 9043 - DNA, 203 bp, Homo sapiens
ggcgcgccagtccttaggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtcgactcggaccgatg

SEQ ID NO: 9044 - DNA, 203 bp, Homo sapiens
ggcgcgccagtcctcgcgggcgttcgggggcggggcctgttccctctgctctgggtctccgccggcgcccgccccgccagcctcacctgcgcggcacgtgacccgcaccgcccgtgggcaccttgaaggcggatcccgcgcgcccccgctcctgcaggctgtttttcttcaaataaagaacatggtgacgactcggaccgatg

SEQ ID NO: 9045 - DNA, 203 bp, Homo sapiens
ggcgcgccagtcctacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacgactcggaccgatg

SEQ ID NO: 9046 - DNA, 203 bp, Homo sapiens
ggcgcgccagtcctctctctcggcgtttccgctgtcagggccctgcggtgtgactcgcgggctcagctggttggtccggccgtagcacctccgcgccgtcgccatgtcgcggtttttcaccaccggttcggacagcgagtccgagtcgtccttgtccggggaggagctcgtcaccaaacctgtcggagcgactcggaccgatg

SEQ ID NO: 9047 - DNA, 203 bp, Homo sapiens
ggcgcgccagtcctgtcaggccccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggtcgactcggaccgatg

SEQ ID NO: 9048 - DNA, 203 bp, Homo sapiens
ggcgcgccagtcctgacgtcaggccccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattcgactcggaccgatg

SEQ ID NO: 9049 - DNA, 203 bp, Homo sapiens
ggcgcgccagtcctagacttcctccttcacttgcctggacgctgcgccacatcccaccggcccttacactgtggtgtccagcagcatccggcttcatggggggacttgaaccctgcagcaggctcctgctcctgcctctcctgctggctgtaagtgattgcagttgctctacggtgagcccgggcgtgcgactcggaccgatg

SEQ ID NO: 9050 - DNA, 203 bp, Homo sapiens
ggcgcgccagtcctcagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcacccgactcggaccgatg

SEQ ID NO: 9051 - DNA, 203 bp, Homo sapiens
ggcgcgccagtcctgggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaacgactcggaccgatg

SEQ ID NO: 9052 - DNA, 203 bp, Homo sapiens
ggcgcgccagtccttccccaacaaacagtacctgggatggagccctagggtaatcgcagccacgggatgggtcgaggtgacaggcttcagggaccacacttcggcctttgcccgaccttccacaacttaagcgaagagaggccaccagccgtaacagggcgttaaagcccaggggaagattggtccttcgactcggaccgatg

SEQ ID NO: 9053 - DNA, 203 bp, Homo sapiens
ggcgcgccagtcctatgggcctgctggccagtgctggtttgttgctgttgctggtcatcggccaccccagaagcctaggactgaagtgtggaattcgcatggtcaacatgaaaagtaaggaacctgccgtgggatctagattcttctctagaattagtagttggagaaattcaacagtgactggacatcgactcggaccgatg

SEQ ID NO: 9054 - DNA, 203 bp, Homo sapiens
ggcgcgccagtcctcgggtgagtcccacttcccgacagcctggctcggccagcgactgggcggggagaccaaggatggaagtgggcttaccggccattaccctctttctcaccagcgccagcagccctgtggtggcgacgacgatggaccaggagccagtgggcggtgtggaacgaggagaagccgtccgactcggaccgatg

SEQ ID NO: 9055 - DNA, 203 bp, Homo sapiens
ggcgcgccagtcctatgtcctatccgcagggctacttgtaccagccgtccgcctcgctggcgctctactcgtgcccggcgtacagcaccagcgtcatttcggggccccgcacggatgagctcggccgctcttcttcgggctccgcgttctcgccctacgctggctcgactgccttcacggcgccctcgcgactcggaccgatg

SEQ ID NO: 9056 - DNA, 203 bp, Homo sapiens
ggcgcgccagtcctgggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggcgactcggaccgatg

SEQ ID NO: 9057 - DNA, 203 bp, Homo sapiens
ggcgcgccagtcctgagccctgctgccctccagccgggctcctccagccgggctcctccaccggcccttgcaggggcgcagagagctcggcgcccgcccttccgctcgcctttttcgtcagccggctggaggagcatgggtccgggaggtctctgggctgaggcggcgacagctcctctagttccacccgactcggaccgatg

SEQ ID NO: 9058 - DNA, 203 bp, Homo sapiens
ggcgcgccagtcctgggtagaagcggcagagaccgcatattccggaggggctggctccaggccacgcgagccggagctggagacatttccagagccttgaggatggcaccggccctcgcacgctcaactcctgctcctcctcttcgcaatgagtaaacgacgcagattaaagcaaggagagccaatcacgactcggaccgatg

SEQ ID NO: 9059 - DNA, 203 bp, Homo sapiens
ggcgcgccagtcctttccctaggtcttttcggaggcggagtttagtatccaagtccgcgggtgtgagcgcgcgcgtgtgtccgcgcgcctcgcccggcgcccccgccagtcctgccggaagatggtcaacgaccggtggaagaccatgggcggcgctgcccaacttgaggaccggccgcgcgacaagccgactcggaccgatg

SEQ ID NO: 9060 - DNA, 203 bp, Homo sapiens
ggcgcgccagtcctccagtctcctggcgactttccctatatcgcagagactcatccctctgaccccagcccggaagcactgtccctcggagtccgagacttccacctgggtcgtgtccaaggccccggcgactccccggactcggggtgccgggccaacctccccgccgaggcccacccgccgtcgctcgactcggaccgatg

SEQ ID NO: 9061 - DNA, 203 bp, Homo sapiens
ggcgcgccagtcctggtgcgcatgcgcccggagagctgaagggcgcgcggtgccgacagggagcttccttggctggcatggcggcgagcgcgctgcgaggcctgccagtggctggcggaggcgagagtagcgagagcgaggatgatggctgggagattgggtatctcgaccggacgtctcagaaattgcgactcggaccgatg

SEQ ID NO: 9062 - DNA, 203 bp, Homo sapiens
ggcgcgccagtcctcgccaatcggtgcagactccggttctccccaaccccgggcctgggcagctgggcactggggcgccgttccccacccggcgcggacttcggaaccggccctgggactgactggctctaccactcgagcgcgtctccgctggacccggaaccccggtcggtccattccccgcgaagcgactcggaccgatg

SEQ ID NO: 9063 - DNA, 203 bp, Homo sapiens
ggcgcgccagtcctatttccaggaacttcctcctcccccaccggccttcaccttttgttccctatcctgggccagttctctcgcaggtcccagatgtccagttccagatgcctggacccagagtgtgggggaaatatctctggagaagccctcactccaaaggctgtccaggcgcaatgtggtggctgcgactcggaccgatg

SEQ ID NO: 9064 - DNA, 203 bp, Homo sapiens
ggcgcgccagtccttctttcctttctttccgcctatcttttttctgctgccgctccgggtccgggccattttccgggccgggcgcactaaggtgcgcggccccggggcccagtatatgacccgccgtcctgctatccttcgcttcccccgccccatgtggctgcggggccgcggcggcgctgcccactcgactcggaccgatg

SEQ ID NO: 9065 - DNA, 203 bp, Homo sapiens
ggcgcgccagtcctccacgttacggatcggcttactccgcggagttggcctcatttctgcagtcggcgctccctgtagtttctcctctcgaacgccaggtggagcaaccggccggataccgccacagccctggcaggcggcgctgtgatgcctgagctgatcctgtatgttgcaatcactctatccgtcgactcggaccgatg

SEQ ID NO: 9066 - DNA, 203 bp, Homo sapiens
ggcgcgccagtcctgagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatcgactcggaccgatg

SEQ ID NO: 9067 - DNA, 203 bp, Homo sapiens
ggcgcgccagtcctcccgggacagccctcggagaaactgcatcatcctcactaatgatccacttcctcctcagggaataaaggctcagggaccggcagttctactctagagcccaccagcctctcagagcctccggtgactggcctgtgtctccccctggatggacatgtggacggcgctgctcatcccgactcggaccgatg

SEQ ID NO: 9068 - DNA, 203 bp, Homo sapiens
ggcgcgccagtcctatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcacgactcggaccgatg

SEQ ID NO: 9069 - DNA, 203 bp, Homo sapiens
ggcgcgccagtcctggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaacgactcggaccgatg

SEQ ID NO: 9070 - DNA, 203 bp, Homo sapiens
ggcgcgccagtcctggagcctgccgctccccgcgctcgtagcgcgggcctggggactggggatcccgccgccgggccgcagcatggggcgcttccgcgggggcctgcggtgcatcaagtacctgctgcttggcttcaacctgctcttctggctggctggatcggccgtcattgcttttggactatggtcgactcggaccgatg

SEQ ID NO: 9071 - DNA, 203 bp, Homo sapiens
ggcgcgccagtcctaaacaataacaaacgggaggaggaagcgattctggggtttctgtgttgaacggttcttgtccgcgaagatgcgcttcggcctctgtcaggggacttgaacgggcttagtgggcttcagccagcttttctccaccggttccccacggggacccccccccccccccggccgttgcacgactcggaccgatg

SEQ ID NO: 9072 - DNA, 203 bp, Homo sapiens
ggcgcgccagtcctagccaaggcttactgaggctggtggagggagccactgctgggctcaccatggaccgccggatgtggggggcccacgtcttctgcgtgttgagcccgttaccgaccgtattgggccacatgcacccagaatgtgacttcatcacccagctgagagaggatgagagtgcctgtctacgactcggaccgatg

SEQ ID NO: 9073 - DNA, 203 bp, Homo sapiens
ggcgcgccagtcctcgactccgctggtcagcgccaagtgacttacgcccccgaccctgagccgggaccgctaggcgaggaggatcagatctccgctcgagaatctgaaggtgccctggtcctggaggagttccgtcccagcccgcggtctcccgggccgccctcctgaccggccggctcccggttcggcgactcggaccgatg

SEQ ID NO: 9074 - DNA, 203 bp, Homo sapiens
ggcgcgccagtcctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggcgactcggaccgatg

SEQ ID NO: 9075 - DNA, 203 bp, Homo sapiens
ggcgcgccagtcctgcgcagccgcggtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagcgactcggaccgatg

SEQ ID NO: 9076 - DNA, 203 bp, Homo sapiens
ggcgcgccagtcctacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagcccgactcggaccgatg

SEQ ID NO: 9077 - DNA, 203 bp, Homo sapiens
ggcgcgccagtcctgccgcagctgctgcacccacccccaccctgcccggccctttctgcaccgtcatctcctgccccgccgaggcttgacccccccgacaatgggcaacgcgcaggagcggccgtcagagactatcgaccgcgagcggaaacgcctggtcgagacgctgcaggcggactcgggactgccgactcggaccgatg

SEQ ID NO: 9078 - DNA, 203 bp, Homo sapiens
ggcgcgccagtcctgtccgttggccagatcaactcgccgcgtgggccggccgttccctgagagtctgagcgctcgccgcacccccttccgagcttctattggccgtagcagacgtccgtctgccgctatctccgccccaatacggaagcggcctagtcctccggctccgacagctgggtgtccaggcccgactcggaccgatg

SEQ ID NO: 9079 - DNA, 203 bp, Homo sapiens
ggcgcgccagtcctatggctcgtactaaacagacagctcggaaatccaccggcggtaaagcgccacgcaagcagctggctaccaaggctgctcgcaagagcgcgccggctaccggcggcgtgaaaaagcctcaccgttaccgcccgggcactgtggctctgcgcgagatccgccgctaccaaaagtcgcgactcggaccgatg

SEQ ID NO: 9080 - DNA, 203 bp, Homo sapiens
ggcgcgccagtcctatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcgcgactcggaccgatg

SEQ ID NO: 9081 - DNA, 203 bp, Homo sapiens
ggcgcgccagtcctccgggaaacctgccattcttcgctgctgatcgcgggattctttttggatagggttgacgttcgtggatagactcatatctgtgaccagtgtccgccaccgcggatggcaagagacctgatgggaccggccctgccgcccggcttcaaggcccgcggaacagcggaggacgaagacgactcggaccgatg

SEQ ID NO: 9082 - DNA, 203 bp, Homo sapiens
ggcgcgccagtcctggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatcgactcggaccgatg

SEQ ID NO: 9083 - DNA, 203 bp, Homo sapiens
ggcgcgccagtcctctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctacgactcggaccgatg

SEQ ID NO: 9084 - DNA, 203 bp, Homo sapiens
ggcgcgccagtcctctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggcgactcggaccgatg

SEQ ID NO: 9085 - DNA, 203 bp, Homo sapiens
ggcgcgccagtccttttcgccagtccgtccggccgttccgcattaggtccgggataactaggtggagtaggtgtgcggcccgccgccggacagcccgctcgctgtttctttaagcccccgcctgcgtcttcacggccctctcccgttctgctggaaagctgacgtggggcaatccgttcagaccctcccgactcggaccgatg

SEQ ID NO: 9086 - DNA, 203 bp, Homo sapiens
ggcgcgccagtcctaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagcgactcggaccgatg

SEQ ID NO: 9087 - DNA, 203 bp, Homo sapiens
ggcgcgccagtcctacccagtgattgtatttgatgacttttaagctttcatatgccgttatttaatacctgtcacttccaaatgagagatgtaagggcaacggccgttagcgttctgttttggatcaggctctggagtggacgcccctagcttaggggtccttctaggcagccagaaacctgcggaaacgactcggaccgatg

SEQ ID NO: 9088 - DNA, 203 bp, Homo sapiens
ggcgcgccagtcctgggtggtggatctgtcggtcccgttttcccgtcgcacgtggtggccactgttggcttctgaatggtttgcaaggcggatatccacgccaaggcctttggatcggccgtgggtacatccgtctgagccgttcctttccatcgcagagcggcggcctccggcggcgctctccagtccgactcggaccgatg

SEQ ID NO: 9089 - DNA, 203 bp, Homo sapiens
ggcgcgccagtcctcttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgccctcgactcggaccgatg

SEQ ID NO: 9090 - DNA, 203 bp, Homo sapiens
ggcgcgccagtcctactcccggttcgcggcgctgggagcggccgtgacgtcaggcgcccggctgctcctcacttgctctgagacaggtgcggcaagtctactgcgggctggtccgggctcctcaggttcagacccgaccgttatccagtcggttcgtggagaggagaggtgcactttacaggtccccgcgactcggaccgatg

SEQ ID NO: 9091 - DNA, 203 bp, Homo sapiens
ggcgcgccagtcctagctgcgccggtgactgaggggccgggcagtggagaagtggtggcggcgggcggcgggcggcaaaggagcagccatgagggccgggcccagtcaccgaccgtgctgaggagtcatggaagagtttttaaaccagtgtgagccactgccccatgttgtgttgatgccaatctgcccgactcggaccgatg

SEQ ID NO: 9092 - DNA, 203 bp, Homo sapiens
ggcgcgccagtccttgcgcggcgcatgcgtggcccggggtctcggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgcgactcggaccgatg

SEQ ID NO: 9093 - DNA, 203 bp, Homo sapiens
ggcgcgccagtcctgcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgcccgactcggaccgatg

SEQ ID NO: 9094 - DNA, 203 bp, Homo sapiens
ggcgcgccagtccttcctggtctccatgtcatctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaaccgactcggaccgatg

SEQ ID NO: 9095 - DNA, 203 bp, Homo sapiens
ggcgcgccagtccttccaaactccctgaacttcggggacagtcccccgaagcggcgaaactctcagggttggcaaccctgcccagggacccccatcccgggcggcgctccggacgccctcccctcaccgcgcccccgcagacacgtgcctggactccgagggcttctggagccaccggccgggccacgcgactcggaccgatg

SEQ ID NO: 9096 - DNA, 203 bp, Homo sapiens
ggcgcgccagtcctgccccgggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggccgcggagacgaaggcgcacgactcggaccgatg

SEQ ID NO: 9097 - DNA, 203 bp, Homo sapiens
ggcgcgccagtcctagtcccggggagcgcaccggaagttctcgcctggcccaggcgcggggtccaagatggtggcgctaggagccgcgacccagtgatagcggccgtggaggggcccccgaccgagcgggaggttgggggtagcctggagattctgaagacaggaataagatgaaggaatggaaatcacgactcggaccgatg

SEQ ID NO: 9098 - DNA, 203 bp, Homo sapiens
ggcgcgccagtccttcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggcccgactcggaccgatg

SEQ ID NO: 9099 - DNA, 203 bp, Homo sapiens
ggcgcgccagtcctgcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccgcgactcggaccgatg

SEQ ID NO: 9100 - DNA, 203 bp, Homo sapiens
ggcgcgccagtcctacgactgcgtgggtgagtcgtctataaaaactcatctctgcgcgtctcttcgccacattcgcttcctgctttcggtgtgtctgttgtgtcttgttgcgggcaccgcagtcgccgtgaagatggcgtctaccagccgtttggatgctcttccaagagtcacatgtccaaaccatccgactcggaccgatg

SEQ ID NO: 9101 - DNA, 203 bp, Homo sapiens
ggcgcgccagtcctctgggctgatccggggctcggccaagctgaggcggcggcgcccggccgtgcgcccagcttgcaggcgcctggctctcacgatgatgaagaagaagaagtttaagtttaaggtggacttcgagctcgaggagctctcctcagtgcccttcgtcaatggggtcctcttctgcaagacgactcggaccgatg

SEQ ID NO: 9102 - DNA, 203 bp, Homo sapiens
ggcgcgccagtcctcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacacccgactcggaccgatg

SEQ ID NO: 9103 - DNA, 203 bp, Homo sapiens
ggcgcgccagtcctgtcgtagagagggggcggggcggccattggggctcctcattggggtgcttggggcgcaccccatcgggtaccgggcgtcccggaattgtgggggacaaaaaggctctgcagtctcggctgaggggtctcaccgacaaaagaggggaagccggccgccgcccaccgcccgccgcccgactcggaccgatg

SEQ ID NO: 9104 - DNA, 203 bp, Homo sapiens
ggcgcgccagtcctctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccacccgactcggaccgatg

SEQ ID NO: 9105 - DNA, 203 bp, Homo sapiens
ggcgcgccagtcctgcacacacgggcgcgcacacacacgcgcgtacacactgggtctccaggcagcggccgtcgccgcatccccggcagcagctccaggcaaagtgacagaggacagtgctgctgtgagtttgacgaagtggacatcacctgcagtcagtccagagctgcccagtcttgaatataatccgactcggaccgatg

SEQ ID NO: 9106 - DNA, 203 bp, Homo sapiens
ggcgcgccagtcctccacgtgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctcgactcggaccgatg

SEQ ID NO: 9107 - DNA, 203 bp, Homo sapiens
ggcgcgccagtcctttgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcgactcggaccgatg

SEQ ID NO: 9108 - DNA, 203 bp, Homo sapiens
ggcgcgccagtcctttcccaggaaagcccaggtgctggctgccagctgctgcgccccccatgtagaaggtgcacctcctgggagcaggcacgtcttttggctcttctgaccatggagagataggacggtccctgcagcccgcgcgacagaaagctgtgccgccaccaccggccgcgcccgtccttcggcgactcggaccgatg

SEQ ID NO: 9109 - DNA, 203 bp, Homo sapiens
ggcgcgccagtcctgaagtcgggggtgggtccctccggacgccgaagtgggctcgggatgcggggctgggaccctcccgattccggggcggattccggacgccgggaccggccattactggtgccgggttgggcttctccagatgccggggctgggtccttcccaaggttgagacaaaaggatgccaccgactcggaccgatg

SEQ ID NO: 9110 - DNA, 203 bp, Homo sapiens
ggcgcgccagtcctggaggggcggggtgagaaggctgcgcgcgggtaaaggggccgcctcgagcggggtccgagcgttcagcggacgcgcgcggcctcgatctctggactcgtcacctgcccctccccctcccgccgccgtcacccaggaaaccggccgcaatcgccggccgacctgaagctggtttccgactcggaccgatg

SEQ ID NO: 9111 - DNA, 203 bp, Homo sapiens
ggcgcgccagtcctctctctccctctgtctccctccctctctctctcccgccgcgcccgcctcccgcccgccctcgctccctccactcctctcccctcccctccccggcactgcagcaccagccgtctgcagctccggccgccacttgcgcctctccagcctccgcaggcccaaccgccgccagcacccgactcggaccgatg

SEQ ID NO: 9112 - DNA, 203 bp, Homo sapiens
ggcgcgccagtcctagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagcgactcggaccgatg

SEQ ID NO: 9113 - DNA, 203 bp, Homo sapiens
ggcgcgccagtcctgagccgcaggcagagcgtccggcggccgggagggacgcggagccacagcccgacgcacggacggagggacgccggagcccgcctgaccatgtggaagctgggccggggccgagtgctgctggacgagccccccgaggaggaggacggcctgcgtggggggccgccaccggccgccgactcggaccgatg

SEQ ID NO: 9114 - DNA, 203 bp, Homo sapiens
ggcgcgccagtcctgaaaacttcctggagaaggatggattttaccctgtaaaagaagaaagacatggatgcataagaagagggttgaagagggggaggcctcagacttctcgctggcctgggattcctccgtgacagcagcaggaggcctagaaggagagccagagtgcgatcagaaaaccagccgtgcgactcggaccgatg

SEQ ID NO: 9115 - DNA, 203 bp, Homo sapiens
ggcgcgccagtcctaggctccaccttttgtgtttcccgcacagtcaatcaaaataggaaaaaaaaatcccgggaccgctccggccgtgtccgccgccgcttcccgcatcctctcccgccgccgccgccttcgctcctcaccatgtgtaaggcggcggggagccccgcctgaggtgccctaaacacactcgactcggaccgatg

SEQ ID NO: 9116 - DNA, 203 bp, Homo sapiens
ggcgcgccagtcctacccggagccgtgcccagtccacgccggccgtgcccggcggccttaagaacccggcaacctctgccttcttccctcttccactcggagtcgcgctccgcgcgccctcactgcagcccctgcgtcgccgggaccctcgcgcgcgaccgccgaatcgctcctgcagcagagccaaccgactcggaccgatg

SEQ ID NO: 9117 - DNA, 203 bp, Homo sapiens
ggcgcgccagtcctggaagccgggattcgccctccggggagcgattggtcctcgggaggggcggggaggtggacgcgggtaccggcggtcgtcgggtcggcagcctttggtcagttggcagcggcaagcgcgctgcggttccggtggcgccatgtcgttctgcagcttcttcgggggcgaggttttcccgactcggaccgatg

SEQ ID NO: 9118 - DNA, 203 bp, Homo sapiens
ggcgcgccagtcctagacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccgactcggaccgatg

SEQ ID NO: 9119 - DNA, 203 bp, Homo sapiens
ggcgcgccagtccttgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggcgactcggaccgatg

SEQ ID NO: 9120 - DNA, 203 bp, Homo sapiens
ggcgcgccagtcctgcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcgactcggaccgatg

SEQ ID NO: 9121 - DNA, 203 bp, Homo sapiens
ggcgcgccagtcctgggcacgatgcggcaacccgccgttcggttggtgcgcctgggtcgggtgccgtacgccgagctactggggctgcaggaccgctggctgcggcggctgcaggccgagccaggcattgaggccccgtcggggactgaggcgggcgcgctcctgctctgcgagcccgcggggcccgtcgactcggaccgatg

SEQ ID NO: 9122 - DNA, 203 bp, Homo sapiens
ggcgcgccagtcctagaagccgcagcccaggcggcggtccctcccgctgtcgccgcccgggtgtagcgcatcacccggagcccaccggccgcaggtgcctcctccggccccagggggccccgggagccctgaagggcgaagcggcagggacgcctctcttgggcgaagaggcggcctcaccgccccggcgactcggaccgatg

SEQ ID NO: 9123 - DNA, 203 bp, Homo sapiens
ggcgcgccagtcctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggaaccctaaggactctgcaatcgactcggaccgatg

SEQ ID NO: 9124 - DNA, 203 bp, Homo sapiens
ggcgcgccagtcctgggtccccggaggcccccgggctctgcccctccagctagagaggcagccgaaccctagcggcctggaaggggccgggaaaccgcggccagctggcaaggagtggcccccgggggcggggcgccggcgggtgtgtgagtagcccgcccggcccgggtccgagttccagccccgcgcgactcggaccgatg

SEQ ID NO: 9125 - DNA, 203 bp, Homo sapiens
ggcgcgccagtcctaaggcgatggcccgcgccccgagcgcaggctagcgtgcctgggtgcccggccatgggctgtatcggctctcggagcccggcgggtcaggcatttctggggaccaacagctggccgaggctcagggatagagacggctgctccagctaaaggtgaatgttggagacacagtcgcgcgactcggaccgatg

SEQ ID NO: 9126 - DNA, 203 bp, Homo sapiens
ggcgcgccagtccttgccgggagagtgaggccgcgggggctgggaagggaccggtgtatgggggacagcaggcgaaggtcactcgggaaccagcccagctctgaggctgcgggcaggtcggaaagggagcaggacggcgacccccgtggcctccagagctctgtgtacgagagccggcgggtcacagacgactcggaccgatg

SEQ ID NO: 9127 - DNA, 203 bp, Homo sapiens
ggcgcgccagtcctactccctctctggatgtgtctgctgccgccattgtgcggcgctggtcccctcagagggttcctgctgctgccggtgccttggaccctccccctcgcttctcgttctactgccccaggagcccggcgggtccgggactcccgtccgtgccggtgcgggcgccggcatgtggctgtcgactcggaccgatg

SEQ ID NO: 9128 - DNA, 203 bp, Homo sapiens
ggcgcgccagtcctagagacgcggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctgggcgactcggaccgatg

SEQ ID NO: 9129 - DNA, 203 bp, Homo sapiens
ggcgcgccagtccttccacgtctcccggaagcggtagcagggccccggcgggtcggggaggaggtttactcagcttgggccccctccgggccagccgccgagggggcgcggcccaggacggcggctaggccgtagtgcagcctctccggagtcctcaggtttgccaataggattatcctgctgccatccgactcggaccgatg

SEQ ID NO: 9130 - DNA, 203 bp, Homo sapiens
ggcgcgccagtcctgcctcgcagccacccctcctgcgtctccacaaatggtccgacccgcaagcaagggggcgggtccggctttgaaaagccggcgggtcgggccttgaggtggaaggcgggaaaatggcggattcctcggggcgaggcgctgggaagcctgcaaccggccccacaaattctagcagtcgactcggaccgatg

SEQ ID NO: 9131 - DNA, 203 bp, Homo sapiens
ggcgcgccagtcctaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaacccgactcggaccgatg

SEQ ID NO: 9132 - DNA, 203 bp, Homo sapiens
ggcgcgccagtcctgacttccggcacgaaggggcggggctgggctcgtggctgagccagcagctgcagcagctacgggagtggccgggtggccggcgggtgccagccgccatggaggccgtgccccgcatgcccatgatctggctggacctgaaggaggccggtgactttcacttccagccagctgtgcgactcggaccgatg

SEQ ID NO: 9133 - DNA, 203 bp, Homo sapiens
ggcgcgccagtcctgagagcggcgcctgatgacgaccgggagggcggggcccgtctggggcgccggcgggtgcgtttgaatctggtccgagcgcgggaaacggcgggtccccgagcccagggttacaaaataaatgccatttgaacagtgccatctgtcatggaaaaacgtgagacgtttgtacaagccgactcggaccgatg

SEQ ID NO: 9134 - DNA, 203 bp, Homo sapiens
ggcgcgccagtcctgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcacccgactcggaccgatg

SEQ ID NO: 9135 - DNA, 203 bp, Homo sapiens
ggcgcgccagtcctgggtggactccgagccggcctgtcaggcaagagccgggcaggtgcggtggcggaagtgcagggacggaggccgaagcggagcggtctagggagccgcggccgcgggtcacccggcgggtagcagttgctgagtgtcagctagacagcagcgactagggctcgggcgccggcgagcgactcggaccgatg

SEQ ID NO: 9136 - DNA, 203 bp, Homo sapiens
ggcgcgccagtcctcggcggaccccgtaccctggcagcatcggagcaccggcgggtgaaggcaaggtccctggactggtcatatacctcttgtggccctggcagaatcaagatgaggccctgtcatgcctccccagtgaggcctacagtctgagcagacagcatggcctgccactggcagtgaacacccgactcggaccgatg

SEQ ID NO: 9137 - DNA, 203 bp, Homo sapiens
ggcgcgccagtccttgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgcgactcggaccgatg

SEQ ID NO: 9138 - DNA, 203 bp, Homo sapiens
ggcgcgccagtccttgcgggagagactggaattcaagagagtcaaatgtgctgggaaagactttctgggcaaaaggaataagcaaaggtgtgcaaaggtaaggaagcaggaaacctttgcacatcttgagaactcgccggccagaggcctgtgaaggagcgcagtggtcaggcaggagaggcagtcggcgactcggaccgatg

SEQ ID NO: 9139 - DNA, 203 bp, Homo sapiens
ggcgcgccagtccttataaagccgcgctgcccgggagccgctcggccacgtccaccggagcatcctgcactgcagggccggtctctcgctccagcagagcctgcgcctttctgactgggtccggaacactgaaaccagtcatcactgcatctttttggcaaaccaggagctcagctgcaggaggcaggcgactcggaccgatg

SEQ ID NO: 9140 - DNA, 203 bp, Homo sapiens
ggcgcgccagtccttcagaactcacacttcttcctggcaaagaagtgcccaggacgggagctggggagccagggctgatctaggaggctgggagccaggtgacaggatggccccaaagagagttgtgcagctgtccctgaagatgcctacccatgccgtgtgtgtggtgggagtcgaggcacatgtggcgactcggaccgatg

SEQ ID NO: 9141 - DNA, 203 bp, Homo sapiens
ggcgcgccagtcctgagtggagctcagtgccagaggaggggattcccggcgccgggggacagagccccttttttcttttgccgaaagaccctttctgctggggagcctcttgtgtccagcctaggcccgcgtgcagcgccgacggatgaccgtcttcttggcaagaaagtgaataaacttaattgagacgactcggaccgatg

SEQ ID NO: 9142 - DNA, 203 bp, Homo sapiens
ggcgcgccagtcctatggggctcaataagtctgcttccaccttccagcttactggcttcccaggcatggagaaggcacatcactggatattcatcccattattggcagcctacatctccatacttcttggcaatggcactcttctctttctcatcaggaatgatcataacctccatgagcccatgtaccgactcggaccgatg

SEQ ID NO: 9143 - DNA, 203 bp, Homo sapiens
ggcgcgccagtcctgccgggaccatggtcaccctcggctgagtttccggcggcgactttgattattggcaaataaccaccataacaataccgagcccccgggcttgcaccgcacgcactgactccgcgagcccgcacacggccgcgtcgcccgccaccgggccctgagcgccagccccaaacgagccgcgactcggaccgatg

SEQ ID NO: 9144 - DNA, 203 bp, Homo sapiens
ggcgcgccagtcctgaggcgaggcggggcgcgactgggttcgcggccgcgtgcagaggtgcaggcagagcagcctcggaaccgagacgatgcgtgcgctccgcgaccgagccgggctcctcctctgcgtgctgctgctggcggcgctgctggaggcggcgctagggctccccgtgaagaagccgcggccgactcggaccgatg

SEQ ID NO: 9145 - DNA, 203 bp, Homo sapiens
ggcgcgccagtcctgccccgccccgcccctgcgcggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttcgactcggaccgatg

SEQ ID NO: 9146 - DNA, 203 bp, Homo sapiens
ggcgcgccagtcctatctaccttatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaacgactcggaccgatg

SEQ ID NO: 9147 - DNA, 203 bp, Homo sapiens
ggcgcgccagtcctgtttgttaggggcagaagcctcccattacggagcacgagagagtccatgaaggtccccgcgactcccggactggagaaaacggctcttgcgatggggcgaagtccgagctgcggcgggcgttggtccgtgcagggaagtgggaatcgttaggttcgttctggacccgccgcccccgactcggaccgatg

SEQ ID NO: 9148 - DNA, 203 bp, Homo sapiens
ggcgcgccagtcctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagcccgactcggaccgatg

SEQ ID NO: 9149 - DNA, 203 bp, Homo sapiens
ggcgcgccagtcctgaccttaggacccgcgggctccagggctactgtccgtccgccactgcgcgccagcaggtcctggtctccgctctccaacagctgaaaggccggcgcagtgaacacagaaacgaaaaccaagaaatgccttattccacaaacaaagagttgatacttggcatcatggtgggcactcgactcggaccgatg

SEQ ID NO: 9150 - DNA, 203 bp, Homo sapiens
ggcgcgccagtcctggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggcgactcggaccgatg

SEQ ID NO: 9151 - DNA, 203 bp, Homo sapiens
ggcgcgccagtcctacttcgctgtgaagatggcgtcgggcagcgggacaaaaaacttggactttcgccgaaagtgggacaaagatgaatatgagaaactcgccgagaagaggctcacggaagagagagaaaagaaagatggaaaaccagtgcagcctgtcaagcgagagcttttacggcatagggactcgactcggaccgatg

SEQ ID NO: 9152 - DNA, 203 bp, Homo sapiens
ggcgcgccagtcctaccccgagcgcggccgcggacgaagatggcgaccgccatgtacttggagcactatctggacagtatcgagaaccttccctgcgaacttcagaggaacttccagctgatgcgagagctggaccagaggacggaagataagaaagcagagattgacatcctggctgcagagtacatcgactcggaccgatg

SEQ ID NO: 9153 - DNA, 203 bp, Homo sapiens
ggcgcgccagtcctctatcaaggaagaaattgccaaaccatgtctttttttctgttttcagagtagttcacaacagatctgagtgttttaattaagcatggaatacagaaaacaacaaaaaacttaagctttaatttcatctggaattccacagaaccttcggctcgcgtgcttctgagctgctgtggcgactcggaccgatg

SEQ ID NO: 9154 - DNA, 203 bp, Homo sapiens
ggcgcgccagtccttgagaagaaaagagagttgacattgggtggcggggaatggagaagaagaacccatgaaggaaactgaggaagagcagccagacgaataggaggaaaaccaggagaagatggtctttggagtccaaatgaagagttctgaggaggaagtggtccacagcgtcaaacttgtgcacccgactcggaccgatg

SEQ ID NO: 9155 - DNA, 203 bp, Homo sapiens
ggcgcgccagtcctcgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaacgactcggaccgatg

SEQ ID NO: 9156 - DNA, 203 bp, Homo sapiens
ggcgcgccagtcctacacaggaagctgagccggcttggggcccagcatacacaggcccccaggacccctggggagagggccccgctgggctggccctgcagggaccatggaatccagagctgaagggggctcccctgctgtgtttgattggttcttcgaagcggcctgccctgcctccctgcaggaggcgactcggaccgatg

SEQ ID NO: 9157 - DNA, 203 bp, Homo sapiens
ggcgcgccagtcctactctgatgaacactgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggcgactcggaccgatg

SEQ ID NO: 9158 - DNA, 203 bp, Homo sapiens
ggcgcgccagtcctgtgtgcggtgcccttcggccggcctgagccccagagtcagctcccctttctcgcccagcgcccccaggccgctcccggggctcacggaatagtaaagaaacacatcataaaacctcccaggacataaaggtgagcacagaccctgtttggatcaagtcagttcctggagcctgacgactcggaccgatg

SEQ ID NO: 9159 - DNA, 203 bp, Homo sapiens
ggcgcgccagtcctaagtgcgactgccagctgccgaggcgttcggtcctgctgttgcggccgctgccccagggctgcggggacgctcccggagccctgcctgttccctgtccatccaggccagcagctgaaggagcctcacctgcctcccttctctgagtagcacggatttgaggagaagcagcgaagcgactcggaccgatg

SEQ ID NO: 9160 - DNA, 203 bp, Homo sapiens
ggcgcgccagtcctgcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactacgactcggaccgatg

SEQ ID NO: 9161 - DNA, 203 bp, Homo sapiens
ggcgcgccagtcctactctaccaaggacagcccaagaactggtctagcctggcagccttttccctcgggtagtagaggctgcccctctgacagggagtttgtggtcagcgagtgggcccttgggggtcttgggctgtcacagggactccagaaagccatgcagagccttgtgccatgaaggacttctccgactcggaccgatg

SEQ ID NO: 9162 - DNA, 203 bp, Homo sapiens
ggcgcgccagtcctgcaggcacaaactcatccatccccagttgattggaagaaacaacgatgactcctgggaagacctcattggtgtcactgctactgctgctgagcctggaggccatagtgaaggcaggaatcacaatcccacgaaatccaggatgcccaaattctgaggacaagaacttcccccggcgactcggaccgatg

SEQ ID NO: 9163 - DNA, 203 bp, Homo sapiens
ggcgcgccagtcctctcctctgactcaacaatgccatcagcactgaaaaggctgagccctgactacagctcttgcagacagaaaaattcgctgcaagtacagcactttctagattgctcctggagtgtgggaacaacagtctctcctgtccacgttactgaatccagaaaaaaggtgaacttacgaaccgactcggaccgatg

SEQ ID NO: 9164 - DNA, 203 bp, Homo sapiens
ggcgcgccagtccttctgccggcgcctgtccggacccgggcccctctccgctttcggccggcctcgggcaccgggcttctggagctcccggagccctgcctgttccctgtccatccaggccagcagctgaaggagcctcacctgcctcccttctctgagtagcacggatttgaggagaagcagcgaagcgactcggaccgatg

SEQ ID NO: 9165 - DNA, 203 bp, Homo sapiens
ggcgcgccagtcctccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatccgactcggaccgatg

SEQ ID NO: 9166 - DNA, 203 bp, Homo sapiens
ggcgcgccagtccttcttgagcctaggaggtggaggctgcagtgatctgtgattgtacctttgcactccagcctgggtgacagagcatgacgctgtctctaaaagaataataataataagcattccataaaaattatggaatggagaaatcatgaatggggtctcggaggggaccagaggctgcagtgcgactcggaccgatg

SEQ ID NO: 9167 - DNA, 203 bp, Homo sapiens
ggcgcgccagtcctacgcctgcagtccccgcgccgtgcccggaatgcgagctgcacgcagggctctcccaagttcccaccgagccgaataaaaagcgtcctcccgcagctctccgccaaagacggacattgactccaggactccacagaatggagcaagaatgagaggaaaaaggccggcagaaaagccgactcggaccgatg

SEQ ID NO: 9168 - DNA, 203 bp, Homo sapiens
ggcgcgccagtcctgtcccaggagactacagcaaacgagtgtatcaaggagtgagagtgaagcatacagtcaaagatctcctggcagaaaaacgatccgggcagacaagtaactcaagacttaatggcagcgtcagttcctctcagtctccatttgtgcagatgccaggttcgccggtcacgtcaggtcgactcggaccgatg

SEQ ID NO: 9169 - DNA, 203 bp, Homo sapiens
ggcgcgccagtcctagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggcgactcggaccgatg

SEQ ID NO: 9170 - DNA, 203 bp, Homo sapiens
ggcgcgccagtccttaaaccatacttgatcctaaattcctgtacttcctcaggccatccgagcatgaaacgctgtcacctacccacatccgctggctgtgacgcttgtcaaagtgttctctatcggctgcatgcctagaccaccaaagcgttctgaccggacagtgtcactggagaaggcggcgcgaccgactcggaccgatg

SEQ ID NO: 9171 - DNA, 203 bp, Homo sapiens
ggcgcgccagtcctccttccagaaggagaaggatttttctccctgctctgcagccaagtgaaagagattagtccctaaacctgtgaaatcgaccagagctgtgtgattaccagggcttgagagaggactcgaaaagaaaaggagaaataaatcaaacagcctgtcagttcctttggccacgtcagaagcgactcggaccgatg

SEQ ID NO: 9172 - DNA, 203 bp, Homo sapiens
ggcgcgccagtcctgggttaaaggtcttgtgatatgtcacaatcccaactaagggcaggacccaggcagaaaaggagagtcacttcctttgatgattggtccagagatacattacaatttcccctgaggacagctctcatgcagaagaggaactgaatatactgcatggctcaggtatctgcagatttcgactcggaccgatg

SEQ ID NO: 9173 - DNA, 203 bp, Homo sapiens
ggcgcgccagtcctgaaggacgggggaggaccgctgcttccggcgccgtaactgctgccatcttctccgcgctatggctgcgttcggccgtcaggtccttgattggcaccgcctgatccccctcacctgggcctgtatggctaggcagactcctcatcttggagaacagagaaggacgacagcttcttcgactcggaccgatg

SEQ ID NO: 9174 - DNA, 203 bp, Homo sapiens
ggcgcgccagtcctcccctcggggaccccctgaggaccctcggattccccccaactcccctgccctctaaaaccacttcaattcctcaactcttcccccggcccgcaggaacccccgccatggcccgttcttacggcggccgggtgctggctgcaatgaccctgctgggcatcgcggcggccgtgctgcgactcggaccgatg

SEQ ID NO: 9175 - DNA, 203 bp, Homo sapiens
ggcgcgccagtcctgaccccggaggcaccacccacatccgtctaacatcacttccttcagagtttgaaaaaaaaaaatctgggaagtagaggtgttgtgctgagcggcgctcggcgaactgtgtggaccgtctgctgggactccggccctgcgtccgctcagccccgtggccccgcgcacctactgcccgactcggaccgatg

SEQ ID NO: 9176 - DNA, 203 bp, Homo sapiens
ggcgcgccagtcctgctccctccttcacctccccctttggcactgcctgtcacctcctttataaagcctggctcttttatcaccgccacttggccctcactgccgccgccagctctgggctccatggactggtcccgtctgaggtgcccctgaccgtccctgccctcaccccaccccggatcccggcacgactcggaccgatg

SEQ ID NO: 9177 - DNA, 203 bp, Homo sapiens
ggcgcgccagtccttgctcctctacctgctctactctcaatccgccagaatcatgggctgctgtggctgttctggaggctgtggctctggctgtgggggctgtggctccggcagtgggggctgtggctctggctgtgggggctgtggctccagctgctgtgtgcccatttgctgctgcaagcctgtgtcgactcggaccgatg

SEQ ID NO: 9178 - DNA, 203 bp, Homo sapiens
ggcgcgccagtcctatggagaatagcacagaagtgacagagtttatcctcttgggattaacagatgaccccaatcttcagatacccctcctcctggcatttttattcatctacctcatcaccctgcttgggaatgggggaatgatggtgatcatccactcagactcccatctccacactccaatgtaccgactcggaccgatg

SEQ ID NO: 9179 - DNA, 203 bp, Homo sapiens
ggcgcgccagtcctagctctttccactacggctgtattgcactggtgagtccgggcccatggatgagaaattgatgcgaggatcaatacaagcttaatttgaattaataaaaggaaatattttctccctttgaacttatctccgtaaagccattgtgcctcctcttgggggtcacgtgttcacaatcacgactcggaccgatg

SEQ ID NO: 9180 - DNA, 203 bp, Homo sapiens
ggcgcgccagtcctagttgcttggaggagcttggagaaaccagaagtgagatccaggagaagtaaggccctggagtgccaggagcccttctcccaaagatggagaaataaatgaagaaatacaggaaaataagcattgggtgttttgcaatggctacacaaactagtcatgtcttccatggtcaagaacgactcggaccgatg

SEQ ID NO: 9181 - DNA, 203 bp, Homo sapiens
ggcgcgccagtcctatgtggcagaagaatcagacctctctggcagacttcatccttgaggggctcttcgatgactcccttacccaccttttccttttctccttgaccatggtggtcttccttattgcggtgagtggcaacaccctcaccattctcctcatctgcattgatccccagcttcatacaccacgactcggaccgatg

SEQ ID NO: 9182 - DNA, 203 bp, Homo sapiens
ggcgcgccagtcctatggcctcccgcagcgcgggcaccctactgaccgagttcaatgccgcctacgtgccccctggactcatgcccgggtaccagggccacgtccccactgtggccttctcctttggcgctccctacggcaccaccaccctcaagtacttccaggaccaccgcaacagagccatggagcgactcggaccgatg

SEQ ID NO: 9183 - DNA, 203 bp, Homo sapiens
ggcgcgccagtcctcaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtccgactcggaccgatg

SEQ ID NO: 9184 - DNA, 203 bp, Homo sapiens
ggcgcgccagtcctcaatccatctaaatccttctcaattgctgccaccatgactcgttacttctgctgtggaagctacttcccaggataccctatctatgggaccaacttccatgggaccttcagagccacccccttgaactgtgttgtgcctctgggctctcccctgaactatggctgtggatgcaacgactcggaccgatg

SEQ ID NO: 9185 - DNA, 203 bp, Homo sapiens
ggcgcgccagtcctggggatctcatttctccccagggggctctaggctgtggatgtgagaaggggagcaagggaggcagatggcgacaaggaacagccccatgcccctgggcacggctcagggtgaccctggagaggcaggaacacggcccggccctgacgccagcctccgggacacaggtgcggccacgactcggaccgatg

SEQ ID NO: 9186 - DNA, 203 bp, Homo sapiens
ggcgcgccagtccttgccagcccatggccgagcctgccctcctccccgccgcccagatggagaggctggccccagggcccctagcctcaccgtgtcctcggatcccgcgggcccgcattgccaggcgctgcgcccagcgctgggccgacctgggctgcagctctggcccctcctcaggccgaatggatcgactcggaccgatg

SEQ ID NO: 9187 - DNA, 203 bp, Homo sapiens
ggcgcgccagtcctccatgacccactgttgctccccttgctgtcagcctacctgctgcaggaccacctgctggaagcccaccactgtgaccacctgcagcagcacaccctgctgccagccctcctgctgtgtgtctagctgctgccagccttgctgccgcccagcttgctgtcaaaacacctgctgcacgactcggaccgatg

SEQ ID NO: 9188 - DNA, 203 bp, Homo sapiens
ggcgcgccagtcctatggcaacggtgaacacagatgccacagataaagacatatccaagttcaaggtcaccttcactttggtggtctccggaatagagtgcatcactggcatccttgggagtggcttcatcacggccatctatggggctgagtgggccaggggcaaaacactccccactggtgaccgccgactcggaccgatg

SEQ ID NO: 9189 - DNA, 203 bp, Homo sapiens
ggcgcgccagtcctagttctgtttctttcctgcgttgatcttggacagtaactgtactatgtaaggaattgtcggtggctggcgacggtatcttagctggttttcagaaaccctcattcctcccttgactgattcaccacttgaacctcatatgacgtagaagaagcctacctatgtccccttcacatcgactcggaccgatg

SEQ ID NO: 9190 - DNA, 203 bp, Homo sapiens
ggcgcgccagtcctatggacaacccacaggctctgccactcttcctactcctggcctccttggtagggatcctcaccctcagagcctcttctggacttcagcaaaccaacttctcctctgccttctcttcagactcaaagagctcttcccaggggctgggtgtggaagttccctccatcaaacctccccgactcggaccgatg

SEQ ID NO: 9191 - DNA, 203 bp, Homo sapiens
ggcgcgccagtccttcactcactcacacacctcccccagctcacctcctccccactccagcatggccgcctccaccatgtccatctgctccagcgcctgcaccaactcctggcaggtggacgactgcccagagagctgctgtgagctcccctgcggcacccccagctgctgtgccccagccccctgcccgactcggaccgatg

SEQ ID NO: 9192 - DNA, 203 bp, Homo sapiens
ggcgcgccagtcctcactgctcttctgcagtagtgtcacaccactcagtgcagggcccaccaagaagaaagcagtgtcaggatccacatggcactatggtaactttgtgaaaggggacattttctccctctgaacttctcttcataaagtcattgtgcttcctcttggggatcacctgttcagtctcacgactcggaccgatg

SEQ ID NO: 9193 - DNA, 203 bp, Homo sapiens
ggcgcgccagtcctcctggcaccagaagggggacattccggaactagatatgaagagacttttctccctgaagttccccggacccaattagatgttgtacccaggctggttaccctggtaacaggcgtcgcggtttgtcaaggaactgagagaagaggcttaagaaaattattcaccactcataagtccgactcggaccgatg

SEQ ID NO: 9194 - DNA, 203 bp, Homo sapiens
ggcgcgccagtcctagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctcgactcggaccgatg

SEQ ID NO: 9195 - DNA, 203 bp, Homo sapiens
ggcgcgccagtcctgagttaggtgacgctgcggggcgggcggacagactgcgggacggacggtggacgctgggacgcgtttgtagctccggccccgccgttccgacccccgccgccgtcgccgccatgacggggctagcactgctctactccggggtcttcgtggccttctgggcctgcgcgctggcccgactcggaccgatg

SEQ ID NO: 9196 - DNA, 203 bp, Homo sapiens
ggcgcgccagtcctggaatcaggttttgaaactgacttccagagctccactgcctccctgcaccatgccctacaacttctgcctgcccagcctgagctgccgcaccagctgctcctcccggccctgtgtgccccccagctgccacggctacaccctgcccggggcctgcaacatccctgccaatgtgacgactcggaccgatg

SEQ ID NO: 9197 - DNA, 203 bp, Homo sapiens
ggcgcgccagtcctcggactgggaggcagggctctggctcacgcttgtaatcccaacattttgggaggacgaagccagcctcatcgcttaagcacaggagttcgaggactgggaggtggaggttgtggtgcctgtatcacctgcccttctgctgacactcctgcctgctgttcctgactacagccatccgactcggaccgatg

SEQ ID NO: 9198 - DNA, 203 bp, Homo sapiens
ggcgcgccagtcctgagattttggactctgtcttcagctggacactccctccctgcaccatgtcttacagttgtggcctgcccagcctgagctgccgcaccagctgctcctcccggccctgtgtgccccccagctgccacggctgcaccctgcccggggcctgcaacatccccgccaatgtgagcaaccgactcggaccgatg

SEQ ID NO: 9199 - DNA, 203 bp, Homo sapiens
ggcgcgccagtccttgtattggggctgacaggggggcgggttattagggctgaggatgggaggatgctcagggtattggggtcagggtggcattagcccagctcaagccgggccgggctgactcagcatcctgccccagccagcttccatccctgacacctctgcactcccttgggcagagatgggagcgactcggaccgatg

SEQ ID NO: 9200 - DNA, 203 bp, Homo sapiens
ggcgcgccagtcctcctgcttttggttcttacagtagtcggcgtaggccttaggtgggttcgtgcgccttctacctcgctgtttcggttttcctggctcctcggcccttttctcccctgttgcagctgggagcggacgaagcgcgaagctgggattttttactgtctcctgaagaatttaacacaaaccgactcggaccgatg

SEQ ID NO: 9201 - DNA, 203 bp, Homo sapiens
ggcgcgccagtcctcgctctgattgtttcgattcttccaaaatcagagacagagtgctcccggtgccatgaacggagacgatgcctttgtacggagacctagggttggttctcaaataccagagaagatgcaaaaggccttcgatgatattgccaaatacttctctgagaaagagtgggaaaagatgacgactcggaccgatg

SEQ ID NO: 9202 - DNA, 203 bp, Homo sapiens
ggcgcgccagtcctgactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcagtggcagctcccaagccaggcggcacccgactcggaccgatg

SEQ ID NO: 9203 - DNA, 203 bp, Homo sapiens
ggcgcgccagtcctgctgtgagggttactatgctccctctttgccgccgtctcctcctcttgcccgcgcaggcacccctctggctgctcagtcctgcctcagtgtcaaaccagaagagaagtaaaattcaacaaaaatttatgtgtggagttccttcttaaaagaagaaaaaagtgattatttagactcgactcggaccgatg

SEQ ID NO: 9204 - DNA, 203 bp, Homo sapiens
ggcgcgccagtcctgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctcgactcggaccgatg

SEQ ID NO: 9205 - DNA, 203 bp, Homo sapiens
ggcgcgccagtcctggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccgactcggaccgatg

SEQ ID NO: 9206 - DNA, 203 bp, Homo sapiens
ggcgcgccagtcctggccgcagtggaaggagcaggcgcttgagctcgagcgacggcgctggcggagacgccggctgctcctcccctccccgccgcttttcctaaaaggattgtacaccttagaagtgcttaaggaagagtgatgaagctctgaatcgtgtcctgcagcagattcgagtgccacccaagcgactcggaccgatg

SEQ ID NO: 9207 - DNA, 203 bp, Homo sapiens
ggcgcgccagtcctttcctccctcccttacgtccccgagtgcggcagtaccgcctccttcccagccgcgcggcttcctccagacctctcggcgcgggtgagccctattcccagaggcaggtggtgctgaccctgtaacccaaaggaggaaacagctggctaagctcatcattgttactggtgggcacccgactcggaccgatg

SEQ ID NO: 9208 - DNA, 203 bp, Homo sapiens
ggcgcgccagtcctggccacaacctccattctcccagaaaagaagaaatgctcatctgaaattcatcacctctctggagtcttcaaactgaccaagcattgaaaagaacacagtttcagaaaacagtttccagtgcctctggccttcctactgaaagcagacacagagtgcatgaagaccgttcaaatcgactcggaccgatg

SEQ ID NO: 9209 - DNA, 203 bp, Homo sapiens
ggcgcgccagtcctgtcagccggcgctggggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacacgactcggaccgatg

SEQ ID NO: 9210 - DNA, 203 bp, Homo sapiens
ggcgcgccagtcctgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagcgactcggaccgatg

SEQ ID NO: 9211 - DNA, 203 bp, Homo sapiens
ggcgcgccagtcctacctgcggaagccatacacccacgggagcccacacctcttggtctgggtcggccacacagagctctaccaccggctcatccacggagaggggctccgtttattcctggagagatgacgaatttgacgaagccagttcacagtcagtgcagcggttactctgggaggtggaggaacgactcggaccgatg

SEQ ID NO: 9212 - DNA, 203 bp, Homo sapiens
ggcgcgccagtcctcagctcattctggatgaatgaatgattacactaagtgtcctccacattcctctgtgggctcacttcatggactcactttgcgtgcttgttaaatgtgctgtgttgctcccaagaccatgtaaagcctactgaccactaacctccctcacagcagaaactagacgtcaggttaaacgactcggaccgatg

SEQ ID NO: 9213 - DNA, 203 bp, Homo sapiens
ggcgcgccagtcctgggatgagagggagagacaacgtgtgtcttacacatctcccaacagccgacttagatgtgatccgttctcccagagggagcaggtttctttgaacttttcctttttatgtacagcatagtgctgagcagatcactgcactgtgcaggagttttaacgacagtcaggccaacggccgactcggaccgatg

SEQ ID NO: 9214 - DNA, 203 bp, Homo sapiens
ggcgcgccagtcctgccgcgggtcttctcccttcactctccacatttggggatcaggtccggcacctgctgcgccagacaggccttgctgggcacgcgcctctgagagtccaaggaggtggcttccagagctgcagcacttcaggccggctccggtggagcgatcagaggtgaggggcttggctgggccgactcggaccgatg

SEQ ID NO: 9215 - DNA, 203 bp, Homo sapiens
ggcgcgccagtcctagcatcgcgacccgccccgtcccgtccagtctggcctgggcgccgcgggaacgctgtcctggctgccgccacccgaacagcctgtcctggtgccccggctccctgccccgcgcccagtcatgaccctgcgcccctcactcctcccgctccatctgctgctgctgctgctgctcacgactcggaccgatg

SEQ ID NO: 9216 - DNA, 203 bp, Homo sapiens
ggcgcgccagtcctctgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataacgactcggaccgatg

SEQ ID NO: 9217 - DNA, 203 bp, Homo sapiens
ggcgcgccagtcctcacagtgtcaagcccacagctctccaaggaggaagatggtccaggctgggagcatccccttagcagcagcctctgatcccttggccaagcaggagggaaccattagcagcctgaggagctggctggctgggagcctcggggaccgcccagccttgctcccagctcacccacaagcgactcggaccgatg

SEQ ID NO: 9218 - DNA, 203 bp, Homo sapiens
ggcgcgccagtcctcaacattccctcgctctggttctcgccccattgggaaactcggccccacgcttcccacttttctggatgaggtgtcccctttctccccactaaaatgtcaaataacctacggagggtcttcctgaaacccgcagaggaaaattcaggcaacgcctcgcgttgatccataatgagcgactcggaccgatg

SEQ ID NO: 9219 - DNA, 203 bp, Homo sapiens
ggcgcgccagtcctcctactgtagacagccttgttctacagatcctcccagaaatctctgggccaggtggaacccagggtcagagagggatgggagagagattccccaggctctcagagaagatcagcagaaagtctgcaagaccctaagaaccatcagccctcagctgcacctcctcccctccaaggcgactcggaccgatg

SEQ ID NO: 9220 - DNA, 203 bp, Homo sapiens
ggcgcgccagtccttgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgcgactcggaccgatg

SEQ ID NO: 9221 - DNA, 203 bp, Homo sapiens
ggcgcgccagtcctgagcggcccgagcatcttctgaaccgggttctggagcggcttgctggaggggctaccagggacagcgccgcctcagatatcctgctggatgacattgtccttacccattctctcttcctcccgacggagaaatttctgcaggagctacaccagtactttgttcgggcaggaggccgactcggaccgatg

SEQ ID NO: 9222 - DNA, 203 bp, Homo sapiens
ggcgcgccagtcctttatctcacccgggaggctgtaaaaatctccgtccttaacagtaacaccatcaggtcctatcagttaagagctgcttgttatttgcatgcattcttataattaaatctcctaacaaccctgtaagcaaaattctgtggcatctctggaatactacctgagaatttttgtgtgcccgactcggaccgatg

SEQ ID NO: 9223 - DNA, 203 bp, Homo sapiens
ggcgcgccagtcctggacttgccatgaggtgttgaagccttgtttcactgagttggagagactggacctaaatggcgcagcatgactttgctccagcctggcttaatttccctactccaccatcatcaacaaaggtcctgaccagcagtttgaaatcgtcattgaattttgagaagcattctgaaaaccgactcggaccgatg

SEQ ID NO: 9224 - DNA, 203 bp, Homo sapiens
ggcgcgccagtcctcactcttcagggagagaatgtggactttagcatttgaactgaatatttgagattgaagatttctgaataatcccccttagcacctctggtactgtaccgtaccttgcctttctgtccaggtttggtggaattgacctatatataaatggtataaagaggggaggtgggaatgaacgactcggaccgatg

SEQ ID NO: 9225 - DNA, 203 bp, Homo sapiens
ggcgcgccagtcctgggttatatgatctctttggctttagggaattactccataccagctctgagatttccagctcagcgatgcccccaggtccctgggagagctgcttctgggtggggggcctcattttgtggctcagcgttggaagttcaggggatgcacctcctaccccacagccaaagtgcgctcgactcggaccgatg

SEQ ID NO: 9226 - DNA, 203 bp, Homo sapiens
ggcgcgccagtcctagtcccgccctccttgctgtcacaggtgcagcctgtcctctccttcccctgaccagcccagcatccacatagtctacacagagctccccttgctgcccagacaagctgaaggaccacaggaaaagccatggagacttcagcatcctcctcccagcctcaggacaacagtcaagtcgactcggaccgatg

SEQ ID NO: 9227 - DNA, 203 bp, Homo sapiens
ggcgcgccagtccttttgtctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcccgactcggaccgatg

SEQ ID NO: 9228 - DNA, 203 bp, Homo sapiens
ggcgcgccagtcctttttgcacacacacgaatacaaagagccatacgaccttcggaccctacagcttggggcctgggctcctctgaccatcctcattgagaaaggaaagtgagtccagagaagttgatgcttcctacctgttggagcggcccagcagtgtaagcgtggttgttactgccccatccgcccgactcggaccgatg

SEQ ID NO: 9229 - DNA, 203 bp, Homo sapiens
ggcgcgccagtcctgtcgcgcaggtcccaccccgcctgcccgcgccgcccattggtcccgagcgcgatgacttggcgggcggagcaggaaggaaaccgctcccgagcacggcggcggcgtcgtctcccggcagtgcagctgccgctaccgccgccctctgcccgccggcccgtctgtctacccccagccgactcggaccgatg

SEQ ID NO: 9230 - DNA, 203 bp, Homo sapiens
ggcgcgccagtcctcccgcaatcctgctccaagagatcttaagctggaggcaccaggtctgaattccagactcctccccaccacccacacttcacctccaactggagcatgaccacagacccattcagggaggctggcggactcttcatcctggacagtcccttactgtatgtcaagtagagctgagacgactcggaccgatg

SEQ ID NO: 9231 - DNA, 203 bp, Homo sapiens
ggcgcgccagtcctcctgaagaccccggaagtgcaactcgaacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgcgactcggaccgatg

SEQ ID NO: 9232 - DNA, 203 bp, Homo sapiens
ggcgcgccagtcctatccgccccctgcctcatccaggcttcgccccagtcagtctccggcagcttctcgcggcttcgcaagccccttcccgtgatgccccgcgcctggctgtcgcggttgccgggcaacgcgctgtccatgtcgcgggcctcgctgggactccctgggagatgaggccgcgaggtctccgactcggaccgatg

SEQ ID NO: 9233 - DNA, 203 bp, Homo sapiens
ggcgcgccagtcctgacgccgatgcggagctgagctggctttcctccagggctctggactccctgctgagcaagagagaaagaggcccgcccttccaccaggacgcctgaccctggggtccttcccaaacccgggtctcttccgactccgggcccaacagtttgtgcgattaaagtgaagaaacaatgcgactcggaccgatg

SEQ ID NO: 9234 - DNA, 203 bp, Homo sapiens
ggcgcgccagtcctgagcagcctccggccgccgccgcgcagagctgccagagtggactgcactgcttctcccagcggggcaggatggcggtttcatgtctggttggataaggccttgcctgcggaaaccagctccatccccaggccctagcagaggctcgcgtgtccccgtccccaggtcaggtcaggcgactcggaccgatg

SEQ ID NO: 9235 - DNA, 203 bp, Homo sapiens
ggcgcgccagtcctgggacaaggcgtcggttctcgcctgagggccaaaccttgcccctgcccaccttcctcacccccgccatttccaggactcacatccaaaggcgacagcaccaggatttgctcccgcctttggcacagaggaggacgggtccctctctcagcctggccagtctttcccagggcttgcgactcggaccgatg

SEQ ID NO: 9236 - DNA, 203 bp, Homo sapiens
ggcgcgccagtcctacatttgtgatcacctggtcacacacctgggcaggaggctgcccctcctccctggtttgaggaagcaggaaaaggtacccgcgagagacagccagcagttctgtggagcagcggtggccggctaggatgggctgtctctggggtctggctctgccccttttcttcttctgctggcgactcggaccgatg

SEQ ID NO: 9237 - DNA, 203 bp, Homo sapiens
ggcgcgccagtcctgcctgccccagcagcggcctgatctgggttccgctgattcctttcgtaaccgcaccacacccgagctacaatctctggacaaaattttaagagaaactccctcagaactcctaaaggtaaacaaaagcaggcagattgaggatggcagtcagaatatgaagtgaccatatatggcgactcggaccgatg

SEQ ID NO: 9238 - DNA, 203 bp, Homo sapiens
ggcgcgccagtcctcaggccctgtgtcttgctcagtccacgtgactctgctttctcatcctaggcctcaggagccgggacactccctgagtcctctgggagcccttaagccacactgagaacacagaccctgggagaagcagccagcagtgaggaatcctggaaccccttcccagggagagccttccccgactcggaccgatg

SEQ ID NO: 9239 - DNA, 203 bp, Homo sapiens
ggcgcgccagtcctgagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctccgactcggaccgatg

SEQ ID NO: 9240 - DNA, 203 bp, Homo sapiens
ggcgcgccagtcctcgcctcggcctttgagccccgcccccgccgtgcaaaaacaaccagaggctgctctgcttgagggtgaagccgcctcccagttttccctccccctctacccccacccccatagttctctccaccaggtccagtgacaattggatgatgcagccttgataatcatccgattccagacgactcggaccgatg

SEQ ID NO: 9241 - DNA, 203 bp, Homo sapiens
ggcgcgccagtcctctcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagaccgactcggaccgatg

SEQ ID NO: 9242 - DNA, 203 bp, Homo sapiens
ggcgcgccagtcctaatgttcggggtggcaccagcccactgccacagccccagtccaccatgccacccatgctgtggctgctgctccactttgctgccccggcactggggttctacttttccatcagctgccccagtggtaagcagtgccaacaggccctactctcaggcaatgatattctcctgtatcgactcggaccgatg

SEQ ID NO: 9243 - DNA, 203 bp, Homo sapiens
ggcgcgccagtcctcgcaccacctgctgcaaggctcgggaaggaaggcgaagatagcaccggggcatccccgggagtccgcaaggctttgcgctgcaaatccagtgctaccagtgtgaagaattccagctgaacaacgactgctcctcccccgagttcattgtgaattgcacggtgaacgttcaagaccgactcggaccgatg

SEQ ID NO: 9244 - DNA, 203 bp, Homo sapiens
ggcgcgccagtcctccaaacaaacttgaagatctcacagacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctcgactcggaccgatg

SEQ ID NO: 9245 - DNA, 203 bp, Homo sapiens
ggcgcgccagtcctagcaagtccgcggtaagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgccgactcggaccgatg

SEQ ID NO: 9246 - DNA, 203 bp, Homo sapiens
ggcgcgccagtccttacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggagggtgggtttctccccagtgtagagggtggcggcggccgactcggaccgatg

SEQ ID NO: 9247 - DNA, 203 bp, Homo sapiens
ggcgcgccagtcctccgtctcctggcaaccagatgcaggggccatggcactcttaacaccccagggagtgaaagaagtcttccaatttcagagaccacaaggtcgggagcgcctgcggaggcttctgaactgggaggagtttgacgaacagagagactcccggaggagcatcctgctggacaccctctcgactcggaccgatg

SEQ ID NO: 9248 - DNA, 203 bp, Homo sapiens
ggcgcgccagtccttagaaggcagtcttgtgggtgcctcctcccccagccgcaactcaggtctgcagctgggtcctgcctccttccgagtgggccatggccggtacatggctgctacttctcctggcccttgggtgtccagccctacccacaggtgtgggcggcacaccctttccttctctggccccacgactcggaccgatg

SEQ ID NO: 9249 - DNA, 203 bp, Homo sapiens
ggcgcgccagtcctctcaagtgactgaagcaggcgccgctgccggggaggaaccgatgggagagaaaggccaggctgggccctgacaccgccaggactccccctccaggaaccagggggcttctcctggaagcttaaaggaaaaaatacttaaattatggtaataagaatgcacctggagctcaagatcgactcggaccgatg

SEQ ID NO: 9250 - DNA, 203 bp, Homo sapiens
ggcgcgccagtcctggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctcccgactcggaccgatg

SEQ ID NO: 9251 - DNA, 203 bp, Homo sapiens
ggcgcgccagtcctacctgtccaggttctgccggccccagccggaagcttactccgcggattgtgcacagttcttgaaggacttgtgccctggggctgcctggcatctgggggcctcctcagagccagggctctttctggttgaggctgagactcactggtgtcatcaggcccctccatgaatgagaccgactcggaccgatg

SEQ ID NO: 9252 - DNA, 203 bp, Homo sapiens
ggcgcgccagtcctggaacttcccaggcaccctgtgtggccgcactgctccctctggcccaaccatgcctctgtccagccacctgctgcccgccttggtcctgttcctggcagggtcctcaggctgggcctgggtccccaaccactgcaggagccctggccaggccgtgtgcaacttcgtgtgtgactcgactcggaccgatg

SEQ ID NO: 9253 - DNA, 203 bp, Homo sapiens
ggcgcgccagtcctccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgcgactcggaccgatg

SEQ ID NO: 9254 - DNA, 203 bp, Homo sapiens
ggcgcgccagtcctgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacagttgcaaccaaggcacgactcggaccgatg

SEQ ID NO: 9255 - DNA, 203 bp, Homo sapiens
ggcgcgccagtcctgccggcagtgcgtgtggtgaggcaggacatggcggaggcaggaaaagtgcccttgagcctcgggcttaccggaggagaagcggcagagtggcctctgcagcggtacgcccgctgcataccctcaaacaccagagacccacctgggccatgcctggaagctgggacagccccctgcgactcggaccgatg

SEQ ID NO: 9256 - DNA, 203 bp, Homo sapiens
ggcgcgccagtcctgccccgtggccacggccccaatcctggccaggcggagattctgcggacattcagggatcggcttcgtcactgagacctcaggcctctgccagccactccccctccccatacccctagtcatcctcggcaggtctcagtcccggctccatctgtgccctcgccccagccgcagctcgactcggaccgatg

SEQ ID NO: 9257 - DNA, 203 bp, Homo sapiens
ggcgcgccagtcctaaatggagacttaggtcccctgcaaagcagaggggaggctggggtcacagctggccactgagagacccatccccctcagcaccgtggcttcccagctctccctgtcctcctccccccgacatctgccccttccctcctaaccccaggaccaggggacccagatctggagctttgcgactcggaccgatg

SEQ ID NO: 9258 - DNA, 203 bp, Homo sapiens
ggcgcgccagtcctgggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagcgactcggaccgatg

SEQ ID NO: 9259 - DNA, 203 bp, Homo sapiens
ggcgcgccagtcctgcgctggccgctcgcggagggagaggctgcagagcgagggcaggaggactacttccagcaacccagtctcctgccatgtccgaccccatcacgctgaacgtcggggggaagctctatacaacctcactggcgaccctgaccagcttccctgactccatgctaggcgccatgttccgactcggaccgatg

SEQ ID NO: 9260 - DNA, 203 bp, Homo sapiens
ggcgcgccagtcctgccaggaactaggaggttctcactgcccgagcagaggccctacacccaccgaggcatggggctccctgggctgttctgcttggccgtgctggctgccagcagcttctccaaggcacgggaggaagaaattacccctgtggtctccattgcctacaaagtcctggaagttttccccgactcggaccgatg

SEQ ID NO: 9261 - DNA, 203 bp, Homo sapiens
ggcgcgccagtcctcgagcccgccgtgcgcacagctctgcccgccgcccctggagcggatccccagccgtccctgggcgttctcccgggttctagcaaagccccccggggtgcccatcagtttccttgggtgactacagcgtgtgttttttctttcctctttcccctgcctgtgtgcccttctccaggcgactcggaccgatg

SEQ ID NO: 9262 - DNA, 203 bp, Homo sapiens
ggcgcgccagtcctatcttgtctccctctccttacctgcgtcctcgggggcgtgcgcaccaccccccctcccgcctaggaggggggagggccccctcttggccaccgccttcgcggcctttaaactcccctggagactgcggctactgccaccgccttgcctccactgcctcttcgcgcagcacacagcgactcggaccgatg

SEQ ID NO: 9263 - DNA, 203 bp, Homo sapiens
ggcgcgccagtcctgttggcagccattttgtgaagagacgaagactgagctgttttggctgcatttctggcctcgagccgcagtcagcttctccccgtagaacccggcagtaggagacttagaatcgaatctcttctccctcccgcctcctgtttttggctttttgagaaaccttatcatccaacacacgactcggaccgatg

SEQ ID NO: 9264 - DNA, 203 bp, Homo sapiens
ggcgcgccagtcctagacttcctgcccctgctctgcactctcaggtattccctgctcttactccaaaaagatggacccaggtccgaaggggcactgccactgtggggggcatggccatcctccaggtcactgcgggccaccccctggccatggcccagggccctgcgggccacccccccaccatggtccgactcggaccgatg

SEQ ID NO: 9265 - DNA, 203 bp, Homo sapiens
ggcgcgccagtcctggctcccatggccctcgggcccagcgtggtgaccccgggggatggagccgttcctcaggaggcggctggccttcctgtccttcttctgggacaagatctggccggcgggcggcgagccggaccatggcacccccgggtccctggaccccaacactgacccagtgcccacgctcccgactcggaccgatg

SEQ ID NO: 9266 - DNA, 203 bp, Homo sapiens
ggcgcgccagtcctccaggctctggagggcgccccggaaaccatggaagtcctcgtcctggccggataccgcgcgcagaaggaggacgagctgagtctggcgcccggggacgtggtccggcaggtgcgctgggtgcccgcgcggggctggcttcgcggagagtttgggggccgctatggcctcttccccgactcggaccgatg

SEQ ID NO: 9267 - DNA, 203 bp, Homo sapiens
ggcgcgccagtcctagagtgtctggtgatccctaataaaccagactgtggcctttttaacgagcagacgcccccacgaaggcaggaacctgggcaagtctggcctgcgggtctcctgcctgggacttggaacatgggtgaccttcggaggccagatcaccgatgagatggcagagcagctcatgacctcgactcggaccgatg

SEQ ID NO: 9268 - DNA, 203 bp, Homo sapiens
ggcgcgccagtcctggctcaagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggacccgactcggaccgatg

SEQ ID NO: 9269 - DNA, 203 bp, Homo sapiens
ggcgcgccagtcctaaggcgagatgggcgggctgggagtgcccggcggcgggtcctcagcttcgagccgaggtgcagtgagctggtggggggaccgcgaggcgagcgcgggagcctgggcggcgagccgggtgtgagctgcctgaaaatgcactcggatgccgccgctgtcaattttcagctgaactccgactcggaccgatg

SEQ ID NO: 9270 - DNA, 203 bp, Homo sapiens
ggcgcgccagtccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggcgactcggaccgatg

SEQ ID NO: 9271 - DNA, 203 bp, Homo sapiens
ggcgcgccagtcctcctgagccaggaggaagcagcggcgaggtctgcgggaggcatggcgggagctccggacgagcgccggcggggccccgcggcaggggagcagctgcagcagcaacacgtctcttgccaggtcttccccgagcgtctggcccaggggaatccccagcaagggttcttctccagcttcgactcggaccgatg

SEQ ID NO: 9272 - DNA, 203 bp, Homo sapiens
ggcgcgccagtcctcccagccccgcgctcccaggacctcccgcccgcggagcccactcggattgctctccgcccgggtcggcggaggccccgtctcctgtacccggcgctgggactgctccgcaccgcgcggctccctttcagcagctgcgggagcatgcggaggaggccctgccggccccgcgggtccgactcggaccgatg

SEQ ID NO: 9273 - DNA, 203 bp, Homo sapiens
ggcgcgccagtcctgtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgcgactcggaccgatg

SEQ ID NO: 9274 - DNA, 203 bp, Homo sapiens
ggcgcgccagtcctctcccccagctgccgacgtggggcgggcagccgccggcggctgggagccgaggcgtcggtgcagacctggagacgggcatgggggggctgcggctgctggctgtggccctcacgtgctgctggtggccgcagggcagccagggtaagaccctgcggggcagcttcagcagcacccgactcggaccgatg

SEQ ID NO: 9275 - DNA, 203 bp, Homo sapiens
ggcgcgccagtcctggctgcaggcggggccggcgggggcgcagcggcccgggaggaagcagtaccttgaagagaaattggagagggagtcaattcctaggatagcagagagatggacaacagacagaatagatggagtttcacaatggtggccatgtgtctggaattggtgggttcttggtctcactgcgactcggaccgatg

SEQ ID NO: 9276 - DNA, 203 bp, Homo sapiens
ggcgcgccagtcctgcaggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcccgactcggaccgatg

SEQ ID NO: 9277 - DNA, 203 bp, Homo sapiens
ggcgcgccagtcctggcatttcattgcttcccctgtccttcctttagctgtaactccggcgggcgtgttgggtgtgtcgttttaggctctgtgacccaggagcaagacgcaataagcgggtgcagtggaggtagaaacgggaaatgcagtaccctttccggaagctactccgcccctcgacagagtctcgactcggaccgatg

SEQ ID NO: 9278 - DNA, 203 bp, Homo sapiens
ggcgcgccagtcctcctgatcggaggagtgcgggccggagggtgatgggaccatctagcccctaaccatgggcccagaagagaagaccatcatgacagaaaggtctgcagctgttttcatccaggcctggtggcggggcatgctggtgcgacgcacactgctgcatgcagccctcagggcttggatcacgactcggaccgatg

SEQ ID NO: 9279 - DNA, 203 bp, Homo sapiens
ggcgcgccagtcctccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggcgactcggaccgatg

SEQ ID NO: 9280 - DNA, 203 bp, Homo sapiens
ggcgcgccagtcctcccggcaactttctctgcccgctcccgcgggttgggggctgccgtgccgggggctaactgggggcagcctctggagaacggcttcagagtcccggagacgcccgccacccgcagcctgcccgcggtgggcctgccgtcggatctcggcaccctctcctcccctctccccgaacccgactcggaccgatg

SEQ ID NO: 9281 - DNA, 203 bp, Homo sapiens
ggcgcgccagtcctggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccggcgactcggaccgatg

SEQ ID NO: 9282 - DNA, 203 bp, Homo sapiens
ggcgcgccagtcctcgcacgcgcggttagtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgtcgactcggaccgatg

SEQ ID NO: 9283 - DNA, 203 bp, Homo sapiens
ggcgcgccagtcctcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacacccgactcggaccgatg

SEQ ID NO: 9284 - DNA, 203 bp, Homo sapiens
ggcgcgccagtcctttccggtccctgcgggtaatagacaagaaggtcaccctggtggataaagacctcctgaaatttctaaagctggaggagttggtactgagcgccaatcgaatcaaggaggtggatgccaccaatctgccccccacactcaaggtgctggagctctacggcaatgagatcagcagccgactcggaccgatg

SEQ ID NO: 9285 - DNA, 203 bp, Homo sapiens
ggcgcgccagtcctgctgccttccctgtggcatcatgaagtttcgcgccaagatcaccggcaaaggctgtctagagctgttcattcacgtcagcggcaccgtcgcgaggctagcgaaggtctgcgtgctccgcgtgcgccctgacagcctgtgcttcggccccgcgggttccggcggcctccacgaggcgactcggaccgatg

SEQ ID NO: 9286 - DNA, 203 bp, Homo sapiens
ggcgcgccagtcctccctagctctgggccgcgcctcacatccctcccagagccgcaacaccccacccggcgggacgccctcgagcagccgctcgttgcgggcctgaagcgcagagcgcctattggccagagcggccgagggcgggaaaagtggccaacggctgcctcggccctcgggctgctgaggagcgactcggaccgatg

SEQ ID NO: 9287 - DNA, 203 bp, Homo sapiens
ggcgcgccagtcctgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtggagagatggaaccgccatgatcagcgactcggaccgatg

SEQ ID NO: 9288 - DNA, 203 bp, Homo sapiens
ggcgcgccagtcctgacgcggagcccggcgctgagccctgcgcgcgcgcctgcgggtccgatctggacgaacgcgaggcgttctgcgagagcgaattcgcggtgaacgggatcgtgcacgatgtggacgtgctgggcgcgggcatccggctggtgaccctgctggtggatcgggacgggctgtacaagcgactcggaccgatg

SEQ ID NO: 9289 - DNA, 203 bp, Homo sapiens
ggcgcgccagtcctagatgggacagcttggcctacagcccggcgggcatcagctcccttgacccagtggatatcggtggccccgttattcgtccaggtgcccagggaggaggacccgcctgcagcatgaacctgtggctcctggcctgcctggtggccggcttcctgggagcctgggcccccgctgtccgactcggaccgatg

SEQ ID NO: 9290 - DNA, 203 bp, Homo sapiens
ggcgcgccagtcctggaagctggggacagccactcgctcgggagcagcctgagcgtttcctctccgcgtactcgagggaactctctccacgcgttcgagggaacccggaaggggccaggcgggtgagtgcggagggaagcccttgtgccatctgggagtagagccgccgagtcaggagttttagggcccgactcggaccgatg

SEQ ID NO: 9291 - DNA, 203 bp, Homo sapiens
ggcgcgccagtcctgtgggggcgggctcccggtcccgctatcggcggccggcgggcaggcgactcctgtcccgggtggaggcggcggagccggagccgggggagggggcagcggctgtctcacggaccacggcggcgcccgcagctcctcaccgaaacaaggagaccagtgctggtccagtggctgtgcgactcggaccgatg

SEQ ID NO: 9292 - DNA, 203 bp, Homo sapiens
ggcgcgccagtcctgcattggtccagtctgggttgaccccgacccgaagtggccctttccttcgcgtcctgaacttcgcttctccgtcggtgtctggtctcttcccgccggcgggctctgcggtggcgggaggagctgtactactcgtgccttagcgcacccttactttcccaggccagaaacgcgaacgactcggaccgatg

SEQ ID NO: 9293 - DNA, 203 bp, Homo sapiens
ggcgcgccagtccttggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccacccgactcggaccgatg

SEQ ID NO: 9294 - DNA, 203 bp, Homo sapiens
ggcgcgccagtcctaggatccgggctggaagcctctcggagtgctgcctccagccaaggggcggccggcgagtcccagtgagagcggagggtgccagaggtagggggccgagaaacaaagttcccggggcttcctccggggccgcggtcggggctgcgcgtttgaccgcccccctcctcgcgaaggcacgactcggaccgatg

SEQ ID NO: 9295 - DNA, 203 bp, Homo sapiens
ggcgcgccagtcctcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagcgactcggaccgatg

SEQ ID NO: 9296 - DNA, 203 bp, Homo sapiens
ggcgcgccagtcctcgtttccccgcggagccccggccgctgcctcccgggacagttcgcacggccacaggggcgcacggcgatgtggcctccgtccagcgcgctggcccgccggggggatgctctggcacctgtcggggtccaggcctagcatggccggcgcgttgcccgacgtcgcctccggctaggcgactcggaccgatg

SEQ ID NO: 9297 - DNA, 203 bp, Homo sapiens
ggcgcgccagtccttgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtccgactcggaccgatg

SEQ ID NO: 9298 - DNA, 203 bp, Homo sapiens
ggcgcgccagtcctgcgccgccaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctcgactcggaccgatg

SEQ ID NO: 9299 - DNA, 203 bp, Homo sapiens
ggcgcgccagtcctaagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtcgactcggaccgatg

SEQ ID NO: 9300 - DNA, 203 bp, Homo sapiens
ggcgcgccagtcctggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgccgactcggaccgatg

SEQ ID NO: 9301 - DNA, 203 bp, Homo sapiens
ggcgcgccagtcctaaaaccttgaggtgattcatcttccaggctctccttccatcaagtctctcctccctagcgctctgggtccttaatggcagcagccgccgctaccaagatccttctgtgcctcccgcttctgctcctgctgtccggctggtcccgggctgggcgagccgaccctcactctctttgcgactcggaccgatg

SEQ ID NO: 9302 - DNA, 203 bp, Homo sapiens
ggcgcgccagtcctttttcagcctgtgatttgataaccgccgccgggtggcgtggagcgtcccgagacttcttccttcattgcagcccctcttcttttagttctagactgaagttcgaggaacgcaccacttggctgaaattaggatccagatttcccaaacttccttcggaggaaaaagccctaacgcgactcggaccgatg

SEQ ID NO: 9303 - DNA, 203 bp, Homo sapiens
ggcgcgccagtcctcctacgcggaactctctcgcggtaattcgaagtaccgcgcctgcgtgctgcagtagcgcctggtggcggtggcagtttgcccgcgggtgtgtgaagggagacagtgtggaggccacagggtactcgccacgatgagcagcaccttagctaagatcgcggagatagaagcagagacgactcggaccgatg

SEQ ID NO: 9304 - DNA, 203 bp, Homo sapiens
ggcgcgccagtcctcggctctcccacgtctacacccatcacctccagcctgagggcgcaactgagaggaactgagacccaagcagctcagtaaaggccccgcggcgagggcatcggctctcgccggcggatgacgagctgtatcagcggacgcgcatctctctgctgcaacgcgaggccgctcaggcacgactcggaccgatg

SEQ ID NO: 9305 - DNA, 203 bp, Homo sapiens
ggcgcgccagtcctgccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatcgactcggaccgatg

SEQ ID NO: 9306 - DNA, 203 bp, Homo sapiens
ggcgcgccagtcctcgggggcgggacttcagcggaggccggagcgaggcgtcgggatgcagcgccccgggcccttcagcaccctctacgggcgggtcttggccccgctgcccgggagggccgggggcgcggcctccggcggaggagggaacagctgggacctcccgggttcccacgtgcggctgccggcgactcggaccgatg

SEQ ID NO: 9307 - DNA, 203 bp, Homo sapiens
ggcgcgccagtcctaccattagtacctaggaggcagggatcagaggaagtagattcagaggtaaggagaattttggggctatactttcaagaaagtcgtgttcgggacccaggaggtatgggtcagaaggaaaggagcacagcagatactctgccggatctggaggaatggaagtcagcggcgggtctcgactcggaccgatg

SEQ ID NO: 9308 - DNA, 203 bp, Homo sapiens
ggcgcgccagtcctgagcctgagggaggggtcggcctgcgggtagccagaggctggggcggctgtggagcctgtggtgggagcggcattgtggggcagggaaaaggtgagccgagccgacggaggggacgcgctgcggggcgcccccagtctatggagcggggtaagatggcggaggcggagagcctgcgactcggaccgatg

SEQ ID NO: 9309 - DNA, 203 bp, Homo sapiens
ggcgcgccagtcctggatccgaaccccggcggctgcgtgcttataggcgcagacgtcagagagcccgcggcttaaagcgcgtcgcctggctagcgccaccccctagccttcttcaaggcctccagggctgggcccaagcgcccgtcgacggcaccctgggcccagaggactcgcgggcctcatctccacgactcggaccgatg

SEQ ID NO: 9310 - DNA, 203 bp, Homo sapiens
ggcgcgccagtcctgtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaacgactcggaccgatg

SEQ ID NO: 9311 - DNA, 203 bp, Homo sapiens
ggcgcgccagtcctgcggggaagtggcggctgaagcgccgccggcggggctcactgtggtggtgtgagtgggaggcggcggcgctggtggctgcagctggggtgaggcgcgaggcggcgcactcgacggctgactggagcagcggatataagtcaaagagtacagcagaaaatgtctactgaagggaccgactcggaccgatg

SEQ ID NO: 9312 - DNA, 203 bp, Homo sapiens
ggcgcgccagtcctgctctcctttcccgaacctcccggggtgcagcctagagccctcccgcgcggctgactccagagtagaggaagggaggcggcctccggctggtcccccgaagccctcgctgccccgcagatgcggatggccagccagtagcgggcggtggccccgcgtcccgggagcgcacagcacgactcggaccgatg

SEQ ID NO: 9313 - DNA, 203 bp, Homo sapiens
ggcgcgccagtcctcgagcgtgtcgctcccagtgcgcaagtgcagcaggtggctgcacggggggcgcgggaggaggaggaggaggaggaggaggctggggtggggccggcggcaagtgctgtgatgcggttccggggaggggccgtcgggtagaggctgaataccagtttccgagcggcaaggcagcgcgactcggaccgatg

SEQ ID NO: 9314 - DNA, 203 bp, Homo sapiens
ggcgcgccagtcctgacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagcgactcggaccgatg

SEQ ID NO: 9315 - DNA, 203 bp, Homo sapiens
ggcgcgccagtcctctgggaaccggcgggagggcgcctcctcctcccccgccctctctgctgaggatggaagtgacgaaagcagccgaggaggtcacttcctgctggggtggatgaggaggagccggagacgccgcggaggagacgggaccgaagagggaccgtgccgggaagagcaggcgggtgaaacgactcggaccgatg

SEQ ID NO: 9316 - DNA, 203 bp, Homo sapiens
ggcgcgccagtcctgcgcacgcacgcccaggggagttggggttcgcagggggttgttttcggctctgaagaggtccccgcccaaccttcaaaattctgtccaaaagcagacaagaggatcgccccgcgctgagccggctggtgggcagcaggaggcgcctgatcgccgccggggcgctgggggtggtgcgactcggaccgatg

SEQ ID NO: 9317 - DNA, 203 bp, Homo sapiens
ggcgcgccagtcctgtctggtccgtgcgcgatcacggcccggcgcgtggctcgggctcgggcggagctggagacgtgtggagctgttcgaggactcgcgggtgtgcagtgcacctatgatatgtgttttagaaatagccgttaaactttggtttgaatgaagaatgtctctcaatccacctatatttccgactcggaccgatg

SEQ ID NO: 9318 - DNA, 203 bp, Homo sapiens
ggcgcgccagtcctaagtaagatggcggcgaacgcacttccggcgtgtgtccttacgggtgcgtccgggcggctgcttgcaggtgccacccagcgggttccagcttgtttgctgcatagattacaacggtgatggcgggcaaggggtccggctggagccgggcggctctcctccagctccttctcggccgactcggaccgatg

SEQ ID NO: 9319 - DNA, 203 bp, Homo sapiens
ggcgcgccagtcctttggcggaagagtgtcccgcctcttccgctctacagcggaggtggctgtggcggtggcgctggtggctgcggcggcggcggcggcagcggcgctcgagcggttcctgtcagggtcagccggcgggccccctgggtggtccacctgcaaatcgcggagcggcgccccagggatcgcgactcggaccgatg

SEQ ID NO: 9320 - DNA, 203 bp, Homo sapiens
ggcgcgccagtcctatgtggccggccggcgcgggcaccaagctgccctgtccccgagactctgcgctccggcgggcggctttctctgggaacctcacggccctgccctctcacctcgtgcccgccggccgcagcgtccgggtcttcatcagcgccaaccctgaagatacgggagcagaaagacaggcgcgactcggaccgatg

SEQ ID NO: 9321 - DNA, 203 bp, Homo sapiens
ggcgcgccagtcctggaggagcggcccagagcgcgcagctagggcactggcgaaaccccgggacagtccctctccgtgcgggggcggcgcagagcagtcccatccccggggtcccgggcgcggctgactgccggctggttccctgcgcgcagtagctccccgagccgggctgcaccggaggcggcgagcgactcggaccgatg

SEQ ID NO: 9322 - DNA, 203 bp, Homo sapiens
ggcgcgccagtcctcgccccctccgacgccaccgaggtagcggcttcacctttaaggcggcgcgggggctgctgggaaggccggcgggatggaggcggcgggaccggctcgcgggtgcgggtccgggtgaagcgggaggcagccagagtcggagccgggcccgagcaccaggcgcagacgccacagcccgactcggaccgatg

SEQ ID NO: 9323 - DNA, 203 bp, Homo sapiens
ggcgcgccagtcctgtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggcccgactcggaccgatg

SEQ ID NO: 9324 - DNA, 203 bp, Homo sapiens
ggcgcgccagtcctatggcatgggagaatcagaccttcaactctgacttcatcctcctgggaatcttcaatcacagccccacccacaccttcctcttctttctggtcctggccatcttttcagtggccttcatgggaaactctgtcatggttctcctcatctacctggacacccagctccacaccccccgactcggaccgatg

SEQ ID NO: 9325 - DNA, 203 bp, Homo sapiens
ggcgcgccagtccttgctacacaccactctggcttacgcttccagctaacagcggtttgtctgtgtttctggactgaagtgactgatgaaaaacagtagtcaagtctggagggtgattccctttcagttcacttgcctttcagttctggggaaattagaagatttgctctctctctctgcttcttagacgactcggaccgatg

SEQ ID NO: 9326 - DNA, 203 bp, Homo sapiens
ggcgcgccagtcctggggtctacggcctaggggccggggaagtttgcgccgccgcgaccagtgctgcgatcccgagccgggctccagccccgaggaccaggggtcgggcgggcctgcctacggaaccccgcgggccagcagcagtcgtctcgcgtcctcctgcttggaaaagtgtttaagcttctaaacgactcggaccgatg

SEQ ID NO: 9327 - DNA, 203 bp, Homo sapiens
ggcgcgccagtccttcagccgaggggctgttggggaactctctgcaggcacagggcacctggtgactgggaagcttctgtttgtgtggacttcttgggaacagcgtcctggtgtgggccaggaggagaggactggagcaccccaggctctgacttcgtgctcctgggatcgtggtgcattgcctggcccgactcggaccgatg

SEQ ID NO: 9328 - DNA, 203 bp, Homo sapiens
ggcgcgccagtccttcagggcttcccctttcttggtcatcgatccctagagctctggctctttctcttcttggggaactgcttaacgtctacagcaaggcctaataggggacctgagggcacagtcctcaggatgtttcggggagaataggagccagaacctgagcccctaagccattcccctcaccacgactcggaccgatg

SEQ ID NO: 9329 - DNA, 203 bp, Homo sapiens
ggcgcgccagtcctgggaccccatttctgtgctcatctgcctccttggcaatataaagagcaagcactgaggccccgcctcagagcaccccaaacttgacgccatgaagatcccggtccttcctgccgtggtgctcctctccctcctggtgctccactctgcccagggagccaccctgggtggtcctgcgactcggaccgatg

SEQ ID NO: 9330 - DNA, 203 bp, Homo sapiens
ggcgcgccagtcctcaggtcttggaagaggctgggggtcccggccttgtgccttacctgcgcccggaggtcgcctccttcttgggagaggatggggacgtggcatagccacccacgcgccgcgggggtcccgagccattaaggggcgtcctggtgggaaggcctttcaagagctgacacactggagggcgactcggaccgatg

SEQ ID NO: 9331 - DNA, 203 bp, Homo sapiens
ggcgcgccagtccttcgtgaagatagagatggggtttcaccatgttgcccaggctggtcttgaactcagggtccaaacgatccacctaccttggcctcccaacgtgccaggattacaggcatgagccaccacacctggtccatcttgataatttcatactctggcttggcaaagactgaagggaagcccgactcggaccgatg

SEQ ID NO: 9332 - DNA, 203 bp, Homo sapiens
ggcgcgccagtcctatttgtcaaactgaagaaacccctgaagaagcagtggtgggcaggcgccgacgctgcggcttccagagcattttggcaaatcaaagccagggaccgttgctgggcctcatttccgcaacttttcggctccgaactgcttctttgacttagaagatatcttatcctgccgttgtacgactcggaccgatg

SEQ ID NO: 9333 - DNA, 203 bp, Homo sapiens
ggcgcgccagtccttcccggggctacgaggcggaagcgaaggcagacgcagtctccgtcgttgacgttagtcgcagtcttcgctgctaacgttttgttatgagttgctaaaatggtgaaatgctgctccgccattggatgtgcttctcgctgcttgccaaattcgaagttaaaaggactgacatttcacgactcggaccgatg

SEQ ID NO: 9334 - DNA, 203 bp, Homo sapiens
ggcgcgccagtcctctctgatgccttcaggagcttgggcctctcctgctccactcctaaacttcagcttctcagcaaacaggcctcccaagtccctgcttctccctctcaggccttgctaacctcaccagctctagggcctggccaggcctcccaggctccctcctccaccccaaccccttctcactccgactcggaccgatg

SEQ ID NO: 9335 - DNA, 203 bp, Homo sapiens
ggcgcgccagtcctatgcgctccgagggtgcggcccccgggccggcggcgccgctgtgcggggcgctgagcctgctgctgggcgcgctgctgggcaaagtgatagagggtcacggggtcacagacaacatacagagattctcctcactgccaccttacctacctgtgagctaccacatcctcagagcacgactcggaccgatg

SEQ ID NO: 9336 - DNA, 203 bp, Homo sapiens
ggcgcgccagtcctttattctggacagttactcttaagaaagttgtcagaagaaacgcatctgcctttttttccaggtgaactgccgtgagttgtccagcatgatagtgtttattttcttggctatggggttaagcttggaaaatgaatacacttcccaaaccaataattgcacatatttaagagagccgactcggaccgatg

SEQ ID NO: 9337 - DNA, 203 bp, Homo sapiens
ggcgcgccagtccttggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtatcgactcggaccgatg

SEQ ID NO: 9338 - DNA, 203 bp, Homo sapiens
ggcgcgccagtcctaactccggctacgggggcccgaagggaccgtgaggcgcagatttgagccgctgttgagatgattcctttccgttcgcggaagagatggggaaactgagggccgcccagtatgcttgctctcttcttggccatgcgctgcagaggcatggagccagtcctgagttacagaaacagcgactcggaccgatg

SEQ ID NO: 9339 - DNA, 203 bp, Homo sapiens
ggcgcgccagtcctagttgaaacatcctcctacactggagctttataaatattttaaagacaaggattggattagatttgacattagaaatgtaccataatacagaaggcaatggacacctaaagaacagaatgaaaaccttcttaggaaatgaagcttgacacttcacccaccaggccaccacaagacgactcggaccgatg

SEQ ID NO: 9340 - DNA, 203 bp, Homo sapiens
ggcgcgccagtcctgatgctgcgggctggtacattccccacttgcaaaactctgtggggctgggttcctctcttttctttccaaatatcccaggaagtggatggttttatccaaattcagcagacgagtaaaaagagtcttcgggaggtgcaatagctttctaggaatgaggatattcttcaaggaaacgactcggaccgatg

SEQ ID NO: 9341 - DNA, 203 bp, Homo sapiens
ggcgcgccagtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtcctcccgacggcccgactcggaccgatg

SEQ ID NO: 9342 - DNA, 203 bp, Homo sapiens
ggcgcgccagtcctcacgcggggcccagctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggaccgactcggaccgatg

SEQ ID NO: 9343 - DNA, 203 bp, Homo sapiens
ggcgcgccagtcctgcctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtcgactcggaccgatg

SEQ ID NO: 9344 - DNA, 203 bp, Homo sapiens
ggcgcgccagtcctgcagattctgtggttatactcactcctcatcccaaagaatgaaatttaccactctcctcttcttggcagctgtagcaggggccctggtctatgctgaagatgcctcctctgactcgacgggtgctgatcctgcccaggaagctgggacctctaagcctaatgaagagatctcagcgactcggaccgatg

SEQ ID NO: 9345 - DNA, 203 bp, Homo sapiens
ggcgcgccagtcctatataaggagcgtgggccaggcctgagtattcagcgatggcatttgcatggtggccctgtctcatcttggctctgctctccagcttggcagcctctggcttcccgagaagcccctttcggctgcttgggaaacggagcctcccggaaggggtggccaatggcatcgaggtctaccgactcggaccgatg

SEQ ID NO: 9346 - DNA, 203 bp, Homo sapiens
ggcgcgccagtcctgctggtcctatcccactgggaccgtcgctgccactcagccagagagccagcatcttggcaagggctgggcctggagtgaagctggaagggctagcatggagagcctgtcacctgggggaccacctggccacccttaccagggggaggcctctacctgctggcagctcacagtgacgactcggaccgatg

SEQ ID NO: 9347 - DNA, 203 bp, Homo sapiens
ggcgcgccagtcctattgcagaagcctatgagttgattaattctaacaactggatactgtggtttagggcttggaagatgaaaaggaggcctctgagaatgaaacagacatggaagaccccagagaaatccagactgattcttggcgtaaacggggagagagcgaggaaccgtcatctcctcagtccccgactcggaccgatg

SEQ ID NO: 9348 - DNA, 203 bp, Homo sapiens
ggcgcgccagtcctatggttgagcccttcttgggaacctggaagctggtctccagtgaaaactttgaggattacatgaaagaactgggagtgaatttcgcagcccggaacatggcagggttagtgaaaccgacagtaactattagtgttgatgggaaaatgatgaccataagaacagaaagttctttccgactcggaccgatg

SEQ ID NO: 9349 - DNA, 203 bp, Homo sapiens
ggcgcgccagtcctgcctagcccacgtccagcgcctgcccggccgccgcttcccgccaccctgccctgcccacccgccaggtactaccattaaagataccttcttctcagcaaatctatgataaaaaatataagtaacagaagaagaaataactgttatttgtcaagtgacaagcttttaatgtcagacgactcggaccgatg

SEQ ID NO: 9350 - DNA, 203 bp, Homo sapiens
ggcgcgccagtcctgctccgcagctgggaatcacgggactagccttcgtttccttggcaacgcagtacacaagtgctagccctagcagctcgcgatgtgcttcagcagagcagacgctgcggataactacccttttggaacatgtcaacagaggaaactttttcctcacttccatcccccgaatttgacgactcggaccgatg

SEQ ID NO: 9351 - DNA, 203 bp, Homo sapiens
ggcgcgccagtcctgactggcactttttcttttttctcagcaaactgtacaaaaccaaatctctttttgattttcaaggaaactaggttcctgccaaattttgaatctggacaataaacagacactttgtcctagcatctttctggaatcatttcgggatattttccacaagcaacacagaaacaggacgactcggaccgatg

SEQ ID NO: 9352 - DNA, 203 bp, Homo sapiens
ggcgcgccagtcctgggaatatgagtgatggtgcctcaaagcagtaactttttgcttagagcttgagagtcaaagttaaggacccacatgtatacttcggctctagcgagtctaaggatgataatatggatacaaaatctattctagaagaacttcttctcaaaagatcacagcaaaagaagaaaatgcgactcggaccgatg

SEQ ID NO: 9353 - DNA, 203 bp, Homo sapiens
ggcgcgccagtcctccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgactcggaccgatg

SEQ ID NO: 9354 - DNA, 203 bp, Homo sapiens
ggcgcgccagtcctctgtgggtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctcgactcggaccgatg

SEQ ID NO: 9355 - DNA, 203 bp, Homo sapiens
ggcgcgccagtcctcagaggagaaggggaggaacaggaagcctccagctagtcgtttggaatctggcaaccatttctgtcagctttctcattcctagattgatgcagattgcttaattccttgagcttaaccagctcgaaaaagcagtggaagcagctcacacatttttcgtggctaaccctgagcaccgactcggaccgatg

SEQ ID NO: 9356 - DNA, 203 bp, Homo sapiens
ggcgcgccagtcctatcctcagtctcccagttcaagctaatcattgacagagctttacaatcacaagcttttactgaagctttgataagacagtccagcagttggtggcaaatgaagccaggctgtgcggcaggatctccagggaatgaatggattttcttcagcactgatgaaataaccacacgctacgactcggaccgatg

SEQ ID NO: 9357 - DNA, 203 bp, Homo sapiens
ggcgcgccagtcctgacaaagacctgcgccggcgcgcgggactctgcgtgaggcgagcgccggggctcccggagcggatccctacctgtttcaaggacctgccagtctgagaagcttcttgtcataaggccatccaggggccacgcacccctaccttgccagcctccagcatgcaggataccgtaacgcgactcggaccgatg

SEQ ID NO: 9358 - DNA, 203 bp, Homo sapiens
ggcgcgccagtcctcctgtgagctccacctgccccagttctcctggctttaacccctccttggccaaggccagggttgcctgcgggagccaggtgtccgctctccacacctttcacagccccagccctcagagcaacctcagcccagcccagcccagctccagctccagctccagcccgggccccatccgactcggaccgatg

SEQ ID NO: 9359 - DNA, 203 bp, Homo sapiens
ggcgcgccagtcctaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagaccccgactcggaccgatg

SEQ ID NO: 9360 - DNA, 203 bp, Homo sapiens
ggcgcgccagtcctagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccaccgactcggaccgatg

SEQ ID NO: 9361 - DNA, 203 bp, Homo sapiens
ggcgcgccagtcctgtatgacgtactggtcggtagtaaagattaatatgtaagaaatgtggagctaggatcaagtcatactccacagcctgcctggcaaactatgttttacttctgactttgctctctcgctgagaacattaatctgtcaagctggcgggctcctttgatagcaactttcccaggggccgactcggaccgatg

SEQ ID NO: 9362 - DNA, 203 bp, Homo sapiens
ggcgcgccagtcctagcctcagccttgcctctccccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggcccgactcggaccgatg

SEQ ID NO: 9363 - DNA, 203 bp, Homo sapiens
ggcgcgccagtccttagagaggaggttcacaaacacccacgtagctgcagccacttatcactgcacctcttgccaaagtgcggtccacatacgtgcaatgagaaaggattaaagggacttgtttgataacacacgcaaaactatatttcctttggcttcaaagctctctcaccatattttgggaagttcgactcggaccgatg

SEQ ID NO: 9364 - DNA, 203 bp, Homo sapiens
ggcgcgccagtcctatggagcttcatgtcctcgtgcaggaagtactcatcgactgatgtggcagactttgctccctggcaaaactaaagaactctcctattcatggaggcgaacactgaggatgctttccacatgaaccctgaagtgaacttctgatacatttcctgcagcaagagaaggcagccaaccgactcggaccgatg

SEQ ID NO: 9365 - DNA, 203 bp, Homo sapiens
ggcgcgccagtcctagccgcgggtacccctcgctggtccgctgggctgccgtccagcgggagagacaaaagtcgcaagggaaggggaaaaacgaactgagtttgtgtcactgtcttggtggacttttcgagctaacctgtatttgagaaaaacttcagtctcttgggaaaggagaggcagtgacaaaacgactcggaccgatg

SEQ ID NO: 9366 - DNA, 203 bp, Homo sapiens
ggcgcgccagtcctgtacttcatagactttatcatacttcgtagcatccagtatgttttctttgctaagattattgattttgtattgaagggtcccatgtccatcgttttcaatgctttatctccagggttggagcatgcctgctgtggcagaggtaaaacttcgagatgatcaatatacactggaaccgactcggaccgatg

SEQ ID NO: 9367 - DNA, 203 bp, Homo sapiens
ggcgcgccagtcctcctgaagaggggggaaaggcatttctgtgctcttcctggtaaagtgtttgaaaatgaacattcagaagaaaacctaaagcacctgaaatgcacaggggacgagaatgagagctgaacaaaaggttcatcctcagttttctccatgcccatgggaagctgtttacccggattgggcgactcggaccgatg

SEQ ID NO: 9368 - DNA, 203 bp, Homo sapiens
ggcgcgccagtcctatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttcgactcggaccgatg

SEQ ID NO: 9369 - DNA, 203 bp, Homo sapiens
ggcgcgccagtcctttcatggtgactgggacgagtaggtttcactgtttctcataggagacttgacagcttaaagtaaaaacaaattattttcgtcaaagtttttttttttctcttaactgatttttagcaaacctcagactgagacacaggactcaacggtgtattcctggaaggcaaggtgctatacgactcggaccgatg

SEQ ID NO: 9370 - DNA, 203 bp, Homo sapiens
ggcgcgccagtcctaatgaggagtgatcatggctacctcagagctgagctgcgaggtgtcggaggagaactgtgagcgccgggaggccttctgggcagaatggaaggatctgacactgtccacacggcccgaggagggctgctccctgcatgaggaggacacccagagacatgagacctaccaccagccgactcggaccgatg

SEQ ID NO: 9371 - DNA, 203 bp, Homo sapiens
ggcgcgccagtcctagcctgtgcaagtgatttgggagaggaaggggagatgatgtaactggttcggcatgttcccgtcttggccaacatgccttgaattggaacgctacctacagacggagccccggaggatctcagagacctttggtgaggacttggactgtttcctccacgcttcccctcccccgtcgactcggaccgatg

SEQ ID NO: 9372 - DNA, 203 bp, Homo sapiens
ggcgcgccagtcctgacttctgccctctaaagactaaggcctaattccactggtttctttgaattccgtggtcctaagtccattttcagacaaagtttctgtggaaagacctacggacaaagacatctctccttggcagagtgagctaggattaccagctcttcagccgcagctgaaggcgggagtcccgactcggaccgatg

SEQ ID NO: 9373 - DNA, 203 bp, Homo sapiens
ggcgcgccagtcctcaccattcctttctcacctggcacaatctcagatttttagactctgaggagcagttggagctaatccacattatggaaatggaaaccaccgaacctgagccagactgtgtagtgcagcctccctctcctcctgatgacttttcatgccaaatgagactctctgagaagatcactcgactcggaccgatg

SEQ ID NO: 9374 - DNA, 203 bp, Homo sapiens
ggcgcgccagtcctatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagccgactcggaccgatg

SEQ ID NO: 9375 - DNA, 203 bp, Homo sapiens
ggcgcgccagtcctacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgagcccgactcggaccgatg

SEQ ID NO: 9376 - DNA, 203 bp, Homo sapiens
ggcgcgccagtcctcagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaaccgactcggaccgatg

SEQ ID NO: 9377 - DNA, 203 bp, Homo sapiens
ggcgcgccagtcctatgcctggtcagaactacagaaccatatctgaatttatcctctctggcttctcagccttcccccagcagctcctgcctgtcttgttcctgctgtacctcctgatgttcctgttcacattgcttggcaaccttcttatcatggccacagtttggattgaacgcagactccacacacgactcggaccgatg

SEQ ID NO: 9378 - DNA, 203 bp, Homo sapiens
ggcgcgccagtcctatgccccaaattcttatattcacatacctgaatatgttttacttctttccccctttgcagatcttggcagaaaacctcaccatggtcaccgaattcctgttgctgggtttttccagccttggtgaaattcagctggccctctttgtagtttttctttttctgtatctagtcattcgactcggaccgatg

SEQ ID NO: 9379 - DNA, 203 bp, Homo sapiens
ggcgcgccagtcctatgggggatgtgaatcagtcggtggcctcagacttcattctggtgggcctcttcagtcactcaggatcacgccagctcctcttctccctggtggctgtcatgtttgtcataggccttctgggcaacaccgttcttctcttcttgatccgtgtggactcccggctccatacaccccgactcggaccgatg

SEQ ID NO: 9380 - DNA, 203 bp, Homo sapiens
ggcgcgccagtcctatggcaaatctgagccagccctccgaatttgtcctcttgggcttctcctcctttggtgagctgcaggcccttctgtatggccccttcctcatgctttatcttctcgccttcatgggaaacaccatcatcatagttatggtcatagctgacacccacctacatacacccatgtaccgactcggaccgatg

SEQ ID NO: 9381 - DNA, 203 bp, Homo sapiens
ggcgcgccagtcctatgttcctttacctttgcttcatttttcagaggacatgcagtgaggagatggaagaggaaaatgcaacattgctgacagagtttgttctcacaggatttttacatcaacctgactgtaaaataccgctcttcctggcattcttggtaatatatctcatcaccatcatggggaatcgactcggaccgatg

SEQ ID NO: 9382 - DNA, 203 bp, Homo sapiens
ggcgcgccagtcctactcaaaatggcggcggcggcgtcagcatcagcggcctcctgcccgtatctatcgtggcggcgacgggacccgcctccctgggcgccggagtcatgtgacccacacaatggctgagtggctactctcggcttcctggcaacgccgagcgaaagctatgactgcggccgcgggttcgactcggaccgatg

SEQ ID NO: 9383 - DNA, 203 bp, Homo sapiens
ggcgcgccagtcctatgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgccgactcggaccgatg

SEQ ID NO: 9384 - DNA, 203 bp, Homo sapiens
ggcgcgccagtcctgcagacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagagcgactcggaccgatg

SEQ ID NO: 9385 - DNA, 203 bp, Homo sapiens
ggcgcgccagtcctcctggccactcttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccacccgactcggaccgatg

SEQ ID NO: 9386 - DNA, 203 bp, Homo sapiens
ggcgcgccagtccttcaatcgccttttatctctggccctgggacctttgcctattttctgattgataggctttgttttgtctttacctccttctttctggggaaaacttcagttttatcgcacgttccccttttccatatcttcatcttccctctacccagattgtgaagatggaaagggtccaaccccgactcggaccgatg

SEQ ID NO: 9387 - DNA, 203 bp, Homo sapiens
ggcgcgccagtccttaggagaggtgggctccacccacaaaaatggactgctcagaaaaatgagggagagagaaagggtggccactttcccgagccaagaaattccttgaaaaaaaatcagaacatctgaaaccagagagccgatttccttaccgggaggcagttcctggctaacgaagaggaagcacgcgactcggaccgatg

SEQ ID NO: 9388 - DNA, 203 bp, Homo sapiens
ggcgcgccagtcctaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagggccgactcggaccgatg

SEQ ID NO: 9389 - DNA, 203 bp, Homo sapiens
ggcgcgccagtcctgttgactaagtcaataatcagaatcagcaggtttgcagtcagattggcagggataagcagcctagctcaggagaagtgagtataaaagccccaggctgggagcagccatcacagaagtccactcattcttggcaggatggcttctcatcgtctgctcctcctctgccttgctggcgactcggaccgatg

SEQ ID NO: 9390 - DNA, 203 bp, Homo sapiens
ggcgcgccagtcctcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatccgactcggaccgatg

SEQ ID NO: 9391 - DNA, 203 bp, Homo sapiens
ggcgcgccagtccttggtcatctcagttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaaccgactcggaccgatg

SEQ ID NO: 9392 - DNA, 203 bp, Homo sapiens
ggcgcgccagtcctgagggaacgggtcctggcggtgctttgcaaagggcccgtgtttctgttgcgggaagctcccgggggtcgcacgtgcgtccgagcccaagcccctcccctccactccccttcctgcgtgccccggagccgccaagcggctacgttcttctcggcccgccgagatggcgctcgacccgactcggaccgatg

SEQ ID NO: 9393 - DNA, 203 bp, Homo sapiens
ggcgcgccagtcctaggaggattcctggggctggtgtcttctcccagctgctgcttccagtgggcctgggcccaggactggacctccgctggcacccctgagtgcctccctgccaggccatgctgctgtagaccctaacagcgtctcttcctggccaagagaagcctgtccccaagaacaggagagcccgactcggaccgatg

SEQ ID NO: 9394 - DNA, 203 bp, Homo sapiens
ggcgcgccagtcctgagtctagtctttgttcggggctgtccaaaggacgctagctgttgcacctgttcctccctgcgcgtaagatagaggataaatctcctggcaaagcccagaatgaccacagccctggaacctgaggaccaaaaaggacttctgataattaaggcagaggaccattactggggacacgactcggaccgatg

SEQ ID NO: 9395 - DNA, 203 bp, Homo sapiens
ggcgcgccagtcctctttctgtctcttcctcgctccctctctttctctcctccctctgccttcccagtgcataaagtctctgtcgctcccggaacttgttggcaatgcctattttttggctttcccccgcgttctctaaactaactatttaaaggtctgcggtcgcaaatggtttgactaaacgtaggcgactcggaccgatg

SEQ ID NO: 9396 - DNA, 203 bp, Homo sapiens
ggcgcgccagtcctgtccttcccacccttagtcccaggcatctgactaccgggaacctcagccagagtccgggagccccccaccccgtccaggagccaacagagcccccgtcttgctggcgtgagaatacattgctctcctttggttgaatcagctgtccctcttcgtgggaaaatgaaccagaagaccgactcggaccgatg

SEQ ID NO: 9397 - DNA, 203 bp, Homo sapiens
ggcgcgccagtcctcgcgctggcgccatggcggagcaggagagcctggaattcggcaaggcagacttcgtgctgatggacaccgtctccatgcccgagttcatggccaacctcaggctcagatttgaaaaagggcgcatctatacgttcattggagaagtcgtcgtttctgtgaacccttacaagttgcgactcggaccgatg

SEQ ID NO: 9398 - DNA, 203 bp, Homo sapiens
ggcgcgccagtcctggagctctccccggtctgacagccactccagaggccatgcttcgtttcttgccagatttggctttcagcttcctgttaattctggctttgggccaggcagtccaatttcaagaatatgtctttctccaatttctgggcttagataaggcgccttcaccccagaagttccaacctcgactcggaccgatg

SEQ ID NO: 9399 - DNA, 203 bp, Homo sapiens
ggcgcgccagtcctctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataacgactcggaccgatg

SEQ ID NO: 9400 - DNA, 203 bp, Homo sapiens
ggcgcgccagtcctactgcctccgccccttcaggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacacgactcggaccgatg

SEQ ID NO: 9401 - DNA, 203 bp, Homo sapiens
ggcgcgccagtcctagcaaaaacctcctggcaaaggaggagaggaggttgtgcgggacaaccttctcctgacagaaggatgtcgctgctgagcctgtcttggctgggcctcaggccggtggcagcatccccgtggctgctcctgctggtggtcggggcctcctggctcctggcccgcatcctggcctgcgactcggaccgatg

SEQ ID NO: 9402 - DNA, 203 bp, Homo sapiens
ggcgcgccagtcctctccctctgccctctccccttgcccaagccccgaggtgggggcctggtgtgaatgctccggccgaagtgaacctgcacccccgcacccgaaggcctctttccggcttctgggcaaggcggccccggtgagctcggccgtcacacatctctgctttttcccaagaagagcaggaacgactcggaccgatg

SEQ ID NO: 9403 - DNA, 203 bp, Homo sapiens
ggcgcgccagtcctgagccaggcttggcggtcctcagaggggctgataaatcggcgctcgactggcctaggagctgtccgcagggagatttatgacaaagtccagttttcaacaatgctgaaatcaaatgattgcctgttttctttggaaaatttgttttttgaaaaaccagatgaagttgaaaaccacgactcggaccgatg

SEQ ID NO: 9404 - DNA, 203 bp, Homo sapiens
ggcgcgccagtcctacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggcgactcggaccgatg

SEQ ID NO: 9405 - DNA, 203 bp, Homo sapiens
ggcgcgccagtccttgcgcggcggggctgaggcggccgcggggcccgagcgcagggagtggagcttggtttcgggatctcggtgctgcagacggcgagacctcctgcacagggtgtacagcaagctgtgattcctgggaaaactaaaaaagctctctgaacaacggggcccagagctgatggcagacacgactcggaccgatg

SEQ ID NO: 9406 - DNA, 203 bp, Homo sapiens
ggcgcgccagtcctatggctactctgatctacgttgataaggaaattggagaaccaggcacccgtgtggctgccaaggatgtgctgaagctggagtctagaccttcaatcaaagcattagatgggatatctcaagttttaacacgacgttttggcaaaacatacgatgctccatcagccttacctaaacgactcggaccgatg

SEQ ID NO: 9407 - DNA, 203 bp, Homo sapiens
ggcgcgccagtcctaggtctccggattactgcatgcttgcagtgggaggaaaggcctgtctaccatgttctctgcctccccttcatgttctgtgaggagaggggccttgtctggcatgttcaccgaggcattcctgaccactagaactgtgcttggcacagagtaggcacttaataaactcctgctgccgactcggaccgatg

SEQ ID NO: 9408 - DNA, 203 bp, Homo sapiens
ggcgcgccagtcctttctcgcccaaggacagacctgaatctctagctgcctagaggctgactcaactgaaatcatggcgtttgacagcacttggaaggtagaccggagtgaaaactatgacaagttcatggaaaaaatgggtgttaatatagtgaaaaggaagcttgcagctcatgacaatttgaagccgactcggaccgatg

SEQ ID NO: 9409 - DNA, 203 bp, Homo sapiens
ggcgcgccagtcctctcctcctcctgctttcctccagtaagtgcatacccgctagtggtctgtacaggcggcacggtttgatggcagagatattttctttccaaactgttcaaaatgatgaacgaagatgcagctcagaaaagcgacagtggagagaagttcaacggcagtagtcagaggagaaaaagcgactcggaccgatg

SEQ ID NO: 9410 - DNA, 203 bp, Homo sapiens
ggcgcgccagtcctttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagcgactcggaccgatg

SEQ ID NO: 9411 - DNA, 203 bp, Homo sapiens
ggcgcgccagtcctggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaacgactcggaccgatg

SEQ ID NO: 9412 - DNA, 203 bp, Homo sapiens
ggcgcgccagtcctgccttatggtatggttggaagcacggccccagattctctttgtatgcacaaagcagggtcatcagaagcctctcgattcaaaagatgataataccgaaaaacactgcccagtgacagtgaatccttggcatatgaagaaagctttcaaagtcatgaacgaattaagaaggtgagcgactcggaccgatg

SEQ ID NO: 9413 - DNA, 203 bp, Homo sapiens
ggcgcgccagtcctggggaatgcgctaacaagacaatgtaactttcttacaaattcgttagcaccctttagcgtttacccagaggtgtatctcctgggggcagatttgtaaaactagcatcaacaaccccttacttaaaccagcagccacatttgagggcaacatctacagtaataaattagccgttgcgactcggaccgatg

SEQ ID NO: 9414 - DNA, 203 bp, Homo sapiens
ggcgcgccagtcctaatcgcagacatgtgtgagcacctgacaatcttggcacaaacgagagatccaatgaaagtccgagtgcagaatacactacaaaccccatttgggcgaaattttagttggcggtagtggcacccagaagccgtggatagaagctatgagcatcggcaacacggcattgagtgtatcgactcggaccgatg

SEQ ID NO: 9415 - DNA, 203 bp, Homo sapiens
ggcgcgccagtcctccgaataaatggatacagggaaacaataataacatctcacgctaatacaacaaatagcaagatagagacgtagagatcaacattatatacacccataccaagactcaacgataaaaatcgtatgaacaataattgacaagcacactaagacgaatgaattgataatatcaagtacgactcggaccgatg

SEQ ID NO: 9416 - DNA, 203 bp, Homo sapiens
ggcgcgccagtccttcccaaggcgacgcattcccgcctccagtcccacgtgagtactcggcctataaacatcagccacaccatttgtacgacacactacgcgaacccgaacgccgtgcctgggaccgaagcacttacattcgggcccaccgtatgcgccgcgtgcaggccaggtgctatgcctcccaccgactcggaccgatg

SEQ ID NO: 9417 - DNA, 203 bp, Homo sapiens
ggcgcgccagtccttcccttcaaccactgcccgctgcaccggacaattcctgaacgcatctgagccagccacgcaccaccgcactacaatgacccgccgctcatgcgtggaacggtctctccaggtgcgcaaatagcgcaccaccctcgcgccgaccctctctgaagaccccaagatccgtagacctccgactcggaccgatg

SEQ ID NO: 9418 - DNA, 203 bp, Homo sapiens
ggcgcgccagtcctctcagccccatgtcctcccccgctgtcgccattaggccggtagtagatggattacacggtctactagtgctgaatgcgatggtaggtgacgtggtgtgcccccctaccggttataacccacactttctcccgtagatggccccccgccccggggcccactcccctccaggttgacgactcggaccgatg

SEQ ID NO: 9419 - DNA, 203 bp, Homo sapiens
ggcgcgccagtcctcgtccgcactgcacctgggacagacttccccttccgtgattcggtgtaccccccccggtgttacagcaccgctacgggcaggctggataggttgccctttcttatgccgacaccaacctcttcgtctacctcaccccgtactgcgcctcctcctcacgacgtgaggcacgcttacgactcggaccgatg

SEQ ID NO: 9420 - DNA, 203 bp, Homo sapiens
ggcgcgccagtcctcgcacctgtgccagcgactatatgctagtaggttaggtagcacgcgcggtctctgcggaatcagcacgtaaacacccgaccccatgccctggctcttacgggttacgtaccaatcggagccgttgggtacgattgtgctacagccccgccttgcagagcagcgtcgcccactaccgactcggaccgatg

SEQ ID NO: 9421 - DNA, 203 bp, Homo sapiens
ggcgcgccagtccttatccgatgtcctttacaccccgtactctcaggcagtagggcacatggcggccaatctgtcgtgtgctgtatcattaattctccggttcttattgatagttcgaatcggcacgggccacgtttctttaatcggagttctatccgcgtgggaatggacgcccatgagataatctacgactcggaccgatg

SEQ ID NO: 9422 - DNA, 203 bp, Homo sapiens
ggcgcgccagtcctgggagccgaatcgctcccactgctagcgcacgggcccgccagagccgcaatgctggagccaacgcgaggaccgtatgggcgataagggcgaggggttgccggaatcgatggaaccgtggggcagggcggctcgggcgcgtgcatcgcgggtgaacaacagggagccgttgcgcacgactcggaccgatg

SEQ ID NO: 9423 - DNA, 203 bp, Homo sapiens
ggcgcgccagtcctggtcccgccgggcacctggttagtgcccacacgcacgacgaggccccatggagaaaggtcccggtctggccagccgaccggcacaggcgaagcaacggcagaccagccctgtcagagccgtccgccccagggcgggaagggataaccgggcgagggaaggttgccgcctgctggcgactcggaccgatg

SEQ ID NO: 9424 - DNA, 203 bp, Homo sapiens
ggcgcgccagtcctgttttttttcctgcgcgccgtcgcagggtctctccccgagcgaggggatcgcccctgaagcctagagttacccgggccccgcagtagggcgccctgtagtcttccacgggcgagtgggcttgtcgcgaataaccctcgctgttcttcggcggttttcagcgcggtgggctagcccgactcggaccgatg

SEQ ID NO: 9425 - DNA, 203 bp, Homo sapiens
ggcgcgccagtccttcagccgcatcgacgagcggctgtgagaggccgtggattccatggccggtcacactaaatcggaggatattcagttctgggggaccggcctcgaggcgccacttcctctgtcctccctatttgctctccccccagttggcggaggtgcggcatggtgtggggcggagagctcatcgactcggaccgatg

SEQ ID NO: 9426 - DNA, 203 bp, Homo sapiens
ggcgcgccagtcctcgggtaaggttgtcttcaatcattatctgaggggcgggccaccattaatcctgcgacctgataggaaacgtttacaagcgcccctctagatcactacagagccgatgccacggcgaacgagacaccacgaaacaatcaggtaagggcaccatcctgccggacacctccgcgccgcgactcggaccgatg

SEQ ID NO: 9427 - DNA, 203 bp, Homo sapiens
ggcgcgccagtcctcatgcccggcaggtggaccgggcggaacgcccggggcggccgacaagaggtgggcgacctagaccagagacgagcgggcctccgtcagccggacccgtcacccaaacacgcacgtaaggatcgggacgggcgaccgacaaacacatgcggcagggcggcccacagcgcgggcaccgactcggaccgatg

SEQ ID NO: 9428 - DNA, 203 bp, Homo sapiens
ggcgcgccagtcctcgtgctataatgcacctaaattctgccctcatgaggggtacctaaattacccaccccccgtgcgccggcgaactatgggcttactccctgtcgcctgacccgcccctgtttaccgtgtggctagaacgcagccggccgtacacgtggcagtgccatggacaagaggctgtggagcgactcggaccgatg

SEQ ID NO: 9429 - DNA, 203 bp, Homo sapiens
ggcgcgccagtcctttgcacctacccgaccaggtacttgttcagtattcccacctcgcccccttgtgtctttaccggctccgccatcaaccttgagcgttcctagttagcctcttatgcagtgtctcggccttggcggcaaagctcctctgcttcgctattaccctccttctgtcaaacagccttgtacgactcggaccgatg

SEQ ID NO: 9430 - DNA, 203 bp, Homo sapiens
ggcgcgccagtccttatattgtgtgttcacctctgttactctttccgtctcgctccacttggcatccctccccttcggtacccggccctctcctctccgataccagtcttcctgtataagtccctgccttctgttcctttccgtctgcaccctttcgccgccacaccgcccccggctataagcgtttacgactcggaccgatg

SEQ ID NO: 9431 - DNA, 203 bp, Homo sapiens
ggcgcgccagtcctctaaagtaaaatacagctacccgctcgcttttaggcaacgattccggcgcctgcgaagcaccagacgatctagagcccatcgactttccaaagttctacccacccccctcaagcgtcgaaacgaacctcatcagccggcgagttattaggccaacaccaagaacgctgctatcccgactcggaccgatg

SEQ ID NO: 9432 - DNA, 203 bp, Homo sapiens
ggcgcgccagtcctgctccacgtacagtgctccaccgccgactatgaaaggagaatcgcacgactagggatgggggcccttaggttcggcttccgcggagcctcccaacatcgcgatatcaaatcggatggcgtaggcgccagaagacaacgacttctgtactctacagaaagaaagccgactccctccgactcggaccgatg

SEQ ID NO: 9433 - DNA, 203 bp, Homo sapiens
ggcgcgccagtcctccctggataagtttcaccagagtcacgacgcgactgatgcgggggtgcagcctcagaatgtgagacataacacccgtttcccgactcaccaaaccacctatatgtcgcgatggaagatgtgggcgaattccaatgattgggcagtgccccaggcccaggcgtatccccagaaatcgactcggaccgatg

SEQ ID NO: 9434 - DNA, 203 bp, Homo sapiens
ggcgcgccagtcctctcgactgtacactaacttcgtaccttatattaagactttatcacatggttgtagtattactttttttgttgtgaatagacaatgtcattctctttaatttggtttaaactgaagtaaattcacagtgcttaagtgttgtgcatgtaacagcgtctataattttagtcagctctcgactcggaccgatg

SEQ ID NO: 9435 - DNA, 203 bp, Homo sapiens
ggcgcgccagtccttctttaatagtttaactgtcgagcgtgtaatctcgaagtccagggtgtatacgttagttctgctatattttgaatatatttaattatgtggtctaaaggggactcatccactgtaggtctaaggtagctaggattgttatgtaatttagcattttgagcgttattcacctggaccgactcggaccgatg

SEQ ID NO: 9436 - DNA, 203 bp, Homo sapiens
ggcgcgccagtccttacatggggcggcgctcgctagcagccagcttgggcactgccgcacgcggcatctgccttcacacgagagtagtcatgcaggggtaaagtcccccgggcagtcccctctccggtggtccgagtagctagcagtaatctgttgacgcccgatccggagtctcagctgggcaccaccgactcggaccgatg

SEQ ID NO: 9437 - DNA, 203 bp, Homo sapiens
ggcgcgccagtcctgctatcgccgatggacatggtatcatatggctcggctagtgcccccgatttgacgggcagtcgcggctgcgcccacgcgcaaccagcgtcgccttgcgtcccgcagggccctgccctgccctcggcgtacgcgcttctgcttccagttcgcgcgagtgccatacccactagcctcgactcggaccgatg

SEQ ID NO: 9438 - DNA, 203 bp, Homo sapiens
ggcgcgccagtccttttatcggtctggagggcgtgatacggcggccgtggtccttagttctcctcccaggctagaacccaggcgcacagaggccgcggccgcgaccacagatgccggtctggccctctccggagcacgcagcgcgggtacggtgacccgtccgttccccatgggcatgtgcacagtttcgactcggaccgatg

SEQ ID NO: 9439 - DNA, 203 bp, Homo sapiens
ggcgcgccagtcctcttccctcccgtagcacgtgcgccccgcagcgctccgttgctcgaccccaaatcccctgtttgtgttgccgcgccgcgccaggggcgccgggttgcgcggcgtcctccttgcctctcagcgccccctggcctggggtccgcgccctcccccctccgtgacggaccaactgctctcgactcggaccgatg

SEQ ID NO: 9440 - DNA, 203 bp, Homo sapiens
ggcgcgccagtcctgtgatgccttagatcgcttcgccagcgtaatcttcgttgcccgccacctgtgtccgtgtctctaccttcagttccccgttgagtcttccattcctacggacgtaggatcccggccccccgttccggtcccgtctcgacatcttcctgccgacttgaggtctacttaagtcgctgcgactcggaccgatg

SEQ ID NO: 9441 - DNA, 203 bp, Homo sapiens
ggcgcgccagtcctctccctagtcccgtgtcgtcaccccctagacgggaaggctccgtcacgccgaccagcgatgggctgcggcgtagttcgacgcctccgggggccccatcctagagacgccgatgattacaaccgttccctcgctgtttcactcccgggatctcgggtgtgtccagacactctatccgactcggaccgatg

SEQ ID NO: 9442 - DNA, 203 bp, Homo sapiens
ggcgcgccagtcctaatggatcggaacgccccgggcctagtgccgcgcacagccatccgctcgtcagcccaccgcagcacaccacatcacggtctccggcagttgccccgtttcggtcccgtcctgttggacctctaacggtgcttcggagacatcctgccctcggtaccacgttgaacctcggtcctcgactcggaccgatg

SEQ ID NO: 9443 - DNA, 203 bp, Homo sapiens
ggcgcgccagtcctcctgccccgcacgccgcgctccgtaatctcttcgcccccaacgtcgggccccccttagtcggccccgcctagtattcgcgaggaagtgccacagacgcacgcgcagccgccaccacactcggctcgcaatcgccccctcgcgcctcggacgccccgcgcgatggcatgacgcggcgactcggaccgatg

SEQ ID NO: 9444 - DNA, 203 bp, Homo sapiens
ggcgcgccagtcctcccacccggtcaccctggtcggcctcggccaccctcccctcggtgtgctgtctggtcccaccccagcccgccccaccccttactgcccagcggaggctcaaacgagcgcctgatcggacccccccaccacggaccaccctgtggagcgaaccggatccgcgcccgcgccgcacacgactcggaccgatg

SEQ ID NO: 9445 - DNA, 203 bp, Homo sapiens
ggcgcgccagtcctttagcgtttttcgatcggctaataccaatcatacgtcctacgtgtaccccggtgcaccctcccccgtaccaatatgcgatagctcatagggtactgacacgtcactacatctgcgggatacgccttcctggcaaagagacgggtcggatcccgcggtttccgcgagctcctcttcgactcggaccgatg

SEQ ID NO: 9446 - DNA, 203 bp, Homo sapiens
ggcgcgccagtcctgccgtcccgtcgggcggcgaggctcgctctttgcgctgcgccgcttgactaccaccaggttcggaggggggctcggttccgggccgtgacccggtcgaccatcggtgccgcggcggtgcgctacctaaccgactgcccggcaacccacccctgcgctgcgcagcgctagcggcgcgactcggaccgatg

SEQ ID NO: 9447 - DNA, 203 bp, Homo sapiens
ggcgcgccagtcctccacccgggcgctaggaccatgccggggtcgagacgccggctctgctaaccgcaacgccggcggggagcccgagggggcccactgcacgagccgcgcctcgggagcgaccgtgccggactcttccaccaggcgtgcctccgtgaatcgtccgccctccggcggcagccgtccctcgactcggaccgatg

SEQ ID NO: 9448 - DNA, 203 bp, Homo sapiens
ggcgcgccagtcctatccacttgatgcttccgccggtcccggtgcgctaactttccacgttcccccagaagcgagtgacgtttccatttgcggtttaaaaagcatagcattactcttactatacgcaacgatggctcatgccctcgctctctccttagcaccgggttgccgtccctctccccagtcatcgactcggaccgatg

SEQ ID NO: 9449 - DNA, 203 bp, Homo sapiens
ggcgcgccagtcctaaggtagttcccactgcgacttaactcatgtcaagtcagtccacgcttccgccgcagggcgatctatgaatgagactggccccttaggtcgtagacaaccagtttatgcatcttacagtagtaatcggaggtgtcgcgttggggttgactacagcgtattctccattaatcggacgactcggaccgatg

SEQ ID NO: 9450 - DNA, 203 bp, Homo sapiens
ggcgcgccagtcctatccttggggacgcatcgcgcaagattttgcgaggctctaaccgcgaagagacgggaaataaaaacccgttgtagggatggaatggcctcctttctctgtacgtccttagaaaacatctagttgcgtcttgtggctgtcttactgaacgaccatcgtccccaactcccatactgcgactcggaccgatg

SEQ ID NO: 9451 - DNA, 203 bp, Homo sapiens
ggcgcgccagtcctagatacatcaatattatctattagtatacatttcggtcgatgtgtttatactacgagtatctaatcaatttttcgttggttcagaaatcaagtgcctgtgaagtgcttcttcacaaaatacttgaacgttgtttactataaagccggctaatacactacattcagtcatttgcccgactcggaccgatg

SEQ ID NO: 9452 - DNA, 203 bp, Homo sapiens
ggcgcgccagtcctccgtggcctcatgtctaccacaaccttgcaggattcccgcagcgctaagcgctcgtgccccgagcgatccccactagacggcttcggagccttcccgctgtgtctagacgatctagtgcatcgtagagttggttcgaaccgacgaaactgctcgccgattgcgccatcgttgcgcgactcggaccgatg

SEQ ID NO: 9453 - DNA, 203 bp, Homo sapiens
ggcgcgccagtcctatgaaaatatctgtacttgtactgaaacgccagtggtgcttgctttcctagtaacaatggaagatgaatttgacgtggaaaattgaataaagtgcttgcaataatatgaggtagacctaactaaattttgatattttatcatacattctacaaaagaacatgtgatgtagctgccgactcggaccgatg

SEQ ID NO: 9454 - DNA, 203 bp, Homo sapiens
ggcgcgccagtcctttttgataggtttttagatgccgataagttcatgcctaggagtccactcatagaatatctctgatattcttatcggaatgtatattgctgttccgtaccgggttttgaggctcttagattttgtacaattttaactctaattgctgaaactaaggcatgtatatatcgactgggcgactcggaccgatg

SEQ ID NO: 9455 - DNA, 203 bp, Homo sapiens
ggcgcgccagtccttcgagatcgataacacattgcaagcaccgaagcgtcagcttgaaatgggacctcctgcagccttggactgtccgcacccgaggtagcgggtcaatttcttccggcgcattttcatatttcgaagacacacactagttggaaagtatttgggtcattccagggcttgtgggagaacgactcggaccgatg

SEQ ID NO: 9456 - DNA, 203 bp, Homo sapiens
ggcgcgccagtcctacggtacctgagagcatacgccgctaatttgaagtacgcggagatatgcgataactaagtaacattgtcagcgtgacgccttgtgggaacccaccctgtctgagaaccgggttatgcgcgataatcactacgacccgattggtgtacaggatccacagtgaaacattcaagcgacgactcggaccgatg

SEQ ID NO: 9457 - DNA, 203 bp, Homo sapiens
ggcgcgccagtcctccggtcgggcctagggctggtaggtcttcgtcggtgggctgtccctgctcgagtgtcgggcgggctgcttcggaaccttgctaacccgtggactttttatttggtcctccgtcgtgctacctcgagcaaggatagaaagcgacgttgactttttacttctaattcacctccggccgactcggaccgatg

SEQ ID NO: 9458 - DNA, 203 bp, Homo sapiens
ggcgcgccagtcctaccgggcgagtgacgtagtatcagttctcgtgagggcaagggttggcgcgtgggtccgggtcccgtcgcccgaaccgtctgaaattactagtgttccctgataccgtgttgcacgccggttggacactccttcctattcttacctcaggccatccgatgtcaggttaacacactcgactcggaccgatg

SEQ ID NO: 9459 - DNA, 203 bp, Homo sapiens
ggcgcgccagtcctcatgcggtaagcctataagatacgcccaaatcgaagcgcacggggtctggcactagtcacgggtcgatgtgcgcgtgccctattcggtagcgctactcccccaacctgagttgtggtttcgcagtactcgtggcatgggaaccaccttggcaagggaaggccacgaagataagacgactcggaccgatg

SEQ ID NO: 9460 - DNA, 203 bp, Homo sapiens
ggcgcgccagtcctttgtcgaagactatgcaagactatcttgactgtcgtgagtttatacgaacccactttattgggcatgcaatccatactagtttgatgtggtaaccgctactgatgcggtgttctaaaccgccttatgtagatcttagtactatcccacacagatacaaggttttgtgctgtcgacgactcggaccgatg

SEQ ID NO: 9461 - DNA, 203 bp, Homo sapiens
ggcgcgccagtcctgcaccgctttacaaagttcgtacatccacataccgtttttgacaggagtgcggactttgacgccaataagcgcgtttgtgacctgaggtctgcctggctggtgtcgtagtgtagactgtttacccataagaatgatgtgttcaagacattttcccgtaggttggcgcgaattcgcgactcggaccgatg

SEQ ID NO: 9462 - DNA, 203 bp, Homo sapiens
ggcgcgccagtcctgacttctccctctctcggagatgatagtcggggtcccatgtgataataattaccctgtcttaattttcaggctctgtccaactcgagcctggatacggatgggatggccctaggagaagcgttctgtacataggtcacgccgcagataggtccgttcaggctggtcccgttcatcgactcggaccgatg

SEQ ID NO: 9463 - DNA, 203 bp, Homo sapiens
ggcgcgccagtcctctgaacaatacttttgttgattcggtttaaaacggatgtctgtcgtagcgtaaaacccgcgatacactgcatttaagataggtgtagaagtggctagtaatttaaagacatgtaaatggtcttccgtgctatcctattagacagctcgatgcactgaaccaactataaacggtgcgactcggaccgatg

SEQ ID NO: 9464 - DNA, 203 bp, Homo sapiens
ggcgcgccagtcctaagtagctaaacagtttctaaaaatctcggccttaagttaagagaagccgtaaacgaagtgctgtaatactaattcggacgctcatgggcggcagtttatacgtgtatgtagaagagtaggatcaccattttgatgttaatctctctcctccaaccatagcgctccgatgacaccgactcggaccgatg

SEQ ID NO: 9465 - DNA, 203 bp, Homo sapiens
ggcgcgccagtccttaagcttttttcaaattactcgttactattgagttgttcattatgtttaacttcacgaaacgggttatgcataagatactttggactgttcaggtgtaagaacaaagtaccaacgagatttaggtgagccctcagttgcctagtcgtggattctttccaataggaataaaccctcgactcggaccgatg

SEQ ID NO: 9466 - DNA, 203 bp, Homo sapiens
ggcgcgccagtcctaacattacatatacttaggattaccttgctgggtttccttggtaatagagttatatattttggcattaaagtatcctctatgtggatgatcctgacgcgtgattcttccctcgattatttgaatctagataaaaggagggaccataattttttgaatgattaattgctaccgctcgactcggaccgatg

SEQ ID NO: 9467 - DNA, 203 bp, Homo sapiens
ggcgcgccagtcctaaattgcagtagcatcattcatcgttccgccaaaattagatacatcataccagaatcacctatgctacggtagacattgaatagacagaaggaacgacgacacaggaaagatctcctccaacccccggaacatcataaagacgtacagtagcaatacttgatcgcaccgagtaacgactcggaccgatg

SEQ ID NO: 9468 - DNA, 203 bp, Homo sapiens
ggcgcgccagtcctacacgagttcattaaagtacctaccaatactggaatctccgccacgattttggctttggtacggtctgttagtaaaaatcgaagtattggtgcggctagtactattgctgcatctaccgatacaagtatagtagtcgcggaaatgagagggggcccagcgatggtaactattttcgactcggaccgatg

SEQ ID NO: 9469 - DNA, 203 bp, Homo sapiens
ggcgcgccagtcctcatcgagatttgctgtcgtttataatcgaaatgggcatgagataaggacaaagagcataccgcggcccgccgattcgcggattaagagtgaatgcggaaccaacaagcgtttacgaaatgactgatcatgtagttgccttgcatccggtctttacgtacttttagaaaattgtccgactcggaccgatg

SEQ ID NO: 9470 - DNA, 203 bp, Homo sapiens
ggcgcgccagtcctttcttactctttagtgaaccgactaataaagtttgaaggtgcgtgctaagataggtaagagactctggtcgagagtttcatgtcgtgcttttggctttggggagtgatgtaggggtttcacttactcttaaccgtgagggttactttcttccctggaagtctgaatataatttacgactcggaccgatg

SEQ ID NO: 9471 - DNA, 203 bp, Homo sapiens
ggcgcgccagtccttaagagggtccgcgttggaaagactcgtgggtcggaatggctttgcaccggtgtcgttgttgccggttttaggcagtaaattcaggcgtgcctacgtaccttagttgctccggctagcctatattgaatttggtgcccatactgacattcctaacactatatgatgttgggaatcgactcggaccgatg

SEQ ID NO: 9472 - DNA, 203 bp, Homo sapiens
ggcgcgccagtcctctggacctagcaagggattctgtaacactcgtggggatcactacgcgggtttctggcgaatgtttggaccggccagggtgatcacatggaatcacatgtatactgtatgtgggccccgtaagctgtcgtgtgtcctgaccgtgctcttcacaatcttttaagtttgtgtcatggcgactcggaccgatg

SEQ ID NO: 9473 - DNA, 203 bp, Homo sapiens
ggcgcgccagtcctgccatatgctcaaacgtctcgggacgccatatacgagagaccatggattgggtggcccactatcacctggagacagtcggggctgggttgtaagccatggaaggacagagacagtgacgttatttggagtccataaacacgcgtcttagcgcagtgggcgcgcacgtcataagtcgactcggaccgatg

SEQ ID NO: 9474 - DNA, 203 bp, Homo sapiens
ggcgcgccagtcctttcaatcaggtgccgcatctacgcaggctgcatcgcggtccaagcgcgcagcagggatccgtcccgtgatgctagggcgtcaagaaggtagcgcgggaaccagatcatcaggaatgtctccgagaggaggatcggggtaactcgggtagcactatgtaaaacgaatgccttcgccgactcggaccgatg

SEQ ID NO: 9475 - DNA, 203 bp, Homo sapiens
ggcgcgccagtcctctgtcgcggttttcgtagatcaccagcaatgtctccgagggaaagtgtggtggtatacgtgctcttattctcaagtacgcgatactgggtgatttcactttagagcgatgcctcagaaaaatggtactggccaaagagtggggctcattacgccagcggattacaagttgctgccgactcggaccgatg

SEQ ID NO: 9476 - DNA, 203 bp, Homo sapiens
ggcgcgccagtccttgtgttgaggagctctgtcgtacgccatgtaagtagctcaacccccagctctgggggcgacccctaatgacaggattacgaggctcacggctagacaacaggtaacggtggatgcattctctatcgtgtgacgttggggtcgtcctgtgtggcctcacgtgagcccactagatgcgactcggaccgatg

SEQ ID NO: 9477 - DNA, 203 bp, Homo sapiens
ggcgcgccagtccttgtccatctctggtctaaaggtcgtgcccgtatgccggaaaagttcggtgaggttgtacttctactctgaagagaaccgcagcgcgcccgcatggcgagtgggggaccgtatatatacaagatttagaccagccaaggaaaatagacttctgtatgacacggttgctctcccgtcgactcggaccgatg

SEQ ID NO: 9478 - DNA, 203 bp, Homo sapiens
ggcgcgccagtcctgccggaatatagcacattgggaaggcatagcgtctgccgtgtatctagatgatcaagagggctactgctacatagggtgcctgtccaagccctgcggactagccgcacacctcgtccctactcgaaatcttttagaatcgcgaatcgatggtacctgtgcgaggcatacgggttcgactcggaccgatg

SEQ ID NO: 9479 - DNA, 203 bp, Homo sapiens
ggcgcgccagtcctcgtcatgtgcgttggccggagggcttactacccttcacgttagttctagcgaaatcctgaatgtacctttcttgccactccccgcttcacactgagtgttactgtcgaattgcttggccacttgtctcttaagcctgtcgctactatgtcttcctcaaagtgccaggtaagtttcgactcggaccgatg

SEQ ID NO: 9480 - DNA, 203 bp, Homo sapiens
ggcgcgccagtcctccgggagtaagcataatacctgtccaactgagatgatgcaaactaacagactcaaacaagtcaggtcaacaataaaaattaaggtaaggagcgaccgggatgcagacgggtgccttggtaaagggaatacgaatccgcagctaccggctcgaagtctccaattgacccacgcaacgactcggaccgatg

SEQ ID NO: 9481 - DNA, 203 bp, Homo sapiens
ggcgcgccagtcctctgtgaaggcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9482 - DNA, 203 bp, Homo sapiens
ggcgcgccagtccttatcggatgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9483 - DNA, 203 bp, Homo sapiens
ggcgcgccagtcctgcagtcgagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9484 - DNA, 203 bp, Homo sapiens
ggcgcgccagtcctattcacccgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9485 - DNA, 203 bp, Homo sapiens
ggcgcgccagtccttgaggtgggcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9486 - DNA, 203 bp, Homo sapiens
ggcgcgccagtcctaacttgtcgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9487 - DNA, 203 bp, Homo sapiens
ggcgcgccagtcctcttccactgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9488 - DNA, 203 bp, Homo sapiens
ggcgcgccagtcctgtcctacagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9489 - DNA, 203 bp, Homo sapiens
ggcgcgccagtcctaatttcatgcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataacgactcggaccgatg

SEQ ID NO: 9490 - DNA, 203 bp, Homo sapiens
ggcgcgccagtccttcgttatatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 9491 - DNA, 203 bp, Homo sapiens
ggcgcgccagtcctgcagtcgatttagaattagaatgtttcttagcggtcgtgtagttatttttatgtcataagtggataatttgttagctcctataacaaaagtctgttgcttgtgtttcacattttggatttcctaatataatgttctctttttagaaaaggtggacaagtcctattttcaagagacgactcggaccgatg

SEQ ID NO: 9492 - DNA, 203 bp, Homo sapiens
ggcgcgccagtcctaacttgtcatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagagacgactcggaccgatg

SEQ ID NO: 9493 - DNA, 203 bp, Homo sapiens
ggcgcgccagtcctctgtgaagcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9494 - DNA, 203 bp, Homo sapiens
ggcgcgccagtccttcgttatacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9495 - DNA, 203 bp, Homo sapiens
ggcgcgccagtcctagtgctgccagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9496 - DNA, 203 bp, Homo sapiens
ggcgcgccagtccttgaggtggcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9497 - DNA, 203 bp, Homo sapiens
ggcgcgccagtcctaggtattgcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9498 - DNA, 203 bp, Homo sapiens
ggcgcgccagtcctgtcctacacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9499 - DNA, 203 bp, Homo sapiens
ggcgcgccagtcctgaaaccctcagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggacgactcggaccgatg

SEQ ID NO: 9500 - DNA, 203 bp, Homo sapiens
ggcgcgccagtcctctgtgaagggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9501 - DNA, 203 bp, Homo sapiens
ggcgcgccagtcctgcagtcgaggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9502 - DNA, 203 bp, Homo sapiens
ggcgcgccagtcctcttccactggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9503 - DNA, 203 bp, Homo sapiens
ggcgcgccagtcctttgcgctcggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9504 - DNA, 203 bp, Homo sapiens
ggcgcgccagtcctgaaaccctggtgtgcaaatcacgcctggcagcccctgcccacagtacccgaagatggcaggccttgttcccttcacctaaattcataaacctgggtgtagtggcttctgatgctgatttgtttctcttttcagtaagtgtggacctttgtgtaccagagagaacatcatggtggcgactcggaccgatg

SEQ ID NO: 9505 - DNA, 203 bp, Homo sapiens
ggcgcgccagtcctctctctcggcggctggagcggacccagcgagtgagggcgcacagccgggacgccgaggcggcgggcgggagacccgcaccagcgcagccggccctcggcgggacgtgacgcagcgcccggggcgcgggtgtatttgatatagtgtttgcaacaaattcgacccaggtgatcaaacgactcggaccgatg

SEQ ID NO: 9506 - DNA, 203 bp, Homo sapiens
ggcgcgccagtcctagtgctgcaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagcgactcggaccgatg

SEQ ID NO: 9507 - DNA, 203 bp, Homo sapiens
ggcgcgccagtcctctgtgaagccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 9508 - DNA, 203 bp, Homo sapiens
ggcgcgccagtcctaacttgtcccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 9509 - DNA, 203 bp, Homo sapiens
ggcgcgccagtcctaggtattgccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggcgactcggaccgatg

SEQ ID NO: 9510 - DNA, 203 bp, Homo sapiens
ggcgcgccagtccttatcggatgtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 9511 - DNA, 203 bp, Homo sapiens
ggcgcgccagtcctgcagtcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 9512 - DNA, 203 bp, Homo sapiens
ggcgcgccagtcctaatttcatgtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagcgactcggaccgatg

SEQ ID NO: 9513 - DNA, 203 bp, Homo sapiens
ggcgcgccagtcctgcagtcgacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtatacgactcggaccgatg

SEQ ID NO: 9514 - DNA, 203 bp, Homo sapiens
ggcgcgccagtcctgcagtcgacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9515 - DNA, 203 bp, Homo sapiens
ggcgcgccagtccttgaggtggcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9516 - DNA, 203 bp, Homo sapiens
ggcgcgccagtcctcttccactcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9517 - DNA, 203 bp, Homo sapiens
ggcgcgccagtcctaggtattgcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9518 - DNA, 203 bp, Homo sapiens
ggcgcgccagtcctgtcctacacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9519 - DNA, 203 bp, Homo sapiens
ggcgcgccagtcctgaaaccctcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9520 - DNA, 203 bp, Homo sapiens
ggcgcgccagtcctaatttcatcaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgactcggaccgatg

SEQ ID NO: 9521 - DNA, 203 bp, Homo sapiens
ggcgcgccagtccttgaggtgggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 9522 - DNA, 203 bp, Homo sapiens
ggcgcgccagtcctaatttcatgagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagcccgactcggaccgatg

SEQ ID NO: 9523 - DNA, 203 bp, Homo sapiens
ggcgcgccagtcctgcagtcgacctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 9524 - DNA, 203 bp, Homo sapiens
ggcgcgccagtcctattcaccccctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 9525 - DNA, 203 bp, Homo sapiens
ggcgcgccagtcctcttccactcctttcccctcccttccctatccccgacgaccggatcctgaggaggcagctgcggtggcagctgctgagttctcggtgaaggtatttcatttctcctgtcccctcccctccccaccccatctattaatattattcttttgaagattcttcgttgtcaagccgccaacgactcggaccgatg

SEQ ID NO: 9526 - DNA, 203 bp, Homo sapiens
ggcgcgccagtccttatcggatttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9527 - DNA, 203 bp, Homo sapiens
ggcgcgccagtccttgaggtggttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9528 - DNA, 203 bp, Homo sapiens
ggcgcgccagtcctaacttgtcttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9529 - DNA, 203 bp, Homo sapiens
ggcgcgccagtcctaggtattgttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacgactcggaccgatg

SEQ ID NO: 9530 - DNA, 203 bp, Homo sapiens
ggcgcgccagtcctctgtgaagttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9531 - DNA, 203 bp, Homo sapiens
ggcgcgccagtccttcgttatattcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9532 - DNA, 203 bp, Homo sapiens
ggcgcgccagtcctagtgctgcttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9533 - DNA, 203 bp, Homo sapiens
ggcgcgccagtcctaacttgtcttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9534 - DNA, 203 bp, Homo sapiens
ggcgcgccagtcctaggtattgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9535 - DNA, 203 bp, Homo sapiens
ggcgcgccagtcctgtcctacattcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaacgactcggaccgatg

SEQ ID NO: 9536 - DNA, 203 bp, Homo sapiens
ggcgcgccagtcctaggtattgccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9537 - DNA, 203 bp, Homo sapiens
ggcgcgccagtcctgtcctacaccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9538 - DNA, 203 bp, Homo sapiens
ggcgcgccagtcctctctctcgccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9539 - DNA, 203 bp, Homo sapiens
ggcgcgccagtcctaatttcatccctaccccatccccttattcagcacatgaaataaacaaggggcatccaaatcttgcggcaacgcccccgggacatgcatcgtcccctggactctctcaaaccccttatccctctggacagaatgcaggtccaaccacgctggtataccctcaaacccctcagacacgactcggaccgatg

SEQ ID NO: 9540 - DNA, 203 bp, Homo sapiens
ggcgcgccagtcctctgtgaagccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9541 - DNA, 203 bp, Homo sapiens
ggcgcgccagtccttcgttataccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9542 - DNA, 203 bp, Homo sapiens
ggcgcgccagtcctgcagtcgaccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9543 - DNA, 203 bp, Homo sapiens
ggcgcgccagtcctaacttgtcccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9544 - DNA, 203 bp, Homo sapiens
ggcgcgccagtcctgtcctacaccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9545 - DNA, 203 bp, Homo sapiens
ggcgcgccagtcctctctctcgccttctgatggtgaatgggaactcccttcctcctgcagcagcctgcctgcagctgtcctggtagaacagtgtggacattgcagaagctgtcactgccccagaaagaaagcaccccagagccaaggcaaagagtcttgaaagcgccacaagcagcagctgctgagcccgactcggaccgatg

SEQ ID NO: 9546 - DNA, 203 bp, Homo sapiens
ggcgcgccagtcctgcagtcgaaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9547 - DNA, 203 bp, Homo sapiens
ggcgcgccagtcctagtgctgcaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9548 - DNA, 203 bp, Homo sapiens
ggcgcgccagtcctgaaaccctaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9549 - DNA, 203 bp, Homo sapiens
ggcgcgccagtcctctctctcgaatatgttcattaccaacactgcagattcccattgagttggtgggggttttgttacctttgttttttttctcagcaaaataattctataactttttgtttgtgacaagaaatggactttcagtttacttaagattaatacttcttgaatgataaaatcattttgcccgactcggaccgatg

SEQ ID NO: 9550 - DNA, 203 bp, Homo sapiens
ggcgcgccagtccttatcggatagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9551 - DNA, 203 bp, Homo sapiens
ggcgcgccagtcctgcagtcgaagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9552 - DNA, 203 bp, Homo sapiens
ggcgcgccagtcctagtgctgcagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9553 - DNA, 203 bp, Homo sapiens
ggcgcgccagtccttgaggtggagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9554 - DNA, 203 bp, Homo sapiens
ggcgcgccagtcctaggtattgagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggccgactcggaccgatg

SEQ ID NO: 9555 - DNA, 203 bp, Homo sapiens
ggcgcgccagtcctctgtgaaggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9556 - DNA, 203 bp, Homo sapiens
ggcgcgccagtccttatcggatgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9557 - DNA, 203 bp, Homo sapiens
ggcgcgccagtcctgcagtcgagcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9558 - DNA, 203 bp, Homo sapiens
ggcgcgccagtcctagtgctgcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9559 - DNA, 203 bp, Homo sapiens
ggcgcgccagtcctaacttgtcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9560 - DNA, 203 bp, Homo sapiens
ggcgcgccagtcctcttccactgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9561 - DNA, 203 bp, Homo sapiens
ggcgcgccagtcctaggtattggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9562 - DNA, 203 bp, Homo sapiens
ggcgcgccagtcctttgcgctcgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9563 - DNA, 203 bp, Homo sapiens
ggcgcgccagtcctgaaaccctgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9564 - DNA, 203 bp, Homo sapiens
ggcgcgccagtcctctctctcggcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9565 - DNA, 203 bp, Homo sapiens
ggcgcgccagtcctaatttcatgcattgcccccagtctcccccaaatttgggcattgtccccgggtcttccaacggactgggcgttgctcccggacactgaggactggccccggggtctcgctcaccttcagcagcgtccaccgcctgccacagagcgttcgatcgctcgctgcctgagctcctggtgcgactcggaccgatg

SEQ ID NO: 9566 - DNA, 203 bp, Homo sapiens
ggcgcgccagtccttatcggatttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggccgactcggaccgatg

SEQ ID NO: 9567 - DNA, 203 bp, Homo sapiens
ggcgcgccagtccttgaggtggttcctcccaaggctaaactttctaattcccttctttgggctcgggggctcccggagcagggcgagagctcgcgtcgccggaaaggaagacgggaagaaagggcaggcggctcggcgggcgtcttctccactcctctgccgcgtccccgtggctgcagggagccggccgactcggaccgatg

SEQ ID NO: 9568 - DNA, 203 bp, Homo sapiens
ggcgcgccagtcctctgtgaagctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9569 - DNA, 203 bp, Homo sapiens
ggcgcgccagtccttcgttatactgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9570 - DNA, 203 bp, Homo sapiens
ggcgcgccagtccttatcggatctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9571 - DNA, 203 bp, Homo sapiens
ggcgcgccagtcctagtgctgcctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9572 - DNA, 203 bp, Homo sapiens
ggcgcgccagtcctaacttgtcctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9573 - DNA, 203 bp, Homo sapiens
ggcgcgccagtcctaggtattgctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9574 - DNA, 203 bp, Homo sapiens
ggcgcgccagtcctttgcgctcctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9575 - DNA, 203 bp, Homo sapiens
ggcgcgccagtcctgtcctacactgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9576 - DNA, 203 bp, Homo sapiens
ggcgcgccagtcctgaaaccctctgccggccggcggccccgcgctcgcccgccccgcttccgcccgctgtcctgctgcacgaacccttccaactctcctttcctcccccacccttgagttacccctctgtctttcctgctgttgcgcgggtgctcccacagcggagcggagattacagagccgccgggcgactcggaccgatg

SEQ ID NO: 9577 - DNA, 203 bp, Homo sapiens
ggcgcgccagtccttcgttataccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 9578 - DNA, 203 bp, Homo sapiens
ggcgcgccagtcctcttccactccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 9579 - DNA, 203 bp, Homo sapiens
ggcgcgccagtcctctctctcgccccgttcttccctgcggagtgcgctgcgccgcccagccctgtcgccccccggaggtgatccctccctcctgcctgcccgccagcctgacctgtgcccggctcgcgggccgcagcctcggcccccgcgcgcccccggcagctctcggcgcgatgagcatagagacgcgactcggaccgatg

SEQ ID NO: 9580 - DNA, 203 bp, Homo sapiens
ggcgcgccagtcctctgtgaaggcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9581 - DNA, 203 bp, Homo sapiens
ggcgcgccagtccttatcggatgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9582 - DNA, 203 bp, Homo sapiens
ggcgcgccagtcctgcagtcgagcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9583 - DNA, 203 bp, Homo sapiens
ggcgcgccagtcctagtgctgcgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9584 - DNA, 203 bp, Homo sapiens
ggcgcgccagtcctaacttgtcgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9585 - DNA, 203 bp, Homo sapiens
ggcgcgccagtcctaggtattggcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9586 - DNA, 203 bp, Homo sapiens
ggcgcgccagtcctttgcgctcgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9587 - DNA, 203 bp, Homo sapiens
ggcgcgccagtcctgtcctacagcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9588 - DNA, 203 bp, Homo sapiens
ggcgcgccagtcctaatttcatgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggcgactcggaccgatg

SEQ ID NO: 9589 - DNA, 203 bp, Homo sapiens
ggcgcgccagtcctctgtgaagaaaaaaccaggatcatcacgcgtgagttggataaggctctggatggtgtactgacacacaagcaaggctgcctccattgtctcagcaccgatttctaggcagcaccctctttaataggtgcaaggggggtgcggtgttggtgagtcacactttcgttgcagacaaacgactcggaccgatg

SEQ ID NO: 9590 - DNA, 203 bp, Homo sapiens
ggcgcgccagtccttatcggataaaacaatttcccataacaccccaataccccaaggacatttaaagctaaattcatctgtaatcaacagagctctacacaatgaccatcgtagtgtttgcgactgaatacgatgccgccaacgtaatttttagtatcctatgtagaagtcccagtgaacatttaatccgactcggaccgatg

SEQ ID NO: 9591 - DNA, 203 bp, Homo sapiens
ggcgcgccagtcctgcagtcgaaaaacttctgtgaaggtcacatccctagttggattacgccgcttttgaaaaatctagaagttgtttggaaaagagatatctggttcgtatgaataggatgctcttgaagaaagggccttcgggccaaacatctggtcggccatcgaccagaccgccggacccagcgcgactcggaccgatg

SEQ ID NO: 9592 - DNA, 203 bp, Homo sapiens
ggcgcgccagtcctattcacccaaaagtccatttccgtagcggccgcaaaaacaagaatgtaaaagagccagagactgacatataagcgttgccttgcgcctttcttacaactcatcttaagtgttattttgaactagtcttcgcgtcgacgtgattaacagcagacagccctctgtcacctggaaaacgactcggaccgatg

SEQ ID NO: 9593 - DNA, 203 bp, Homo sapiens
ggcgcgccagtcctgtcctacaaaacggaagttcagggagggcgaggccgtgccccacatccaggcagcgcaggccgcgggccgctcccctagccaggaagagccgccgtccgcaccgggaccggagaggaagcggaggtctgaagggggacaggtgaggcggaaccaaccctcctggccatgggaggcgactcggaccgatg

SEQ ID NO: 9594 - DNA, 203 bp, Homo sapiens
ggcgcgccagtcctgaaaccctaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaacgactcggaccgatg

SEQ ID NO: 9595 - DNA, 203 bp, Homo sapiens
ggcgcgccagtcctggtgctcaaaagcgctcggtttaaaaagcttctatgcctgaataggtgaccggaggtcggcacctttcctttacaattaatgaccctatgaatacaactgactgttttatcgctgtggtaaacgccatcaaagaggtaatagcacttttcctatcacggactgcaggaaaaatgcgactcggaccgatg

SEQ ID NO: 9596 - DNA, 203 bp, Homo sapiens
ggcgcgccagtccttcacatccaacacagtgggggcgatagatgccatctgcgcgatctacaatttgaagtactgcgagatcgtttggaataaaaattaacatgattcttccgtctcttccctctcctctgctgcttgaaacgcaatccagttgcattgcttggttgggatttgcatatgctaccgtgcgactcggaccgatg

SEQ ID NO: 9597 - DNA, 203 bp, Homo sapiens
ggcgcgccagtcctcgtagcctaactgtccagtttaaaaagcttctatgcctgaataggtgaccggaggccggcaccttttccttttatccaacacattttatgaagacaactgactgttttgacgttttgctcgagatctttcacaggttccgacacacgttcaagacagacaggaagatggaattccgactcggaccgatg

SEQ ID NO: 9598 - DNA, 203 bp, Homo sapiens
ggcgcgccagtcctaccggcagaacttgttaggagacgccctcaatcgtattaaaagccgtgtattcccccgcactaaagaataaatccccagtagacatcatgcgtactgttggtgtatttctggccacctgtcttgtcaccattttcgtcctcccaacatggggcaattgggcatacccatgttgtcgactcggaccgatg

SEQ ID NO: 9599 - DNA, 203 bp, Homo sapiens
ggcgcgccagtcctagatcaccaactttcggtgctgttgtttaatcacaatgacaggttttacgagggtcgagctggagaccctgtggcttgtcttgtgatggaaagactgatttttccacctgttcgacaggctactatgatatgacgcttgtttcttttattttgcagactaattcaaaactaacacgactcggaccgatg

SEQ ID NO: 9600 - DNA, 203 bp, Homo sapiens
ggcgcgccagtcctcgatgcgcaagacacttttattttgcaaactcaaataaaggtgctaaaaaatcaaaaaacaacgaacctaaaccaagcacctcaaaaatgtctgaaaatgaaattcaagaccaacagccatcagaacctaatgatggccaacgaggagggggaggaggtgcgaccggcagtgtgcgactcggaccgatg

SEQ ID NO: 9601 - DNA, 203 bp, Homo sapiens
ggcgcgccagtcctacaagaataagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatctcgactcggaccgatg

SEQ ID NO: 9602 - DNA, 203 bp, Homo sapiens
ggcgcgccagtcctcggcgtgaaagcgtgtgattcagtatctgtttttataatacggagagctatcgtgctgagcggaacagagctttggctgtgacgaagatggatgtgtggaagcgtcaacggcttcaagaatgccgtgaattgtgtcctttgcctgtattaatgtcactgtcgaatatgttttcacgactcggaccgatg

SEQ ID NO: 9603 - DNA, 203 bp, Homo sapiens
ggcgcgccagtcctggctcctgaaggaaaggaaaagcgcatccaagaatggctccaaaagaatggagagaacaggttgtcagccatggcagtcagcggggatgattgtgtggtgaaaccagcagatgacagattcgccacagcactgcatttcctcaacagcatgtctaaggtgaggaaagatactcacgactcggaccgatg

SEQ ID NO: 9604 - DNA, 203 bp, Homo sapiens
ggcgcgccagtcctgcttcttcaagggaccgtagagactggcagagcactaaaacaggtagttggtctatcaacagctgagaatgccctgttagtagccttattcggctacgtaggatatcaggcgctttcaaagaggcatataccagtagtcacagacatatattcaattgaagatcacaggttggacgactcggaccgatg

SEQ ID NO: 9605 - DNA, 203 bp, Homo sapiens
ggcgcgccagtcctcagggtgcaagtccctcactgagaggctttatgttgggggccctcttaccaattcaaggggggaaaactgcggctaccgcaggtgccgcgcgagcggcgtactgacaactagctgtggtaacaccctcacttgctacatcaaggcccgggcagcctgtcgagccgcagggctcccgactcggaccgatg

SEQ ID NO: 9606 - DNA, 203 bp, Homo sapiens
ggcgcgccagtcctaacagagcaagttttggagactaagtgaaagacattgtcggtttgcgcttgtcggcatctgttttcttttagccttgtatttttgttatgttctacttaaaaaaactcctacgccagcttctggctccgttgtgtaaacatgggtcgtacacgcatttgcaattgtttgtgatgcgactcggaccgatg

SEQ ID NO: 9607 - DNA, 203 bp, Homo sapiens
ggcgcgccagtcctactatgacaatcagtgtcgtcgcggtcgctgttctaaagtccgcacgcacccaccgggactcagattctccccagacgccgaggatggccgtcatggcgccccgaaccctcctcctgctactctcgggggccctggccctgacccagacctgggcgggctcccactccatgaggcgactcggaccgatg

SEQ ID NO: 9608 - DNA, 203 bp, Homo sapiens
ggcgcgccagtcctatccgcgtaatgaaatacccaatcactgctgacaaaaggataacagaaatggttccggagagaaatgaacaaggacaaactctatggagtaaaatgagtgatgctggatcagatcgagtgatggtatcacctttggctgtaacatggtggaatagaaatggacccgtggcaagtcgactcggaccgatg

SEQ ID NO: 9609 - DNA, 203 bp, Homo sapiens
ggcgcgccagtcctttagttcaaatgaagggagtgtacataaacacagctttgttgaatgcatcctgtgcagccatggatgacttccaactgatcccaatgataagcaaatgcagaaccaaagaaggaagacggaaaactaacctgtatggattccttataaaaggaagatcccatttgagaaatgaccgactcggaccgatg

SEQ ID NO: 9610 - DNA, 203 bp, Homo sapiens
ggcgcgccagtcctaatgagaaaatgaagggggtatacattaatactgccttgcttaatgcatcctgtgcagcaatggacgatttccaactaattcccatgataagcaagtgtagaactaaagagggaaggcgaaagaccaatttatatggtttcatcataaaaggaagatctcacttaaggaatgaccgactcggaccgatg

SEQ ID NO: 9611 - DNA, 203 bp, Homo sapiens
ggcgcgccagtcctgttcaattaatggaatttgaaccatttcaatctttagtccccaaggccattagaagccaatacagtgggtttgtcagaactctattccaacaaatgagagacgtacttgggacatttgacaccacccagataataaagcttctcccttttgcagccgctccaccaaagcaaagccgactcggaccgatg

SEQ ID NO: 9612 - DNA, 203 bp, Homo sapiens
ggcgcgccagtcctcgtcagtaaatgtgctctctgatgcaaggatcaactctcccgaggagatctggagctgctggtgcggcagtaaagggagtcggaacgatggtgatggaactaattcggatgataaagcgagggattaacgatcggaatttctggagaggtgaaaatgggcgaagaacaagaattcgactcggaccgatg

SEQ ID NO: 9613 - DNA, 203 bp, Homo sapiens
ggcgcgccagtcctcgggtttgacaaacgattaagaacagctgtcttggctccgactcgggtggtggccgctgaaatagcggaagcactgaaaggacttccaatacggtatctgactccggcagtaaagagggagcataccgggacagagataatagatgtgatgtgtcacgcgactttgacagcgcgcgactcggaccgatg

SEQ ID NO: 9614 - DNA, 203 bp, Homo sapiens
ggcgcgccagtcctttgggactacaaacgattaagaacagctgtcttggctccgactcgggtggtggccgctgaaatagcggaagcactgaaaggatttccaatacggtatctgactccggcagtaaagagggagcataccggaacagagataatagatgtgatgtgtcacgcgactttgacagcgcgcgactcggaccgatg

SEQ ID NO: 9615 - DNA, 203 bp, Homo sapiens
ggcgcgccagtcctcatcccacacaaagtacacaacaagcgttttgaaccacgttctatagacgaacgtgtcattcttggaggacttcatgattgcgatggtctcagttgagcattcaccttttaaataatttgcaaagggcgtgaccggatgttttaaagggtccagtcctcctcagatctcaaacacgactcggaccgatg

SEQ ID NO: 9616 - DNA, 203 bp, Homo sapiens
ggcgcgccagtcctgtatcgcgacactttcgtgatgtagcaagactgaagaaaggtacccccgtcgttggcgtgattaacaacgctgatgttgggagactgattttctctggtgaggcccttacctacaaagacattgtagtgtgcatggacggagacaccatgcccggcctctttgcctacaaagcccgactcggaccgatg

SEQ ID NO: 9617 - DNA, 203 bp, Homo sapiens
ggcgcgccagtcctgggctgatacagggaagaatttgaaaagttattggacgatagtccgggactttttgaagctcttaacttgggtcatcaggctcattttaaggagaaggttttatcagttttagatttttctactcctggtagaactgctgctgctgtagcttttcttacttttatattggataacgactcggaccgatg

SEQ ID NO: 9618 - DNA, 203 bp, Homo sapiens
ggcgcgccagtcctagttaagaacatttgtccgtgaggcgggcgcgctgcttagacgccactcgatctcgctcctgtccctggagcacaccctgtgtacctatgtatgacaccgacccccatcgccgcggctcccggcccgggccctatcacggcaaggagcgccggcggtcgcgctcctctgcggcccgactcggaccgatg

SEQ ID NO: 9619 - DNA, 203 bp, Homo sapiens
ggcgcgccagtcctagaccctgaccacgcctgcttcacgcctcgtttactaatggaatattaataaatatcttcctgttggctctctttgaagtggttgccatggtttcgtttaagcaggtgagggtgccattgtttaccgccatcgcacttgttattgttctactcctggcatactttttgccaccccgactcggaccgatg

SEQ ID NO: 9620 - DNA, 203 bp, Homo sapiens
ggcgcgccagtccttttgtataaccactcaccacattggtgtgcacctgggttgatggcgggaccgtcgattccctgacgactacgaacacctaaatgaagcggaaggcttcatttggtgaccccgacgtgatagttagggaatagtggtcggccacagacggcgtggcgatcctgtcctcatccgtccgactcggaccgatg

SEQ ID NO: 9621 - DNA, 203 bp, Homo sapiens
ggcgcgccagtcctaagatcacaccattcaccacattggtgtgcacctgggttgatggcgggaccgttgattccctgacgactacgagcacctgcatgaagcagaaggcttcatttggtgaccccgacgtgatagttagggaatagtggtcggccacagacggcgtggcgatcctgtctccatccgtccgactcggaccgatg

SEQ ID NO: 9622 - DNA, 203 bp, Homo sapiens
ggcgcgccagtcctgggtttgcaccccggctactcctgctcagcatggctgctttagggactgttctcttcagtgtccggaggctgcactgcagcgtagccgcttgggcgggcggccagtggcgactacagcagggactggctgccaacccctccggctacgggccccttaccgagctcccagactggcgactcggaccgatg

SEQ ID NO: 9623 - DNA, 203 bp, Homo sapiens
ggcgcgccagtcctctcgaattacgaaagtgtgactcaccaacaccgcaccccccttgcacctattaaagagggtgctgcctagaaatcggtgctgagacaatggaggcagccttgcttgtgtgtcagtacaccatccagagccttatccaactcacgcgtgatgatcctggttttttcaatgttgagcgactcggaccgatg

SEQ ID NO: 9624 - DNA, 203 bp, Homo sapiens
ggcgcgccagtcctaggatagaacgatttatgacagtaatgtaattcgcgtcagtcgtcggaaacgagaagacagtttactaaaaaagatgagattggagtatggaaacgcacttatactatgacaccctgtatcaatatcaaggcggagtgtatccggctcatatttgcctgccgacagatgtgtgtcgactcggaccgatg

SEQ ID NO: 9625 - DNA, 203 bp, Homo sapiens
ggcgcgccagtcctccttcctaacggaagtctcgttctttttcgtccttttccccggttgctgcttgctgtcctggtccgcgccagagcccagcgcgcctcgtcgccatgcctcggaaaattgaggaaatcaaggacttcctgctcacagcccgacgaaaggatgccaaatctgtcaagatcaagaaacgactcggaccgatg

SEQ ID NO: 9626 - DNA, 203 bp, Homo sapiens
ggcgcgccagtcctctgtttgaacgggctctcccttgggtgcttagccccgcccccgtcccactctgccctgttgctgtcgcgccgctgctggttgctgtccctggtggggtggaagacaacccgtgagtattacaccttcatgtgggttactttgcccattgacctaaacaacaaatcagctaaacacgactcggaccgatg

SEQ ID NO: 9627 - DNA, 203 bp, Homo sapiens
ggcgcgccagtcctcagtacagactgaccaaagctggaaatctttttttcaaaggctttggaagcagttagatctaagtgaccaagaagacgagggggaggatggaggctctgaaccagcgtttcaatgctctagaagaccagctcatggacatatatgaacaagggagtgataaattagaagatcaacgactcggaccgatg

SEQ ID NO: 9628 - DNA, 203 bp, Homo sapiens
ggcgcgccagtcctcacatgtaactgactgactcctttggattttgacctcagaatgcctacctgacctcccacttgcctctcccttctcggattgccggtggtgcctggcggaaaaagcacaagtgtgttgcaggctaccaaactcctacccgacaaaggtgcgtgtccgcgtgctgagtaatgggacgactcggaccgatg

SEQ ID NO: 9629 - DNA, 203 bp, Homo sapiens
ggcgcgccagtcctttggaatcactggaccctttaaaacatccggtcacgccctttgcaaattatttaaaaggtgaatgctcaactgagaccatcgcaatcatgaagtcctccaagaatgacacgttcgtctatagaacgtggttcaaaacgcttgttgtgtactttgtgatgtttgtcatgtcggcgcgactcggaccgatg

SEQ ID NO: 9630 - DNA, 203 bp, Homo sapiens
ggcgcgccagtcctgttcgcgaactggcgtgaattgtgcccaccagagggtgagcccacctgtctgacttggcccccgtgtacataatactcggggtctcggcacccaggcagccttgcgtggtgctatcctgctgcagggcgtttcttaggttctcggtcagacggccgcgctgcgaggcatacagccgactcggaccgatg

SEQ ID NO: 9631 - DNA, 203 bp, Homo sapiens
ggcgcgccagtcctgcgatgcaagaaaaaggacattgggctaaagattgccccaagaagccaagaggaccccggggaccgcgaccccaggcctccctcctgaccttagacgattagggaggtcagggtcaggagcccccccctgaacccaggataaccctcaaagtcggggggcaacccgtcaccttccgactcggaccgatg

SEQ ID NO: 9632 - DNA, 203 bp, Homo sapiens
ggcgcgccagtcctaggccaagagaagtgcttacgggcaatctccaaacattgaaaataagggtgcatgaggggtacgaggaattcacaatggtggggaaaagggcaacagctatactcagaaaagcaaccaggagattggttcagctgatagtgagtggaagagacgaacagtcaatagccgaagcacgactcggaccgatg

SEQ ID NO: 9633 - DNA, 203 bp, Homo sapiens
ggcgcgccagtcctcgttctacagacaccgtgtcctcttgcctgggagaggggaagcagatctgaggacatctctgtgccaggccagaaaccgcccacctgcagttccttctccgggatggacgtggggcccagctccctgccccaccttgggctgaagctgctgctgctcctgctgctgctgcccctcgactcggaccgatg

SEQ ID NO: 9634 - DNA, 203 bp, Homo sapiens
ggcgcgccagtcctacgaagaaagacttcactaacctattagcacttcaccacttcgatatcgtcgatcccattttcaccgtcaactactacgtttgaagaatgactgtacacaagagccgtattcgacgatcgcgaagcctgtccgtgacacacagaatacaaaaacgacctgatcacagagaaaaacgactcggaccgatg

SEQ ID NO: 9635 - DNA, 203 bp, Homo sapiens
ggcgcgccagtcctgcgttctgagagaaaaaaccggatgtacaaatgaggagggatgtaaagacttgcagatgaggttctcatagattgttattagtgattatggtgcctcagggttgtagtttagtatgggtgagtgcattatacgtgtcggtgatagcgtctttgcatattattaacaatgaaaatcgactcggaccgatg

SEQ ID NO: 9636 - DNA, 203 bp, Homo sapiens
ggcgcgccagtcctgtctacttagaggggtatgtgattctggtaggggacggaaggctaaaacggtttccgcccccgtctgaatttttgctttcggtttggagccgaagccgcgccgcgtgtcttgtctgctgcagcatcgttctgtgttgtctctgtttgactgtttttctgtatttgtctgaaagccgactcggaccgatg

SEQ ID NO: 9637 - DNA, 203 bp, Homo sapiens
ggcgcgccagtcctggcccgctagaggttagtgaaacacagggaacagagaagttgacaataacatattcatcctcaatgatgtgggaaatcaacggtcctgagtcagtgcttgttaacacttatcaatggatcatcaggaattgggagactgtaaagattcaatggtctcaagatcccacaatgctgcgactcggaccgatg

SEQ ID NO: 9638 - DNA, 203 bp, Homo sapiens
ggcgcgccagtcctgagtacctagatgaactatgattggagcctttatgaggaggacagtctgatgattacacaattggaaattcttaataatttgttgatatcagatgaactaccaatggcagtaaaaaatataatggccaggactgaccacccagaaccaattcagctggcgtacaacagctacgacgactcggaccgatg

SEQ ID NO: 9639 - DNA, 203 bp, Homo sapiens
ggcgcgccagtcctgagcgcacagccatggaagagctggatgcttgttacatcaacgagcaacaccggctctttccccttccccgtccctcccactggtacaattgtctctattgtcaacatccctcggaagacggcgacaccctcatgtcgctggcttgtgagtacgatgaagactgcccctttcaccgactcggaccgatg

SEQ ID NO: 9640 - DNA, 203 bp, Homo sapiens
ggcgcgccagtcctacgtcaggagccctcaaccggttggagaagctggcaagaagtacctttttgctcacaccatttccacgagctgcaaatgaaagatggcagaaagattgtggttccatgtcgagaccaggatgaactaattggaagagccaggctctctccagggtctggctggtcactaacagacgactcggaccgatg

SEQ ID NO: 9641 - DNA, 203 bp, Homo sapiens
ggcgcgccagtcctcacatacgaggaagattaagaaaaagtgtctgtggggtctttccgtgtagaagggcacacagccataattcttcctctttatacaacatggctacacaacatacgcaatatccagacgcaaggttatcatcacctatagttttagatcagtgtgatcttgtcactcgtgcttgtcgactcggaccgatg

SEQ ID NO: 9642 - DNA, 203 bp, Homo sapiens
ggcgcgccagtcctagcttcccaggaccggtttccgtgtcatatggatacacggggttgaaggtatcttcagacggtcttgcgcgcttcatctgcaacaacatgaagatagtgggtgcggatggacaggaacaggaggaaactgacattccatttagattgtggagaaagtttgcagccaggaggaagcgactcggaccgatg

SEQ ID NO: 9643 - DNA, 203 bp, Homo sapiens
ggcgcgccagtcctcagattagaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaacgactcggaccgatg

SEQ ID NO: 9644 - DNA, 203 bp, Homo sapiens
ggcgcgccagtccttgacttctaggcgccactggacgacgcaagactgcaattgttctatctatcccggccatataacgggtcatcgcatggcatgggatatgatgatgaactggtcccctacggcagcgttggtggtagctcagctgctccggatcccacaagccatcatggacatgatcgctggtgcgactcggaccgatg

SEQ ID NO: 9645 - DNA, 203 bp, Homo sapiens
ggcgcgccagtcctttacaatgaggcgggtgggggacttccactacgtatcgggtatgactactgacaatcttaaatgcccgtgccagatcccatcgcccgaatttttcacagaattggacggggtgcgcctacataggtttgcgcccccttgcaagcccttgctgcgggaggaggtatcattcagagcgactcggaccgatg

SEQ ID NO: 9646 - DNA, 203 bp, Homo sapiens
ggcgcgccagtcctttcacataagggagcctccagtgggggctgtatcatcgccgcctgttgctgcatcacgctctcgtaagaaggaggaggaccctccggatacaccaccgctccgcctagcacggctcgtctcctcatcgtactagacacagataacaaaaaagaacgaacgcacgctcggtcgcccgactcggaccgatg

SEQ ID NO: 9647 - DNA, 203 bp, Homo sapiens
ggcgcgccagtcctgtaatggaagtaagtattacaccctttgccccacaccccctttcccttactcttccttctctaacgcactttctcctctttccccagtcaccctcctgctcatcgctctctggaatttgcacggacaggcattgtaccttggaattgtgctgttcatcttcgggtgcttacttgcgactcggaccgatg

SEQ ID NO: 9648 - DNA, 203 bp, Homo sapiens
ggcgcgccagtccttcgtagccagtcgcggctggccgactcatgggttaaagtcagttgacaagacacatggcttcttcaattctggtttctgactccgtctttgcccccatccttacccacaaactctcccgtcggatccggcgacaccccgtcgcttggcatcctagggagaactcccgactgtctcgactcggaccgatg

SEQ ID NO: 9649 - DNA, 203 bp, Homo sapiens
ggcgcgccagtcctgtagaggcagtgagcgacacactctgcgtcctcgcctcaccagatggagaggagaaaacctatggtggctgtgaaggacctgatgccatgtatgtcaaattgatatcatctgatggccatgaatttattgtaaaaagagaacatgcattaacatcaggcacgataaaagccatgcgactcggaccgatg

SEQ ID NO: 9650 - DNA, 203 bp, Homo sapiens
ggcgcgccagtcctcgcaagttagttctgcataaaagtgctttgtccctacatgccagcggtcataaaagaattggaaagactgcagctgaaatggggaggtggtttggttagggtgccactctcgcgtaattcgacacatgagatgtactgggtgagcggctcaagtgggaatgtgacaaatagtatcgactcggaccgatg

SEQ ID NO: 9651 - DNA, 203 bp, Homo sapiens
ggcgcgccagtcctaaacagtgagtttctgcacttaacaacacaaccaatcccactgcctaccacaagggcccggtgactcgactggctctcccatacaccgcgccacaccgtgtgttggctacggcgtacactggcactacgacctacaccgccagtgcacgcggggattcggctcacctaacgacgcgactcggaccgatg

SEQ ID NO: 9652 - DNA, 203 bp, Homo sapiens
ggcgcgccagtcctctgccgggagttttgcataaaagtgctttgtccctacatgccagcggtcataaaagaattggaaagactgcagctgaaatggggaggtggtttggctagggtgccactctcgcgtaattcaacacatgagatgtactgggtgagcggctcaagtgggaatgtgacaaatagtatcgactcggaccgatg

SEQ ID NO: 9653 - DNA, 203 bp, Homo sapiens
ggcgcgccagtcctcttataccatagccttcgcctcccgggggaaccatgtttcccccacgcactacgtgccggagagcgatgcagccgcccgcgtcactgccatactcagcagcctcactgtaacccagctcctgaggcgactgcatcagtggataagctcggagtgtaccactccatgctccggttcgactcggaccgatg

SEQ ID NO: 9654 - DNA, 203 bp, Homo sapiens
ggcgcgccagtccttaacacgtatattcggtaacaatgatgtctgaagacttaccagaagtttggacagctcaatgacagtgtccatctcgtcgcttgtcagttttctgtgtgggtaaaaaaaagactattaaacattgaatgttggcggaaatgagcagttctgtttttgagtttgttttctaaaatcgactcggaccgatg

SEQ ID NO: 9655 - DNA, 203 bp, Homo sapiens
ggcgcgccagtcctggaacgccatccgggagttgttggacgcggcgcttagccagggtccctatcctcctgactatacgcctcacggaggcgtctgaggtcatgttcaacatgaacgtggacgagagcgcctctggcgctctcggctcctcggccattcctgtgcaccccacgccggcctgggtccgacgactcggaccgatg

SEQ ID NO: 9656 - DNA, 203 bp, Homo sapiens
ggcgcgccagtccttagatttcatgccagacagggagcagcgagggtgacatcctggctcgggaggcaactcagaactgctgggaagaggttggagggtagaagcaaaacctggtttggcgcttatgccctatcgccttactgtaatgtaacaagcaaaatagggtacatatggtacactaacaactgcgactcggaccgatg

SEQ ID NO: 9657 - DNA, 203 bp, Homo sapiens
ggcgcgccagtcctgggtccgaattaggcctcacacgtgtggtcgaagctgctcctatccacgctatcattgctggtaggatgttgcttggtggactcattgagtacatgcaggcaaatcctggcaaacatggtagtgctgttggttgcaacccagacctacactggacaaaatttttctttaaattccgactcggaccgatg

SEQ ID NO: 9658 - DNA, 203 bp, Homo sapiens
ggcgcgccagtcctggcgggcaattgaggggattcctaattctaggcagagaggacaaaagatatggacccgcattgagcatcaatgaactgagcaatcttgcaaaaggggagaaggctaatgtattgataatgcaaggagacgtggtgttggtaatgaaacggaaacgggactttagcatacttactcgactcggaccgatg

SEQ ID NO: 9659 - DNA, 203 bp, Homo sapiens
ggcgcgccagtcctttactgtcatttattctattgtaagttggggggcaactggacatgtgtgaaaggcgagccagtggtctacacaggggggctagtaaaacaatgtagatggtgtggcttcgacttcgatgggcctgacggactcccgcattaccccataggtaagtgcattttggcaaatgagaccgactcggaccgatg

SEQ ID NO: 9660 - DNA, 203 bp, Homo sapiens
ggcgcgccagtcctactgtgcacaaaaagaaagaaggttttttgatctttattgtgtgcgaataactatgaggaagattaataattttcctctcattgacacttacattaagattaagattctcattgatctgttacttactctgaggataataattggtgttcagaagtaccccattccccagtgggcgactcggaccgatg

SEQ ID NO: 9661 - DNA, 203 bp, Homo sapiens
ggcgcgccagtcctctgctgaacaaaagttgtcggtgtcatgtgggactatgatgaagtagcagctcacacgccctctaagtctgctaagtcccacatcactggccttcggggcactgatgttcgttctggagcagcccgcaaggctgttctggacttgcagaagtgtgtcgaggcaggtgagatacccgactcggaccgatg

SEQ ID NO: 9662 - DNA, 203 bp, Homo sapiens
ggcgcgccagtcctccgtaagacaacctaggggactaggttttctctattttaaaagatgtcaatatgggtgcaaataatagcaaggagagtgtgtccagcaatggcaatcagggtactattgtcaataatttttatgctaactcatattatgcttctattgacgcttctgcctcctcagtcgggggccgactcggaccgatg

SEQ ID NO: 9663 - DNA, 203 bp, Homo sapiens
ggcgcgccagtcctggttgacccaactgctgctctagaaacttctcctcccgctcctttgggggctacctgtactacccaggctcctaccccagcagcctggtctacagcactgccctctgctctcccagcacctgccagctgcgttcctctctctacagggactgtcagaagacctgctgggagccccgactcggaccgatg

SEQ ID NO: 9664 - DNA, 203 bp, Homo sapiens
ggcgcgccagtcctcgggcgcacaactgttgctctagaaacttctcctcctgctcccacgggggttacttgcactacccaggctcctcctgtggctcttcctaccccagcaacctggtctacagcactgacctctgctctcccagcacctgccagctgggttcctctctctataggggctgtcaggagcgactcggaccgatg

SEQ ID NO: 9665 - DNA, 203 bp, Homo sapiens
ggcgcgccagtccttctagttgcaaggatgccaaggaatggctcgacaacacgcgccaagtgtgtttgaagaacgggaacgtccatattgccaacctttgcaaagtggtcgccccagcacccagcaagtcgagacccgagcccgtggtcgtttgcctccgcggcaagtctggccagggcaagagtttccgactcggaccgatg

SEQ ID NO: 9666 - DNA, 203 bp, Homo sapiens
ggcgcgccagtccttcgcttcgcaaggcccaacctagagtcaagctgtaactctaggggaaggactagaggttagaggagaccccttgcgagtgaacaccacaagagacagcatattgacacctgggatagactaggagaccctctgtcctaacaacaccaaccacttggcacagatcgccgaaagtgcgactcggaccgatg

SEQ ID NO: 9667 - DNA, 203 bp, Homo sapiens
ggcgcgccagtcctcaactgaccaatacagaaatatgttctggcactttagaaatgcttctgattgtgaacgttgtaattactgggacaatgtataccgtatgcacttagctcatgtttcctctcagacagaatcagaagaaataactgacgaggaaatgctttctgctgctgaaagtatggaaacagcgactcggaccgatg

SEQ ID NO: 9668 - DNA, 203 bp, Homo sapiens
ggcgcgccagtcctgcctcactcaattctgggacggaaccgactactttggggtgtccgtgtttcttttgttcatattaaactgttttatggtcacaacacaacttggtacgatttgtgattattcactgctcacttgtcacagtaaatatacacaatcatcatgcctgtcgttgtgaactcagtttacgactcggaccgatg

SEQ ID NO: 9669 - DNA, 203 bp, Homo sapiens
ggcgcgccagtcctgatcgccgcaattggtccaggagagggtggctaggcctgcatccttgcgaccacgttggcataaaccttccactgttcttgaagtattgaatcctaggactgttgttattttggaccatcttggcaacaacagaactgtaagtattgacaatttaaaacctacttctcatcagacgactcggaccgatg

SEQ ID NO: 9670 - DNA, 203 bp, Homo sapiens
ggcgcgccagtcctcaatcattcaccaagaggaactgactgaattacacaagaaacgtggggagctcaactggtgattgacctgaataaccaaatgcagcggaaggacagggagatgcagatgaatgaagcaaaaattgcagaatgtttgcagactatctctgacctggagacggagtgcctagacctcgactcggaccgatg

SEQ ID NO: 9671 - DNA, 203 bp, Homo sapiens
ggcgcgccagtcctccacaccacaccggcaagtcacatgagccaccaaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatacgactcggaccgatg

SEQ ID NO: 9672 - DNA, 203 bp, Homo sapiens
ggcgcgccagtcctttaaactccacctctgactaaggggattttaggatttgtgttcacgctcaccgtgcccagtgagcgaggactgcagcgtagacgctttgtccaaaatgcccttaatgggaacggggatccaaataacatggacaaagcagttaaactgtataggaagctcaagagggagataaccgactcggaccgatg

SEQ ID NO: 9673 - DNA, 203 bp, Homo sapiens
ggcgcgccagtcctctttattgcacgagtacccggtggggtcgcaattaccttgcgagcccgaaccggacgtagccgtgttgacgtccatgctcactgatccctcccatataacagcagaggcggccgggagaaggttggcgagagggtcacccccttctatggccagctcctcggccagccagctgtcgactcggaccgatg

SEQ ID NO: 9674 - DNA, 203 bp, Homo sapiens
ggcgcgccagtccttaatccagcagcatcaggaactccggctttctttgatcttaaaaaccttaaaggctggtcagggctaccgatatttgaggcatcaagtggaagggtagtcggcagggtcaaggtcggtaagaatgaggactctaaaccaaccaagcttatgagtggaatacaaacagtttccaacgactcggaccgatg

SEQ ID NO: 9675 - DNA, 203 bp, Homo sapiens
ggcgcgccagtcctacgtaccgcagcgtgttggacttgggtggaagaggagggggcaacccgttcgctcatctgcgtcccagattcgggcgcatgttgtaaaagtgaaagtaaaataaaaaggcaactcaccaaggccatggcgaccgagcgtgcgttcgttcttttttgttatctgtgtctagtacgcgactcggaccgatg

SEQ ID NO: 9676 - DNA, 203 bp, Homo sapiens
ggcgcgccagtcctctcaattacaggaggagcccgtgaatcccaggtgtcattcgcgcgtcatccccgcgcacccccagtcccattaacatagcgggcacaatggtgcaggcaccgtctgtatacgtctgcggctttgtggagcgcccggacgccccacccaaggacgcctgccttcacctggatccccgactcggaccgatg

SEQ ID NO: 9677 - DNA, 203 bp, Homo sapiens
ggcgcgccagtccttgtgtgggcagggtgacaaagacataatggattccaacactgtgtcaagctttcaggtagactgctttctttggcatgtccgcaaacgatttgcagaccaagaactgggtgatgccccattccttgaccggcttcgccgagatcagaagtccctaagaggaagaggcagcactccgactcggaccgatg

SEQ ID NO: 9678 - DNA, 203 bp, Homo sapiens
ggcgcgccagtcctagttggtacagggttaataatcactcaccgagtgacatcaaaatcatggcgtcccaaggcaccaaacggtcttatgaacagatggaaactgatggggatcgccagaatgcaactgagattagggcatccgtcgggaagatgattgatggaattgggagattctacatccaaatgcgactcggaccgatg

SEQ ID NO: 9679 - DNA, 203 bp, Homo sapiens
ggcgcgccagtcctgtgtcgtccaggtactgattcgaaatggaagattttgtgcgacaatgcttcaacccgatgattgtcgaacttgcagaaaaagcaatgaaagagtatggagaggatctgaaaattgaaacaaacaaatttgcagcaatatgcacccacttggaggtatgtttcatgtattcagatcgactcggaccgatg

SEQ ID NO: 9680 - DNA, 203 bp, Homo sapiens
ggcgcgccagtcctagcacttgcagtaacgagctcgtgccgcgacagagggccttcagctaggacaacaacagcgagtgggaaactgataacagattggtgctgtaggtcttgcaccaccccaccactgagatttgttacaaaaagtggatgctggtatgggatggaaattcggccaactgctcacggcgactcggaccgatg

SEQ ID NO: 9681 - DNA, 203 bp, Homo sapiens
ggcgcgccagtcctgcgcaacgcagtaacgagctcgtgccgcgacagagggccttcagctaggacaacaacagcgagtgggaaactgataacagattggtgttgtaggtcttgcaccaccccaccactgagatttgttacaaaaagtggatgctggtatgggatggaaattcggccaactgctcacggcgactcggaccgatg

SEQ ID NO: 9682 - DNA, 203 bp, Homo sapiens
ggcgcgccagtcctaaggcatgcagtgccagttccagacactgcccatacctgcgggcgagcatcgggtcatcgggcatatcggccttgaccgcgttgaacatgctgtatgcctcgcagcgcggccgtctgaccgagaacctaagaaacgccctgcagcaggatagcaccacgcaaggctgcctgggtcgactcggaccgatg

SEQ ID NO: 9683 - DNA, 203 bp, Homo sapiens
ggcgcgccagtcctctaaggtacatcgatgctggatttctgagaaaccgcgtggagactctgaggcaggacaggggtgtggccaatatcccagccgagtcgtatttaaaggccagcgatgccccggacctacaaaagccggacaaggcacttcagagcccaccaccggcctccacagacccagacacccgactcggaccgatg

SEQ ID NO: 9684 - DNA, 203 bp, Homo sapiens
ggcgcgccagtcctaacactaccatcgcggattacgaaacgccgcggagctgaggcagttccgctggctagtgtgtacgcggcgagcttctcccggcgccgcccgctcggctcccatagcgcccgcgacaggggtccggacgccgcccgaacatggactccgccggccaaggtgtggctgcccggactcgactcggaccgatg

SEQ ID NO: 9685 - DNA, 203 bp, Homo sapiens
ggcgcgccagtcctccatacggcatgaaaatctcctggaagagttggggtcagtcaatgatctggagtgtcccggaggccccccgacggtttctggtgggcacagagggaagcagtgagtgtccactggcaaagagaagaacaggtgtcttcacagtggctgaatttggaatgggcttgagaacaaaacgactcggaccgatg

SEQ ID NO: 9686 - DNA, 203 bp, Homo sapiens
ggcgcgccagtcctcgtgcagtcattggcgggagctattccagtgaagtactctggaagcaaattggaaatgacctcaggtcatcttaaatgtagggttaaaatgcagggtttgaagctgaaaggaatgacctacccgatgtgtagcaatacattttccctagtgaagaatcctaccgacactgggcacgactcggaccgatg

SEQ ID NO: 9687 - DNA, 203 bp, Homo sapiens
ggcgcgccagtccttgcgttagcattggtgcactgcgcaggcgcatgcacctacggatcaacgtggaccgcattgacggcaaacccttcgatcctgtggaggccctcaaaccccttaaccaaccttccaaatatctaacctcccaaactgaactttctctcttcagatcttttaaacttactgttgcccgactcggaccgatg

SEQ ID NO: 9688 - DNA, 203 bp, Homo sapiens
ggcgcgccagtcctcgcaaagcccaaagaaggaggacttatgtacgcagacgacacggctggatgggacactagaataaccaaggctgatttggaaaacgaagccatcattttggaaaagatggaaccaatgcacagagctgtcgcagaaccactcattaaatttgcctacatgaacaaggtggtgaacgactcggaccgatg

SEQ ID NO: 9689 - DNA, 203 bp, Homo sapiens
ggcgcgccagtcctttatttatccacagcccttcttgccctccccggcaacattgccggcggtgctccttctgcgacggtcaacgccaacaacacttctatctcctctcaagctcttttaccctccgtcaacccttacccttctactcctgctgtctcactccccaaccccgacgcccccactcaagtcgactcggaccgatg

SEQ ID NO: 9690 - DNA, 203 bp, Homo sapiens
ggcgcgccagtcctcattgactccaccaaactgccagccccctccatcgaagaggtagtggtaagaaagcgccagttccgggcaagaactggttcgcttaccttgcctccccctccgagatccgtcccaggagtgtcatgtcctgaaagcctgcaacgaagtgacccgttagaaggtccttcaaacctcgactcggaccgatg

SEQ ID NO: 9691 - DNA, 203 bp, Homo sapiens
ggcgcgccagtcctctaatgatccaccgcggtaaaggtcgctgggaagaccccgtggatccactactctcgactcaagaaagctcctgacaaccaagaagaatggactgtctcaccaacctccgatccactgagggtaaagttgaccaggcgggcaaaaccctaattcttcttgtggtttggtgggggcgactcggaccgatg

SEQ ID NO: 9692 - DNA, 203 bp, Homo sapiens
ggcgcgccagtcctagcgacctccactgcatacacgcagaatgggacactggtctgaactccaagttcacgttttcaatcccgtacatctcggccgctgactacgcgtacaccgcgtcccacaaggctgaaacaacaagtgtacaggggtgggtctgtgtgtaccaaatcactcacggcaaggcagaccgactcggaccgatg

SEQ ID NO: 9693 - DNA, 203 bp, Homo sapiens
ggcgcgccagtccttgaggcctccactgctctccaggaagataaggcttttaaagcagcctagcactagaaggctctgtgtgctccgggatggagcaggtgtgcagagggtgagaacccagctctgggaccaagtcacttgcttccttacttagcaagactatcgacttgagcaaacttggacctgggcgactcggaccgatg

SEQ ID NO: 9694 - DNA, 203 bp, Homo sapiens
ggcgcgccagtcctgccgcgggccatatttccggtatatgaccttcgtaagctgctcggtgcgcttgtcatttcggaaggtagtgtcaagttcgacatataatgtctttgaaggactatctgagacagtccatttctaaagatttggaggtgagacatcgagattctttaaagattagattaggggagcgactcggaccgatg

SEQ ID NO: 9695 - DNA, 203 bp, Homo sapiens
ggcgcgccagtcctagatcgggccattcggccaaatcccccccgtacaacatccgcgctagcgatacgctcgacgtgtactgttcgcactcgtcgtccccaatgggacgcccggcccccagaggatctcccgactccgcgccccccacgaaaggcatgaccggggcgcggacggcgtggtgggtctggcgactcggaccgatg

SEQ ID NO: 9696 - DNA, 203 bp, Homo sapiens
ggcgcgccagtcctagttagcgcccaaaaactgaccaccgaccgcattccatttctcgatatcttcgacgataggtacaacctagtcagacacgtcgaacgacaattaaactggtacgccgcatatgccgaagcagcgcagcaagatcttattgctcctcttacgttttaacggtcgcgttctaaccccgactcggaccgatg

SEQ ID NO: 9697 - DNA, 203 bp, Homo sapiens
ggcgcgccagtcctcgcattaccccaaatgaagtgggagctagaatattgacatcagagtcgcaattgacaataacaaaagagaagaaagaagagctccaggattgtaaaattgctcctttaatggtggcatacatgttggaaagagaactggtccgcaaaaccagatttctaccggtagcaggcggacgactcggaccgatg

SEQ ID NO: 9698 - DNA, 203 bp, Homo sapiens
ggcgcgccagtccttcgccaatcccaaggatcaccctcaaggtccggcccacggagtgcggatttctatcgaaggcaaaatagactctcgcctgcaacgaattttctcccagcggcccgtgctgatcgagcgagaccagggaaacaccacggtttccatctactgcatttgtaatcaccccggattgccgactcggaccgatg

SEQ ID NO: 9699 - DNA, 203 bp, Homo sapiens
ggcgcgccagtcctacgcgcctccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgccgctgtcactctccatagcggacgcccgactcggaccgatg

SEQ ID NO: 9700 - DNA, 203 bp, Homo sapiens
ggcgcgccagtcctgaacgagcccccgtctacgggaaggtttacaacccccctcggactgctctgccggggcggttcacaaactacctggatgttgccgaggcttgtcccaccttcctgatgttcgagaacgtaccttacgtctcaacacgaactgacgggcaaaggctactggccaagttcgacgtgcgactcggaccgatg

SEQ ID NO: 9701 - DNA, 203 bp, Homo sapiens
ggcgcgccagtcctagagtttacccctgctcttgttcccggggggcttctggctaagcagtttggtgataatatgagagagtttttacaactagaacttaaagaagaacttagagccaagggcatgtcaattgatgttgccattctcaattcgctacaggtgacacaggagcaagatattttgtcattcgactcggaccgatg

SEQ ID NO: 9702 - DNA, 203 bp, Homo sapiens
ggcgcgccagtcctaatacccgcccgcctttcataagttttaccgtctgtcccgacgttaaagggaggtaaccacaagcatactgccgccttccccggcgttaacgggatgcaaccgtaagacacaccttcatccggaagtaaaacggctgcgtcacatagttttgcccgttttcacgagaaacgggacgactcggaccgatg

SEQ ID NO: 9703 - DNA, 203 bp, Homo sapiens
ggcgcgccagtcctgcccgtgaccctgtagccggagggttattttccaagggttgagtcgcgggacccccggttcgagtctgggaccggccggactgcggcgaacgggggtttgcctccccgtcatgcaagaccccgcttgcaaattcctccggaaacagggacgagccccttttttgcttttcccagcgactcggaccgatg

SEQ ID NO: 9704 - DNA, 203 bp, Homo sapiens
ggcgcgccagtccttcctggctccgagcagccggtcctccagtggctccgctccccgttctctgtgggctcaaaatgacagaggctcacaggacacctgcatgcccaaggcactccaccgtatgtgatcaacctggatccagcagtacatgaagttccctttcctgccaatattggtgatgaaatttacgactcggaccgatg

SEQ ID NO: 9705 - DNA, 203 bp, Homo sapiens
ggcgcgccagtccttgccgaccccgatgatggcgcaagtgggagtaaagagaagaagccagataggatcaacaaaggcaaattaaaaatagccccaaaagagcatgagaaggacagcagaactaggccacctgacgctacgatcgtggtggaaggagtaaaataccaggtcaaaaagaaaggtaaagtcgactcggaccgatg

SEQ ID NO: 9706 - DNA, 203 bp, Homo sapiens
ggcgcgccagtcctaaacatacccgcacctgcccctacgtttacaaggccctgggcatagtctcgccgcgcgtcctatcgagccgcactttttgagcaagcatgtccatccttatatcgcccagcaataacacaggctggggcctgcgcttcccaagcaagatgtttggcggggccaagaagcgctcccgactcggaccgatg

SEQ ID NO: 9707 - DNA, 203 bp, Homo sapiens
ggcgcgccagtcctgcgtgtaaccgcctcggaaaaagcgtacggtggtcctcaccgaatcaaccctatctactgccttggccgagcttgccaccaaaagttttggcagctcctcaacttccggcattacgggcgacaatacgacaacatcctctgagcccgccccttctggctgcccccccgactccgcgactcggaccgatg

SEQ ID NO: 9708 - DNA, 203 bp, Homo sapiens
ggcgcgccagtcctgacaaaccccgcgccgcgcgtcttgtctgctgcagcatcgttctgtgttgtctctgtttgactgtttttctgtatttgtctgaaaacatgggccaggctgttaccacccccttaagtttgactttagaccactggaaggatgtcgaacggacagcccacaacctgtcggtagagcgactcggaccgatg

SEQ ID NO: 9709 - DNA, 203 bp, Homo sapiens
ggcgcgccagtcctctcgttgtccgcgccgcgcgtcttgtctgtctcagtgttgttctgtcatttgtctgttcattgttgttttggaccgtttctaaaaatatgggacagaccgtaaccactcccttgagtctgacccttgaacactggggagacgtccagcgcattgcgtccaaccagtccgtggaccgactcggaccgatg

SEQ ID NO: 9710 - DNA, 203 bp, Homo sapiens
ggcgcgccagtcctctgtgggcccgctccgcctagcacggctcgtctcctcatcgtactagacacagataacaaaaaagaacgaacgcacgctcggtcgccatggccttggtgagttgcctttttattttactttcacttttacaacatgcgcccgaatctgggacgcagatgagcgaacgggttgcccgactcggaccgatg

SEQ ID NO: 9711 - DNA, 203 bp, Homo sapiens
ggcgcgccagtcctgcagattcccggccaggccgggagtggcgtgctgggcgtgcgcggctgcggtacggcgtgttggtcccagcggttcagctgaggtagggacgtgctgtaggccggaatgttaccggctgttggatctgtggatgaggaagaggatcctgcggaggaggattgtcctgaattggtcgactcggaccgatg

SEQ ID NO: 9712 - DNA, 203 bp, Homo sapiens
ggcgcgccagtcctggctttcaccggctctcctggccagtacccggacgagttcataccaaacttcgacgcaatcagcgagtcagtggatggctatgattgatgtctaatggtggtgcggctgagctagctcgactgcgacacctagaccactgccgccgctttcgctgcttcgcccgggaactcacccgactcggaccgatg

SEQ ID NO: 9713 - DNA, 203 bp, Homo sapiens
ggcgcgccagtcctacagatagccggtccctccccggggctggagcctttggtaacgtggttgctggtcaggaaattcccatctacgcgatggagtccttccgtccaccagttgactacctaccagccaaagtcaacgattggcttgagttcgcccaccgccctggtctgttcgagtcttacacttggcgactcggaccgatg

SEQ ID NO: 9714 - DNA, 203 bp, Homo sapiens
ggcgcgccagtcctgctctataccgttgacgcggctaatgaccaggacatctatcaaccaccatgtggagctgggtcccttactcggtgctcttgcggggagaccaaggggtatctggtaacacgactggggtcattggttgaggtcaacaaatccgatgacccttattggtgtgtgtgcggggccctcgactcggaccgatg

SEQ ID NO: 9715 - DNA, 203 bp, Homo sapiens
ggcgcgccagtcctgtttccaacctaggaaaccctcagctcagagaacaaccctgcattccccacacaacacccacaatcagccactgcgggcgaggagggcacgaggccaggttcccaagagctcagggaacgggcctggctctggcccctgacgcaggaacatggagctgatccaggacacctccccgactcggaccgatg

SEQ ID NO: 9716 - DNA, 203 bp, Homo sapiens
ggcgcgccagtcctttgctttacctccgagtgactgagtcgcccgggtacccgtgtatccaataaaccctcttgcagttgcatccgacttgtggtctcgctgttccttgggagggtctcctctgagtgattgactacccgtcagcgggggtctttcatttgggggctcgtccgggatcgggagacccccgactcggaccgatg

SEQ ID NO: 9717 - DNA, 203 bp, Homo sapiens
ggcgcgccagtcctgattagatcctcggagggtggattcagcggccatcctatttgataatctcgcggtggagatatttaacgatgtaatatatcgacaaaatggagttgccgcgaaaatacgacagggtaacgggcaggatattgacacataagaataaccagatgtgtacaaccgaatgttctcagcgactcggaccgatg

SEQ ID NO: 9718 - DNA, 203 bp, Homo sapiens
ggcgcgccagtccttgtgaacacctctctacaaccctctctcctcagcgcttcttctttcttggtttggtgcttctgagatgtgggcttgcacacgctgttgctatagtacgtgttgatcctgactgctgtcatggcgtgccctctggagaaggccctggatgtgatggtgtccaccttccacaagtacgactcggaccgatg

SEQ ID NO: 9719 - DNA, 203 bp, Homo sapiens
ggcgcgccagtcctactaatcgcctgtccctacgtttacaaggccctgggcatagtcgcgccgcgcgttctttcaagccgcactttctaaaaaaaaaaaaaatgtccattctcatctcgcccagtaataataccggttggggactgtatgcgcccaccaagatgtatggaggcgcccgcaagcgctctcgactcggaccgatg

SEQ ID NO: 9720 - DNA, 203 bp, Homo sapiens
ggcgcgccagtccttcttacttcctgtgcttgtgtttaaaaattgtcgcagcttccccaaaccaagtggtcttggttttctctttttattatattgtcaatatggcttgcaaacacggatacccagacgtgtgccctatttgcacagccgttgacgctactcccgactttgaatatttgctcatggcacgactcggaccgatg

SEQ ID NO: 9721 - DNA, 203 bp, Homo sapiens
ggcgcgccagtcctgcgttacccgaagatcagcttcggcgcacgctggaagacgcggaggctctcttcagtaaatactgcgcgctgactcttaaggactagtttcgcgccctttctcaaatttaagcgcgaaaactacgtcatctccagcggccacacccggcgccagcacctgtcgtcagcgccattcgactcggaccgatg

SEQ ID NO: 9722 - DNA, 203 bp, Homo sapiens
ggcgcgccagtcctaactatcgcgaccaactcttccttaaacacaacaagggagacatggacgaaccctggcccggactcgaggcggccgccgacctttacttctccaaatttccaaccatgatccatactctgacgatggaagaggcaatcaatggaactcccaatctcgagggcattgacatgaatcgactcggaccgatg

SEQ ID NO: 9723 - DNA, 203 bp, Homo sapiens
ggcgcgccagtcctgcctggtccgacggatgacagaatagggctcccccaagacaatttccaccaagtggagacgaaatgcccctgtggttacaagatgaaggcagttaagaattgtgctggagaactgagactcttggaggaggagggttcatttctctgcagaaataaattcgggagaggttcacgcgactcggaccgatg

SEQ ID NO: 9724 - DNA, 203 bp, Homo sapiens
ggcgcgccagtcctagtctacacgatgattgccactgatcctggcggcctgggtattctcggtatccatgtcgccggggtggctggctacaacggcttctccgcgcgccttacccctgaacgtgtccaagctttcctctctaacctggccacacctcagtctgttcttcatttccacccacccatgggcgactcggaccgatg

SEQ ID NO: 9725 - DNA, 203 bp, Homo sapiens
ggcgcgccagtcctatcaagagcgcacgtctctcgtcgcagtcggctccatccctcccctgcctttggcgccttccccatcaccaaagaaccagcagccctttctaggaaggaccctcgcctccccgagggcaccgacctggatgctatcaccctcgccaagcacgacaagggcgacatcgcgacgcccgactcggaccgatg

SEQ ID NO: 9726 - DNA, 203 bp, Homo sapiens
ggcgcgccagtcctaaggagcgcgcccccgccttccagctgctgccgggggactcttcgcacaccgcgacgctcgccaggaccccggggggcgaagttgccatggctgggcgggaggggcgcacgcgccagcgaactttacgggacacaatccccgactgcgcgctgcggtcccagaccctggagagtcgactcggaccgatg

SEQ ID NO: 9727 - DNA, 203 bp, Homo sapiens
ggcgcgccagtcctcacgtagccgcccgcagcacgcggatcttacggcctgcgtcatcacccagggcacgatcctcgcccaattgcacgccatccaaaaatcccgccaagagtttcttctgaaaaagggtaaaggggtctacctggacccccagacgggcgaagtgcttaacccgggtctcccccagccgactcggaccgatg

SEQ ID NO: 9728 - DNA, 203 bp, Homo sapiens
ggcgcgccagtcctgtcattctcgccgacatggagctgttcctcgcgggccgccgggtgctggtcaccggggcaggcaaagggcgcggcacggtccaggcgctgcacgcgacgggcgcgcgggtggtggctgtgagccggactcaggcggatcttgacagccttgtccgcgagtgcccggggatagaacgactcggaccgatg

SEQ ID NO: 9729 - DNA, 203 bp, Homo sapiens
ggcgcgccagtcctatccttcccggacggcgtttccacggacgcccaggagacagccggttgctgagccgggagcgctgactggcccggctgggcaggtcttgactcgtctgctgaacaaatcctctgacctcaggccggctgtgaacgtagttcctgagagatagcaaacatgcccaacagtgagcccgactcggaccgatg

SEQ ID NO: 9730 - DNA, 203 bp, Homo sapiens
ggcgcgccagtcctgattcgcccggccccgccgggcggccgcgggtgggtagagaacatggacttcccgtgcctctggctagggctgttgctgcctttggtagctgcgctggatttcaactaccaccgccaggaagggatggaagcgtttttgaagactgttgcccaaaactacagttctgtcactcacgactcggaccgatg

SEQ ID NO: 9731 - DNA, 203 bp, Homo sapiens
ggcgcgccagtcctcgatagatcggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacacgactcggaccgatg

SEQ ID NO: 9732 - DNA, 203 bp, Homo sapiens
ggcgcgccagtcctatccactacggctcctgaaaaagactgtatgcccaaggccagacggcagcgaactcgtcgcacacgcagcaacagaccaccaacaccatgggtaagataattgctttccttttattccatcttacatgtatcacaatcactaaacagagccggtgcacgcttacggtaggtgtccgactcggaccgatg

SEQ ID NO: 9733 - DNA, 203 bp, Homo sapiens
ggcgcgccagtcctttcatcgccggctggacttgtccggttggttcacggctggctacagcgggggagacatttatcacagcgtgtctcatgcccggccccgctggttctggttttgcctactcctgctcgctgcaggggtaggcatctacctcctccccaaccgatgaaggttggggtaaacactcccgactcggaccgatg

SEQ ID NO: 9734 - DNA, 203 bp, Homo sapiens
ggcgcgccagtcctacgctttccgggatgccatctggctgttccgcaacaagcatcatcaacacaattttgaataacatctacgttctctacgccctgcgtagacactatgagggggttgagctggacacctacaccatgatctcctatggagacgacatcgtggtggcaagcgattatgatctggaccgactcggaccgatg

SEQ ID NO: 9735 - DNA, 203 bp, Homo sapiens
ggcgcgccagtccttaagggttcgtacagtgatctggtcaagtacgtcattctagtggcagctgcatttgctgagagcaatacaggtggtgacattgtgcacttggccatggtggctgcttttaacatccagccaggtttactgattggattcctactgaggaggaagtggagcaatcaggaaagcagcgactcggaccgatg

SEQ ID NO: 9736 - DNA, 203 bp, Homo sapiens
ggcgcgccagtcctttaccacacgtctcgctgaggtcatcctttacggcaggcgtccgcgtcgctagctagtcgttctgaagcggcggccagagaagagtcaagggcacgagcatcggccatgcctttcttggacatccagaaaaggttcggccttaacatagatcgatggttgacaatccagagtggcgactcggaccgatg

SEQ ID NO: 9737 - DNA, 203 bp, Homo sapiens
ggcgcgccagtcctcttactagcgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaagccgactcggaccgatg

SEQ ID NO: 9738 - DNA, 203 bp, Homo sapiens
ggcgcgccagtcctcctggacactaattcttctgtataagggcagggggtgggtatttaaggatctatatgcccttctctacctgcacctccaaatgagagatgactcggcgtagggtgctaagcgtggtcgtgctgctagccgccctggcgtgccgcctcggtgcgcagaccccagagcagcccgcacgactcggaccgatg

SEQ ID NO: 9739 - DNA, 203 bp, Homo sapiens
ggcgcgccagtcctagattcgtctacaaccgcttccagctacgttactggccccccgtaccctaagatacggggaaaggattccactcagtcagcccccgccaaacggcctacaaaaaagaagttgggaaagagtgagttttcgtgcagcatgagctacacttggaccgacgtgattagcttcaaaaccgactcggaccgatg

SEQ ID NO: 9740 - DNA, 203 bp, Homo sapiens
ggcgcgccagtcctctatacaactaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggcgactcggaccgatg

SEQ ID NO: 9741 - DNA, 203 bp, Homo sapiens
ggcgcgccagtcctgatccagactccaaattctttgctgaaaacccccctcctgtatctcttgctggaaaaatcaacctttccgatttcactgacctcactctctccactcctggacagatggtgcgccagggcaactccaccactaacatctacggaagtaataacaatgttactactgacgtgggtcgactcggaccgatg

SEQ ID NO: 9742 - DNA, 203 bp, Homo sapiens
ggcgcgccagtcctaatctttactcccacgtggcctcctttgtgctggcctggacacgcgcttttgtatcagagtgggctgggttcctctacgaagaggaccgaggcactccgctcgaggacaggcccataaagtcggtctacggggacacggacagcctctttgtcacccagcggggacacgaactccgactcggaccgatg

SEQ ID NO: 9743 - DNA, 203 bp, Homo sapiens
ggcgcgccagtcctccagagaactcccattgactcagctttctatggcctcagattccccatccccttcccaacgccccagcactggaagacacgtgctgtccctggtgccggctcctacggctcggtcgtggctggccaggaaatccccctggttggctatgcccccgctgctcccccccgcgattacgactcggaccgatg

SEQ ID NO: 9744 - DNA, 203 bp, Homo sapiens
ggcgcgccagtccttttacgacctcgcacgtggcctcctttgtcttggcgtggacgcgcgcctttgtctcagagtggtccgagtttctctacgaggaggaccgcgggacgcccctgcaggacaggccaatcaagtccgtctacggggacaccgacagcctgtttgtcaccgagcgcggacacagactccgactcggaccgatg

SEQ ID NO: 9745 - DNA, 203 bp, Homo sapiens
ggcgcgccagtcctgtcgtcaactcgtcctctgagccgcgctctggaggcattggaactctgcaatttattgaggagtttgtgccatcggtctactttaaccccttctcgggacctcccggccactatccggatcaatttattcctaactttgacgcggtaaaggactcggcggacggctacgactgacgactcggaccgatg

SEQ ID NO: 9746 - DNA, 203 bp, Homo sapiens
ggcgcgccagtcctcagacccactctaggggaaggactagaggttagaggagaccccttgcgagtgaacaccacaagaaacagcatattgacacctgggatagactaggagaccctctgtcctaacaacaccagccacttggcacagatcgccgaaagtgtggctggtggtggtagaacacagagtctcgactcggaccgatg

SEQ ID NO: 9747 - DNA, 203 bp, Homo sapiens
ggcgcgccagtcctctactgcgctctcgttgcccgctactacccaggccccgccgcctgtctggccctgttgctcattatactatacgcctggagcttcagccattttatggactctctcaagaaccaggtgacagtcaccgccagatacttcagaagggtgcctagccagtccacctgagcgcgaggcgactcggaccgatg

SEQ ID NO: 9748 - DNA, 203 bp, Homo sapiens
ggcgcgccagtcctacgcgggactgcgggcttgcccctaactttctttgttgcagcagctgctgcccaaccagattatgactggtgggtgcgactgctagtggcagggttagttttgtgggccggccgtaaccgtggtcaccgcatagctctgcttgtaggtccttggcctctggtagcgcttttaaccgactcggaccgatg

SEQ ID NO: 9749 - DNA, 203 bp, Homo sapiens
ggcgcgccagtcctgaatgttactggcagaaccttgggggaggcatggaaggcccagcttaatcaactgacccggcaagagtttatggaataccggaaagacgggatcattgaagtagatagagctgctgcaaagagagcccgccgtgaagggaatgtgacaggagggcacccagtttcacgaggcaccgactcggaccgatg

SEQ ID NO: 9750 - DNA, 203 bp, Homo sapiens
ggcgcgccagtcctcccaggccctggcagaactttgggggaggtatggaaggcccagcttaatcaactgacccggcaagagtttatggaataccggaaagacgggatcattgaagtagatagagctgctgcaaagagagcccgccgtgaagggaatgtgacaggagggcacccagtttcacgaggcaccgactcggaccgatg

SEQ ID NO: 9751 - DNA, 203 bp, Homo sapiens
ggcgcgccagtcctggtgatatctgggcgatcgcttcctggtcctcgcctcctccgctgtctccctggagttcttgcaagtcggccaggatgtctcaggtacagcgcgtgcacagccaggctgcgaaggctgagtttgagaaagctgcagaggaggttaggcaccttaagaccaagccatcggatgagcgactcggaccgatg

SEQ ID NO: 9752 - DNA, 203 bp, Homo sapiens
ggcgcgccagtccttggtgtccctggtgacctcgtcttcgttaagaagcacgacttccagcagttggggccacggtgggacggaccctacactgtagtcctcagtacccccaccgcggtaaaggtcgctgggaagaccccgtggatccactactctcgactcaagaaagctcctgacaaccaagaagacgactcggaccgatg

SEQ ID NO: 9753 - DNA, 203 bp, Homo sapiens
ggcgcgccagtcctactccagcctggttggggctgcttcccagctagtagcccttggaactgacgggcactgcgtccacctggccaccacatcggacgggcaggcatttttggtgctgcctgggggctttgttattaaaggccaattggcactcacccccgaggagaggggatatattctggcacgtccgactcggaccgatg

SEQ ID NO: 9754 - DNA, 203 bp, Homo sapiens
ggcgcgccagtccttaaggaacctgtcacgattggggaacaagcccagagaagggggagagttgggagagtaaagcctggaagatactacaggagtcaagaaactcccgttggttctaaagattaccattatgatttactgcaagcacagaggtacggtattgaagatgggataaacatcaccaaatccgactcggaccgatg

SEQ ID NO: 9755 - DNA, 203 bp, Homo sapiens
ggcgcgccagtcctgcgctgggctgttgccaagggttcttcaggtgccccgattctgtgctcctccgggcatgttattgggatgttcaccgctgctagaaattctggcggttcagtcagtcagattagggttaggccgttggtgtgtgctggataccatccccagtacacagcacatgccactcttgacgactcggaccgatg

SEQ ID NO: 9756 - DNA, 203 bp, Homo sapiens
ggcgcgccagtcctatgttccacttagagagttgttcttgatcaattctactgcggatctggataaagatacatcatctctctttcatatgtgatatagtaatggatcttgatcaaatatctgaaacactgagttctgtggccgaagaagagcctttaaccatgtttttacttgataaactgtatgcacgactcggaccgatg

SEQ ID NO: 9757 - DNA, 203 bp, Homo sapiens
ggcgcgccagtcctcgtttgttcttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtcgactcggaccgatg

SEQ ID NO: 9758 - DNA, 203 bp, Homo sapiens
ggcgcgccagtccttggcattccttggatgctgactaatcagaggaacgtcagcattttccggcccaggctaagagaagtagataagttagaatctaaattatttatcatccccttgacgaattcgcgttggaaaagcacctctcacttgccgctcttcacacccatcattctaattcggcccctgtgcgactcggaccgatg

SEQ ID NO: 9759 - DNA, 203 bp, Homo sapiens
ggcgcgccagtcctactggtttgaacacgctaagcggcaggatagaaggcgaagaagagtgtgttctgccagggccgcgttttgctatacaaaatacgagaatgtcaggaagcaactccattatgacaaggttgcgcgcacgctcgacatcatgcgccagacatcacccttacaccagagcccagttacgactcggaccgatg

SEQ ID NO: 9760 - DNA, 203 bp, Homo sapiens
ggcgcgccagtccttccggtcagaccaaagatgcagagagaggtaaattaaaaagaagggctattgcaacacccgggatgcaaattagagggttcgtgtacttcgttgaaactttagctagaagcatttgcgaaaagcttgaacagtctggacttccggttgggggtaatgaaaagaaggccaaactgcgactcggaccgatg

SEQ ID NO: 9761 - DNA, 203 bp, Homo sapiens
ggcgcgccagtcctcctagtgagacccagaacttgttcaaattactggagaggggctgttccagtcaacgctaggctgtgtgggtcggctagaccggacccaactgattggactagtcttgtcgtcaattatggcgttagggactactgtaaatatgagaaaatgggagatcacatttttgttacagccgactcggaccgatg

SEQ ID NO: 9762 - DNA, 203 bp, Homo sapiens
ggcgcgccagtccttaaacgcggacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctgcgactcggaccgatg

SEQ ID NO: 9763 - DNA, 203 bp, Homo sapiens
ggcgcgccagtcctagctacaagaggacttggatgaggatgaggaagaggaggaggatgcacccgctgcggggtactgacgcctccgtgatgtgtttttagatgtcccagcagcaagccccggaccccgccataagggcggcgctgcaaagccagccgtccggtctagcatcggacgactgggaggcccgactcggaccgatg

SEQ ID NO: 9764 - DNA, 203 bp, Homo sapiens
ggcgcgccagtcctaggtccatgaggagggaagagagaaattggcagctctcttcaggaaatttcctcctcctataccaaattccccctcatctgagggggggcggttcttgttctccctgagccaccatcacccagacacaggcagtctaacaaggaggtgatgtgtgactcggaacaacacccgctcgactcggaccgatg

SEQ ID NO: 9765 - DNA, 203 bp, Homo sapiens
ggcgcgccagtcctgcatcgatgaggatggttcggaggatggggaattttcagacctggatctgtctgacagcgaccatgaaggggatgagggtgggggggctgttggagggggcaggagtctgcactccctgtattcactgagcgtcatctaataaagatgtctattgatctcttttagtgtgaatccgactcggaccgatg

SEQ ID NO: 9766 - DNA, 203 bp, Homo sapiens
ggcgcgccagtccttgggaggtgagggagtatcctaggaagagattgtctgcagggcctagggctccgcttgacaaatttatagggagggccactgttcttactgttgcgctacatctggctattccgctcaaatggaagccagaccacacgcctgtgtggattgaccagtggccccttcccgagggtcgactcggaccgatg

SEQ ID NO: 9767 - DNA, 203 bp, Homo sapiens
ggcgcgccagtccttccactccgaggggcgtgtctgcatagcgttgcgtgccctcatctacaccttcaagacgtatcaggtatttgtaccaaagcccaccgcgctcgccacatttgtccgtgaggcgggcgcgctgcttagacgccactcgatctcgctcctgtccctggagcacaccctgtgtacctcgactcggaccgatg

SEQ ID NO: 9768 - DNA, 203 bp, Homo sapiens
ggcgcgccagtccttccaaacggatacaagacctggctacagtaccttatcagcacagtgacaggtatctttttaataagggtactgaagggaataggtgagttggatttacacactccgaccttgccatctcatagacccctctttttcattctcgtgtaccttatttccactgcagtggtaacaagcgactcggaccgatg

SEQ ID NO: 9769 - DNA, 203 bp, Homo sapiens
ggcgcgccagtcctttccctgggatccacttaccaatctgtggtatgggcctgaccctgtattaatatggggacgagggcatgtttgtgtttttccacaggatgccgaagcaccgcgctggattccggaaaggctggtacgcgcggcagaggaactccctgacatatcaaatgcaacgcatgacattgcgactcggaccgatg

SEQ ID NO: 9770 - DNA, 203 bp, Homo sapiens
ggcgcgccagtcctggccacgggatgttgttgtatgtccgagagacacgtgaggttctgctacgtcattaccaggcacgcgcaggaaacatggcggcggcgggtgttgtgagcgggaagattatatatgaacaagaaggagtatatattcactcatcttgtggaaagaccaatgaccaagacggcttgcgactcggaccgatg

SEQ ID NO: 9771 - DNA, 203 bp, Homo sapiens
ggcgcgccagtcctccggtgtagattgtctgacctttgaaaaaatttttgtgtccgtgtagcatttcaataaaagtcattatctgctccgagggataaatcatgtctatctcttcgttgttcggaggtagatacgataataagtttttgcttaacatgtcttcggctcccaaaatagagttgattgtacgactcggaccgatg

SEQ ID NO: 9772 - DNA, 203 bp, Homo sapiens
ggcgcgccagtcctgcgacagcgcaataaggtctctgttgaaattttctcccagcagcacctcacttccctcttcccaactctggtattctaaaccccgttcagcggcatactttctccatactttaaaggggatgtcaaattttagctcctctcctgtacccacaatcttcatgtctttcttcccagcgactcggaccgatg

SEQ ID NO: 9773 - DNA, 203 bp, Homo sapiens
ggcgcgccagtcctcacggatggcaattggctagtcaatgcagacagactagtaagtagcaagaccgggaataggtacatacccggagagggtcacaccctgcaaggaagacattatgaagaactggtgttggcaagaaaacagatcaacaactttcaagggacagacaggtacaacctaggcccaatcgactcggaccgatg

SEQ ID NO: 9774 - DNA, 203 bp, Homo sapiens
ggcgcgccagtccttgcaccgggcagacgagcggccgttgccgccgccgcggccatctctagcatgaccagacccaggcgcggaaacgtgtactgggtgcgcgactccatcacgggcgtgcgcgtgcccgtgcgcacccgtcctcctcgtccctgatctaatgcttgtgtcctcccccgcaagcgacgcgactcggaccgatg

SEQ ID NO: 9775 - DNA, 203 bp, Homo sapiens
ggcgcgccagtcctggttagtcgcatgttacagatttcactactcccaccagcttggagacaacatgtggttcttgacaactctgctcctttggggctggctactactgcaggtctccagcagagtcttcatggaaggagaacctctggccttgaggtgtcatgcgtggaaggataagctggtgtacacgactcggaccgatg

SEQ ID NO: 9776 - DNA, 203 bp, Homo sapiens
ggcgcgccagtcctgcgcccaggcatgttacagatttcactgctcccaccagcttggagacaacatgtggttcttgacaactctgctcctttgggttccagttgatgggcaagtggacaccacaaaggcagtgatcactttgcagcctccatgggtcagcgtgttccaagaggaaaccgtaaccttgccgactcggaccgatg

SEQ ID NO: 9777 - DNA, 203 bp, Homo sapiens
ggcgcgccagtcctcgaacactgccccgatccagtgttaatttggggcagaggttcagtctgtgtttactctcaaacctatgatgccgctagatggctaccagaacggttagtaagacaggtgtctaacaataaccaatccagggagtgattctctccctgagatcgctctttcccttgttcacagatcgactcggaccgatg

SEQ ID NO: 9778 - DNA, 203 bp, Homo sapiens
ggcgcgccagtcctcaaagtcggccctgctctcttgcctgactgtgcccgcttcagcctaccaagtgcgcaattcctcggggctttaccatgtcaccaatgattgccctaactcgagtattgtgtacgaggcggccgatgccatcctgcacactccggggtgtgtcccttgcgttcgcgagggtaacgcgactcggaccgatg

SEQ ID NO: 9779 - DNA, 203 bp, Homo sapiens
ggcgcgccagtcctcaccctctgccggcgctccgagtgacgtagggaagcgcgccgcgcacctcatggttccggggacagttagggcggcggatggaggtcagcggtggtgctcgctgcgacatcatggcagctcacctggtaaagcgatgcacgtgcctcctgagagaagctgctcgtcaggcccctcgactcggaccgatg

SEQ ID NO: 9780 - DNA, 203 bp, Homo sapiens
ggcgcgccagtcctccagaaccgcctcagggttgttcccaccctgagggcccacgtggcgtagtactctggtatcaaggtacctttgtacgcctattttatttcccttcccccacagtaacttagaagcttatctcatagttcaacagtagggtcactaaccaagtggctcagcgaacaagcacttctcgactcggaccgatg

SEQ ID NO: 9781 - DNA, 203 bp, Homo sapiens
ggcgcgccagtcctagcctggggcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagacgactcggaccgatg

SEQ ID NO: 9782 - DNA, 203 bp, Homo sapiens
ggcgcgccagtcctggaagtctgcctgtgggttgctcccacccacagggcccaagtggcgtagtacttggtattccggtacctttgtacacctatttacaaaccctaccccttgtaaccttagaagcaattatttaaccgctcactagggggtgtgctatccaagcacatcaagagcaagcacttctgcgactcggaccgatg

SEQ ID NO: 9783 - DNA, 203 bp, Homo sapiens
ggcgcgccagtcctttctcggcgcctgtgggttgtacccacccacagggcccactgggcgctagcactctgattctacggaatccttgtgcgcctgttttatgtcccttcccccaatcagtaacttagaagcattgcacctctttcgaccgttagcaggcgtggcgcaccagccatgtcttggtcaagcgactcggaccgatg

SEQ ID NO: 9784 - DNA, 203 bp, Homo sapiens
ggcgcgccagtcctctccaaccgcctgtgggttgtacccacccgcagggcccactgggcgctagtacactgatatcacggtacctttgtacgcctgttttatctccctacccccatcgtaacttagaagcttaacaatacagatcaatagcctctgcaccaaaccaggtgtggaatgatcaagcatttcgactcggaccgatg

SEQ ID NO: 9785 - DNA, 203 bp, Homo sapiens
ggcgcgccagtcctgtgcgaatgcctgtgggttgttcccacccacaggcccattgggcgctagcactctggtatcacggtacctttgtgcgcctgttttacatcccctccccaaattgtaatttagaagtttcacacaccgatcattagcaagcgtggcacaccagccatgttttgatcaagcacttccgactcggaccgatg

SEQ ID NO: 9786 - DNA, 203 bp, Homo sapiens
ggcgcgccagtcctctatgcctgcctgtgggttgttcccacccacagggcccactgggcgctagtacactggtatgccttacctcggtattacggtaccgatgtatatagtacctttgtacgcctgttttatatccctcccccacatgtaaccttagaagtttacacaaacaaagaccaataggagtccgactcggaccgatg

SEQ ID NO: 9787 - DNA, 203 bp, Homo sapiens
ggcgcgccagtcctttatgtgagcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtcccgactcggaccgatg

SEQ ID NO: 9788 - DNA, 203 bp, Homo sapiens
ggcgcgccagtcctatgtgagagcgcaaactaggattaattcacctgtatccctttccctccacccgcagtaactcagcgctggcgtgtgacgtggtgtaaagttttgcctgaacctgtggttgggcaggtacatgccaacaaccttctaagcacccgcgcttgtgttttgctttatctgctgccatccgactcggaccgatg

SEQ ID NO: 9789 - DNA, 203 bp, Homo sapiens
ggcgcgccagtcctcagtatttgcgcactccggtgtccgcgatcacggacgccatcacgcgttgtcgcgagctcaccaaggtggctgccgacgccaagtctgctcctcattcctccttcctctctcaggccttgcggaactatcaacttgctctcaactctgcccgcatggcccaatctggtcctcgccgactcggaccgatg

SEQ ID NO: 9790 - DNA, 203 bp, Homo sapiens
ggcgcgccagtcctcggagaccgcggaagtggtccgttctcttcctctcccggcccaagcttctgggtatttctattgcgcgaggcattgtgggttgctgggcggcccggtctcggagaagaggggagagtggcgggccgctgaataagcttccaaaatgatggtgggtgatggcaccacctcagtgacgactcggaccgatg

SEQ ID NO: 9791 - DNA, 203 bp, Homo sapiens
ggcgcgccagtcctctgcacacgcggtcgcaatctgattgctccttcccacgcattcgtctccgatgattatgagatcacccacatccgcgttggatcgcgcacgcttgacgtgtcgcgtgttacgcgggtggatgacggtgagttatctctgatctcggtgccggatgggccggagcataagagcctcgactcggaccgatg

SEQ ID NO: 9792 - DNA, 203 bp, Homo sapiens
ggcgcgccagtcctggacaaccgcgtccgcgctcgggggtggtttcgcgctgctcctcttcccgactggccatttccttctcctataggcagaaaaagatcatggagtcagtcgagaagaaggacagcctaaccgccccctctgagttcgccaccaccgcctccaccgatgccgccaacgcgcctacccgactcggaccgatg

SEQ ID NO: 9793 - DNA, 203 bp, Homo sapiens
ggcgcgccagtccttcacgcatgcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaaggctgccccgggagacgctggcctcgactcggaccgatg

SEQ ID NO: 9794 - DNA, 203 bp, Homo sapiens
ggcgcgccagtcctgtggaccagcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaacgactcggaccgatg

SEQ ID NO: 9795 - DNA, 203 bp, Homo sapiens
ggcgcgccagtcctagggctttgcgttgcgttagcactcataacagtggcaatgagagatttgaacatgagtataccaacattactcaactccggagccatggcctggctcttgccgagagccgtgtttgaagggacggttagctcctttgctctgccacttgttagcttgctggctccagggctcagcgactcggaccgatg

SEQ ID NO: 9796 - DNA, 203 bp, Homo sapiens
ggcgcgccagtcctaaagcactgctcgtcgtctccgcatcagcggggaaagactttgagctccggctacctgtggacgctagaaaacaaactacgaccactggtgaatctgctgaccccgtcaccactaccgttgagaactacggaggagagactcaggtccaacgtcgccaccacaccgacgttgcccgactcggaccgatg

SEQ ID NO: 9797 - DNA, 203 bp, Homo sapiens
ggcgcgccagtcctggtgtttcgctctggggttgttcccaccccagaggcccacgtggcggctagtactccggtaccccggtacccttgtacgcctgttttatactccctttcccaagtaactttagaagaaataaactaatgttcaacaggagggggtacaaaccagtaccaccacgaacacacactcgactcggaccgatg

SEQ ID NO: 9798 - DNA, 203 bp, Homo sapiens
ggcgcgccagtccttaagattggctcttgtagcattcaagatcatgagcggtgaggtcccctccacggaggacctggtcaatctgctgcccgccatcctctcgcctggagcccttgtagtcggtgtggtctgcgcagcaatactgcgccggcacgttggcccgggcgagggggcagtgcaatggatgacgactcggaccgatg

SEQ ID NO: 9799 - DNA, 203 bp, Homo sapiens
ggcgcgccagtcctaggaacgggctggaacattgtgacattaaagagtggggttaatgttcatttcaagccgactgaaccatctgacacactgctgtgtgacataggtgaagcttcacccgtcccagaaattgaatctgccagaacaatcagggggctgcaaatggccgaggaatggctagctaggggcgactcggaccgatg

SEQ ID NO: 9800 - DNA, 203 bp, Homo sapiens
ggcgcgccagtcctagtttggcgctggaatctgggaacgacgagaagccaaaagataattttcacaattatgttaatgttaatagccccagcgtacagcttcagctgtctggggatgcagaaccgagactttgtcgagggagtgaatggtgttgagtggatcgatgtcgttctggaaggcggctcatgcgactcggaccgatg

SEQ ID NO: 9801 - DNA, 203 bp, Homo sapiens
ggcgcgccagtcctatcgggtcgcttcaaaactgatgttgtaacggctcggatcgtcaccgaaataaattcgcaaattgtcaaaaagttgttcggctgtgtatgttttaatgtcattgaaaatatttagaggtgcttcgatcttaggtaaaatttcggtcgcctgccaattttccatgtttcggcgttcgactcggaccgatg

SEQ ID NO: 9802 - DNA, 203 bp, Homo sapiens
ggcgcgccagtcctcattaggaggaaaggcattcatcaggttttcggctcagcatttaaaagcttatttggaggaatgtcatggattactcaaggcatgttgggggcactgctattgtggatggggctgaatgcaagggacagatccatttctatgacttttctagccgtaggaggaattttagtcttcgactcggaccgatg

SEQ ID NO: 9803 - DNA, 203 bp, Homo sapiens
ggcgcgccagtcctcacctggtggaagtttctgccgcggctttgcggggacgggggagtggtagtgggggctgcagctgccggacccaggcgcgatggctacgggcgcggatgtacgggacattctagaactcgggggtccagaaggggatgcagcctctgggaccatcagcaagaaggacattatcacgactcggaccgatg

SEQ ID NO: 9804 - DNA, 203 bp, Homo sapiens
ggcgcgccagtcctaccggtgcggaatccacgcttgaccatgtactgcttgatagagtcgcggctggccgactcatgggttaaagtcagttgacaagacacatggcttcttcaattctggtttctgactccgtctttgcccccatccttacccacaaactctcccgtcggatccggcgacaccccgtccgactcggaccgatg

SEQ ID NO: 9805 - DNA, 203 bp, Homo sapiens
ggcgcgccagtcctgggctcccggagaatcagaccttcaactctgacttcctcctcctgggaatcttcaatcatagccccacccacaccttcctcttctttctggtcctggccatcttttcagtggccttcatgggaaactccatcatggttctcctcatctacctggatacccagctccacaccccccgactcggaccgatg

SEQ ID NO: 9806 - DNA, 203 bp, Homo sapiens
ggcgcgccagtcctattacatgggaggagggacattggaagaagaactgtccaaaactcgtaagcggggcaaccccagtgttggtagaagaattacagtagggccgtcagggttcttccgccctccgtgaacccaggctaaaggttaaagtaggggggcaaataatagattttctagtagatacgggacgactcggaccgatg

SEQ ID NO: 9807 - DNA, 203 bp, Homo sapiens
ggcgcgccagtcctgggtaaggggaggtcagtgaaacacaggggacagagaaactgacaataacttactcatcgtcaatgatgtgggagattaatggccctgagtcagtgttggtcaatacctatcagtggatcatcagaaactgggaaactgttaaaattcaatggtctcagaatcctacaatgctacgactcggaccgatg

SEQ ID NO: 9808 - DNA, 203 bp, Homo sapiens
ggcgcgccagtcctatgggctgggataaagaggacgattgatggggtcctgagaggagcaggacccataaggtttgtgctggctctactgactttcttcaagtttacagccctgaggccaaccattggaatgctgaagagatggaagctggttggagttaatgaggcgactaaacatctgaaaagcttcgactcggaccgatg

SEQ ID NO: 9809 - DNA, 203 bp, Homo sapiens
ggcgcgccagtccttccaccatggatagatgtggtgagaataggtgtgctaaccctgggaatcctctcactattgaaagagaggagcaatgcaatggcaaaaaagaagggaggcatgctcctgggagtggcatgcgctaccgctggaatcgctagccctttggtgtttgctggtctgcacatggtgctcgactcggaccgatg

SEQ ID NO: 9810 - DNA, 203 bp, Homo sapiens
ggcgcgccagtcctcgctgacaggatcctaggcaattttgtggatctttgctgatacttcattctgcactcaaagccgcatccggcaagagtcatggggaaaacgcagtccaagggacagcccagcacaaatctcctcaaggagacagaaccaaggcatccagtaataccagatgccaggggaactggcgactcggaccgatg

SEQ ID NO: 9811 - DNA, 203 bp, Homo sapiens
ggcgcgccagtcctgttaagccggatcctaggcatagtgtctaacactttcactgagcaactctattctagatcaaaatcaccagaacttctggcatggcacactccaaggaggttccaagctttagatggactcagtccttaaggagaggtttgagccaattcactcagactgtcaagtcagatgttcgactcggaccgatg

SEQ ID NO: 9812 - DNA, 203 bp, Homo sapiens
ggcgcgccagtcctgcccgcttggatcctaggctattggattgcgctttgcttttgtcattttggcagatagtctcagttctttgttgtgtgcatacaacacaacaatctggcgatgagtgcctcaaaggaaataaaatcctttttgtggacacaatctttgaggagggaattatctggttactgctccgactcggaccgatg

SEQ ID NO: 9813 - DNA, 203 bp, Homo sapiens
ggcgcgccagtccttgaccgaaggatgagcccaccctgctttatcttctcttcgaagttttcgacgtggtcagagtgcatcagccacaccgcggcatcatcgaggcagtctacctgcgtacaccgttctcggccggtaacgctaccacgtaagaagcttcttgcttcttgcaaatagcagctgcaacccgactcggaccgatg

SEQ ID NO: 9814 - DNA, 203 bp, Homo sapiens
ggcgcgccagtcctggaggcagggatgctttaaaattaagcattgaggacccaagtcacgaaggggagggaataccactatatgatgcgatcaagtgcatgagaacattctttggatggaaagaaccctatattgttaaaccacacgaaaagggaataaatccaaattatctgctgtcatggaagcaacgactcggaccgatg

SEQ ID NO: 9815 - DNA, 203 bp, Homo sapiens
ggcgcgccagtcctgcgtaattggccaaaccctcctcttcaacatattgggggggtgggtggctgcccagctcgccgcccccggtgccgctaccgcctttgtgggcgctggcttagctggcgccgccatcggcagcgttggactggggaaggtcctcgtggacattcttgcagggtatggcgcgggcgcgactcggaccgatg

SEQ ID NO: 9816 - DNA, 203 bp, Homo sapiens
ggcgcgccagtcctcttccctgggccagcgatgccccggacctacaaaagccggacaaggcacttcagagcccaccaccggcctccacagacccagacaccatgctatcaggtaacgcaggagaaggagcaacagcctgcggaggttcggccgccgcgggccaggacctcatcagcgtcccccgcaaccgactcggaccgatg

SEQ ID NO: 9817 - DNA, 203 bp, Homo sapiens
ggcgcgccagtcctctttaagcggccagtggagtgaaagccatcagggccggtctcgatgaggccaaaccctggtacaagcttattaagctcctgagccgcttgtcgtgcatggccgctgtagcagcgcggtcaaaggacccagtccttgtggccatcatgctggctgacaccggtctcgagattctgcgactcggaccgatg

SEQ ID NO: 9818 - DNA, 203 bp, Homo sapiens
ggcgcgccagtcctaaccgacgggcccgcgcgctcctgggcgggggatgttgtgatggagaagccgcggcggagcccgaaccccgcagcctgagccacctccgtcatctgggcccggggcctcaccgcgcagattccttctggaaccccaacgccttcgagacggattccgacctgccggctggatggcgactcggaccgatg

SEQ ID NO: 9819 - DNA, 203 bp, Homo sapiens
ggcgcgccagtcctccgggcccggcgaactcagagggggcggttaggctgtccttcttctcgactgactccatgatctttttctgcctataggagaaggaaatggccagtcgggaagaggagcagcgcgaaaccacccccgagcgcggacgcggtgcggcgcgacgtcccccaaccatggaggacgtgcgactcggaccgatg

SEQ ID NO: 9820 - DNA, 203 bp, Homo sapiens
ggcgcgccagtcctcgagatgcggcgcgtgcgcaattggctcgagtacgctgcccgccactcttgggagaggaacctaccctggaccgctgccgacgaagttggcgaccagctagtttcctatcccatccaaccggagactctcgcaaacacccaaaccaacacagcttttgtcctgtccctcttctccgactcggaccgatg

SEQ ID NO: 9821 - DNA, 203 bp, Homo sapiens
ggcgcgccagtcctgtgatacgggcgggcggcgaacttcctccacaccttgaaagggatgtcaaattcctggtccacaattttcattgtcttccctctcagatgtcaaagaggctccgggtggaagatgacttcaatcccgtctacccctatggctacgcgcggaatcaaaatatccccttccttactcgactcggaccgatg

SEQ ID NO: 9822 - DNA, 203 bp, Homo sapiens
ggcgcgccagtccttcatgtacggcttcggcttaggagggcgaaaagctgagtggcgtcggagggagctctactgcagggagccaacataccctaccgagcactcagagagtcgttggaagacgggaaggaagcccgacgactgagcggtccaccccagacgtgattctggtcgcccggagatcaagccgactcggaccgatg

SEQ ID NO: 9823 - DNA, 203 bp, Homo sapiens
ggcgcgccagtccttatcataggggacccgatatctgcctacaaggaagtcatcggccacaatctttttgatcttaagagaacaagcttcgagaagctggccaagttaaatctcagcatgtcagtactcggagcctggactagacacaccagtaaaagactactacaagactgtgtcaatgtgggtgtcgactcggaccgatg

SEQ ID NO: 9824 - DNA, 203 bp, Homo sapiens
ggcgcgccagtcctatgtagacgggcccgggggatctcccccgcggtaactggtcacagttgccgcggacggagatcatcccccggttaccccctttcgacgcgggtactgcgatagtgccaccccagtccttcctactcccgactcccgaccccaacccaggttccttggaacaggaacaccaatttcgactcggaccgatg

SEQ ID NO: 9825 - DNA, 203 bp, Homo sapiens
ggcgcgccagtcctatgacctagggcctctttgagattccaagctacagatcactttacctgcgttgggtgaacgccgtgtgcggcgacgcataatcccccaaacatcacaattggcacaatgattttggggcgcgcgacgccgtgggagtgaaaagcccgaaagggcttttcccgcttccttaatcccgactcggaccgatg

SEQ ID NO: 9826 - DNA, 203 bp, Homo sapiens
ggcgcgccagtcctgtctgagtgggcgctagggtcccacccctaacatgccaacgacagctcctgcgctgcactccacacttacgtttgtgcacgcgcgggaaccgatggactttcgttcaaccacctccagctggactcactgcaccgcgtggccatgttagctggattgtgtggacgaacaccgctcgactcggaccgatg

SEQ ID NO: 9827 - DNA, 203 bp, Homo sapiens
ggcgcgccagtccttaattagagggcgctagggtcttgccctagttagccgtaacgaccgtccctgcgactcacctcgcacttacgccatcgctcttcggtggcccagatggacttccgttcacccacctctggctggacctgctgcaccgcacctggcccggacagctggactgtgcggacgaacaccgactcggaccgatg

SEQ ID NO: 9828 - DNA, 203 bp, Homo sapiens
ggcgcgccagtcctatctaacagggcgctagggtttcacccctagcatgccactgcagtccctgcgatacactccacacttacgttcttgtgtgcgcgggacccgatggactttcgttcacccacttacagctggacccacgacaccgcgtgaccactttgctggattgtgcggacgaacaccgcttgcgactcggaccgatg

SEQ ID NO: 9829 - DNA, 203 bp, Homo sapiens
ggcgcgccagtcctaactcctagggctgactttgtgaacatcgtttcctctgcccccttcattgtccccatggccgacgttaatgacaagggacggttttacacctcccgtgtcgtcatcgtcacctcaaacttccccggccctaacccccgctccgcccgctgtgtggccgcgctggaacgccgcctcgactcggaccgatg

SEQ ID NO: 9830 - DNA, 203 bp, Homo sapiens
ggcgcgccagtcctgcacacacggggcgagactggttgtgctcgccactgctacccctccgggctccgtcactgtgtcccatcctaacatcgaggaggttgctctgtccaccaccggagagatccctttttacggcaaggctatccccctcgaggtgatcaaggggggaagacatctcatcttctgcccgactcggaccgatg

SEQ ID NO: 9831 - DNA, 203 bp, Homo sapiens
ggcgcgccagtcctcgataacggggggcaggagtctgcactccctgtattcactgagcgtcatctaataaagatgtctattgatctcttttagtgtgaatcatgtctgacgagggaccaggtacaggacctggaaatggcctaggacagaaggaagacacatctggaccagacggctccagcggcagtcgactcggaccgatg

SEQ ID NO: 9832 - DNA, 203 bp, Homo sapiens
ggcgcgccagtcctctagttaggggggtgggggggcctcggccccctcaccctcttttccggtggccacccgcccgggccaccgttactccactccactccttcgggactggtttggaggaacataacagggcttcccatccctgtttacccttactccactcacccttccccttgaccaaccctatccgactcggaccgatg

SEQ ID NO: 9833 - DNA, 203 bp, Homo sapiens
ggcgcgccagtccttgttgtaagggttggagtggccgcaacgggcggggcggggcggggccgggcaagtttgttccccgagttcggagcctaggagccccccgcggctgcggcgcaggtgccctcggcctgagtcgggatggagctgcctgctgtgaacctgaaggggctgcattgtattctcaggctcgactcggaccgatg

SEQ ID NO: 9834 - DNA, 203 bp, Homo sapiens
ggcgcgccagtcctatgcgcaaggtaaactttgtgagtatggaattctctcttactgatccgaggctggagccacacagatgggaaaagtactgcgttcttcggataggagacatgctcttacggactgaaataggccaagtgtcaaggcccatgtttctttatgtgagaaccaatggaacctccaagcgactcggaccgatg

SEQ ID NO: 9835 - DNA, 203 bp, Homo sapiens
ggcgcgccagtccttcgagagaggtcaccacgggcatagcattgctcacccgtgaatcaagtcatcgagatttctctgacctctgaagtgcactgtggttgcgtggctgggaatccacgcttgaccatgtactgcttgatagagtcgcggctggccgactcatgggttaaagtcagttgacaagacaccgactcggaccgatg

SEQ ID NO: 9836 - DNA, 203 bp, Homo sapiens
ggcgcgccagtcctaatcgaacggtggtgaatggttctcaattccatgctggatgtctggcgatggttatggtcccggagtactcctacgggaccttcaaccagaaccgacagaatgctatcttcacctttccttatgccctcctcaacctctaccagggtaatactgcctctcttgaagttccctaccgactcggaccgatg

SEQ ID NO: 9837 - DNA, 203 bp, Homo sapiens
ggcgcgccagtccttcattcctggtggtgctttgatggaccctcatgcaatactgttctggaagacaataacccagtggagttatggacaaagtcaggtgagaagaaaatcttgaagccccggtggagagatggaagattgtgggcagatcaccaggccttaaaagccttcaaggattttgcgagtggcgactcggaccgatg

SEQ ID NO: 9838 - DNA, 203 bp, Homo sapiens
ggcgcgccagtcctgtaaaccgggtggtgctttgatggaccctcatgcaatactgttctggaagacaataacccagtggagttatggacaaagtcaggtgagaagaaaatcttgaagccccggtggagagatggaagattgtgggcagatcaccaggctttaaaagccttcaaggattttgcgagtggcgactcggaccgatg

SEQ ID NO: 9839 - DNA, 203 bp, Homo sapiens
ggcgcgccagtcctctggataagtaaaaggtggcctccctgcccagggccgtgtccaaccatttgattagaagggtagcatcctcgggaagtgcgggtgggctgcggttgcaggccagggcgtaaaagagacccagctgtgaagagaagccctcgagacctccccccatctccctcttaccttgtgtccgactcggaccgatg

SEQ ID NO: 9840 - DNA, 203 bp, Homo sapiens
ggcgcgccagtcctgagcggcagtatgtgatggttcagtagagtattgggtgtggagactagctataaaagaggccgggaggccttctgcgtccagacgcgatggcacacgccagagacaaggcaggcgctgtcctggccatgatactcatctgtgagacaagccttatctggacatctagtggcagtcgactcggaccgatg

SEQ ID NO: 9841 - DNA, 203 bp, Homo sapiens
ggcgcgccagtcctggagccgcgtcgaaacctcagtggataaaagacctagagaatgtgtatcccagaagaagctggccaaggatatgggagcaaccaccatggaccagaagtctctctgggcaggatctgcctacaaactggtttgctactttaccaactggtcccaggaccggcaggaaccaggaacgactcggaccgatg

SEQ ID NO: 9842 - DNA, 203 bp, Homo sapiens
ggcgcgccagtcctcacgtcaggtctacgtggaccgacaagaacagtttcgaatcggaagcttgcttaacgtagttctaacagttttttattagagagcagatctctgatgaacaaccaacggaaaaagacgggtcgaccgtctttcaatatgctgaaacgcgcgagaaaccgcgtgtcaactgtttccgactcggaccgatg

SEQ ID NO: 9843 - DNA, 203 bp, Homo sapiens
ggcgcgccagtcctgctaagtagtctccgtacccgcagaaattctgcggaagtctcggagattcgcccgggccctgcccgtttgggcgcggccggactacaaccccccgctagtagagacgtggaaaaagcctgactacgaaccacctgtggtccatggctgcccgctaccacctccacggtcccctccgactcggaccgatg

SEQ ID NO: 9844 - DNA, 203 bp, Homo sapiens
ggcgcgccagtcctcggtcgaggtctcttggtggcattattggctcaagtttctttaaacttaagcgcgccgtggctcctgctctagggaataaagagcgagctcaaaaaagacacttttattttgcaaactcaaataaaggtgctaaaaaatcaaaaaacaacgaacctaaaccaagcacctcaaaacgactcggaccgatg

SEQ ID NO: 9845 - DNA, 203 bp, Homo sapiens
ggcgcgccagtcctagtcatctgtctgaaggtgctgcgggatgccgttccttcgcgcgtgaggctgcggctctgacgccccataggctccttcaatttccgtgatcctcggagtccccaggagaccaggtgatggcagcagccagactcctgccagtgccggcaggaccccagcccctgtcgttccagcgactcggaccgatg

SEQ ID NO: 9846 - DNA, 203 bp, Homo sapiens
ggcgcgccagtcctattccttcgtcttgcggaccaggaggagcaactcgaggaagcagcgaccaacgcttctctgtggggagacggcgacctggccgaaggatggatgagtcccgcagacagcgacctgctggtcatgtggcagctaacctcagcccccaaggtgcacgccaacggtccttcaaggatcgactcggaccgatg

SEQ ID NO: 9847 - DNA, 203 bp, Homo sapiens
ggcgcgccagtcctcggattcagtgaagagggtagtaatgagcttgttggacggcagagggccagtacgtttcgtgctggctcttatcacgttcttcaagtttacagcattagccccgaccaaggcgcttttaggccgatggaaagcagtggaaaagagtgtggcaatgaaacatcttactagtttcacgactcggaccgatg

SEQ ID NO: 9848 - DNA, 203 bp, Homo sapiens
ggcgcgccagtcctatgcatttgtgatgggagtacgacctgatagggcgctgcagaggcccactattaggctagtataaaaatctctgctgtacatggcacatggagttgaatcactttgaacttttatacaaaacaaacaaacaaaaaccaatgggagtggaggaaccggtgtacgatgccacggggcgactcggaccgatg

SEQ ID NO: 9849 - DNA, 203 bp, Homo sapiens
ggcgcgccagtccttgtaattagtgcgaattgcctacctacgtcaccatcccgaataccgcaatcaaaatgttgcggcacttcttaggcttatttaaaaccatgcaggctatgctaccagtcattttaattttgctactaccctgcattcccctagcttccaccgccactcgcgctacacctgaacaacgactcggaccgatg

SEQ ID NO: 9850 - DNA, 203 bp, Homo sapiens
ggcgcgccagtcctcacagttcgtgcgaattgcctacctgcgccaccatcccgaataccgcaaccaaaatatcgcggcacttcttagactcatctaaaaccatgcaggctatactaccaatatttttgcttctattgcttccctacgctgtctcaaccccagctgcctatagtactccaccagaacaccgactcggaccgatg

SEQ ID NO: 9851 - DNA, 203 bp, Homo sapiens
ggcgcgccagtcctcggaacaagtgctagcagggccagccttgaactcgctggacagagctacagacctatggggcctggaagtgcccgctgagaaagggagaagacagcagaggggttgccgagggagttcctggtcggctccgacgccttctgctgcaacttggctagtgccctactttcagacaccgactcggaccgatg

SEQ ID NO: 9852 - DNA, 203 bp, Homo sapiens
ggcgcgccagtccttcatagtggtgtgtatgtatcatcaccacgccgccgcagcagaggagaaaggaagaggtcgcgcgccgaggctgagttgctttcaagatggccaccccatcgatgatgccccaatgggcatacatgcacatcgccggacaggatgcttcggagtacctcagtccgggtctggtgcgactcggaccgatg

SEQ ID NO: 9853 - DNA, 203 bp, Homo sapiens
ggcgcgccagtccttaacgcccgttaagtccgtcaagagactactcttgagtgccagcgagtagagttttctctaaactgtgctcccaaagtttaagaaaaatgagacacctgcacctcctgtcttcaactgtgcctattgacatggccgcattattgctggaggactatgtaaatacaatattggagcgactcggaccgatg

SEQ ID NO: 9854 - DNA, 203 bp, Homo sapiens
ggcgcgccagtccttccgtaatgttatatagaccggcggcggagcacgcgtgtgtgcggacgcagttgcgtgaggggtttgtactatcctcggtgctgtggtgcagagctagttcctctccagctcagccgcgtaggttgaattgaccaaagcaatggtgatggagaagcctagtcccctgctggtcgcgactcggaccgatg

SEQ ID NO: 9855 - DNA, 203 bp, Homo sapiens
ggcgcgccagtcctcgtacgatgttcgtcctcgcagccccgctcgggcggcattggaactctccagtttgtggaggagtttactccctctgtctacttcaaccccttctccggctctcctggccagtacccggacgagttcataccaaacttcgacgcaatcagcgagtcagtggatggctatgattgcgactcggaccgatg

SEQ ID NO: 9856 - DNA, 203 bp, Homo sapiens
ggcgcgccagtcctcaccaagggttgggtcgcgaaaggccttgtggtactgcctgatagggtgcttgcgagtgccccgggaggtctcgtagaccgtgcaacatgagcacacttcctaaacctcaaagaaaaaccaaaagaaacaccatccgtcgcccacaggacgtcaagttcccgggtggcggacagcgactcggaccgatg

SEQ ID NO: 9857 - DNA, 203 bp, Homo sapiens
ggcgcgccagtcctaacggcccgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagcgactcggaccgatg

SEQ ID NO: 9858 - DNA, 203 bp, Homo sapiens
ggcgcgccagtcctaacctccttaagccaaatgctgatcaacaggatgcacaaaaccaaccgcaatggacccaggtatgaagaagatgtggacttgggttcagggaccagagctgtgagctgcacaagacagaggactgactggggaatggtcgctgatagggtgaagaatttggccagagaatatgccgactcggaccgatg

SEQ ID NO: 9859 - DNA, 203 bp, Homo sapiens
ggcgcgccagtccttgctatcttacacagagcgatctaagcggcgagaccggagacgcagatctgtttgtcacgcccgcacctggttttgcttcaggaaatatgactacgtccggcgttccatttggcatgacactacgaccaacacgatctcggttgtctcggcgcactccgtacagtagggatcgtcgactcggaccgatg

SEQ ID NO: 9860 - DNA, 203 bp, Homo sapiens
ggcgcgccagtcctagtaaacctaccggagcagtcgcctggccatctacatcgaggacctcggtcgaaaatactgccccgcgagcgcgaccgggggagatcatggcatccggcaagcaccatcagcccggggggacgcggagcctgaccatgcaaaaagtaagcctgcgcgtgaccccccgcctggtgcgactcggaccgatg

SEQ ID NO: 9861 - DNA, 203 bp, Homo sapiens
ggcgcgccagtcctcactgcattactgtcgttagcgggcagagacaggatagacagggaggagagcgaaggaggccccaactcgaccgcgaccagtgtgcctactgcaaagaaaaaggacattgggctaaagattgccccaagaagccaagaggaccccggggaccgcgaccccaggcctccctcctgcgactcggaccgatg

SEQ ID NO: 9862 - DNA, 203 bp, Homo sapiens
ggcgcgccagtcctgctgagactagcctgcaaggaagattacaggtacgcaatatcgtcaaccgatgagatagggctacttggggccggaggtctcaccaccacctggaaggaatacaaccacgatttgcaactgaatgacgggaccgttaaggccagttgcgtggcaggttcctttaaagtcacagccgactcggaccgatg

SEQ ID NO: 9863 - DNA, 203 bp, Homo sapiens
ggcgcgccagtcctcgaacttatatcctctcctttgcacgccgtgggaccatccaggagaagttgatttccgtggcaggactcgccgtccactccggaccagacgagtaccggcgcctctttgagcccttccagggcctctttgagattccaagctacagatcactttacctgcgttgggtgaacgcccgactcggaccgatg

SEQ ID NO: 9864 - DNA, 203 bp, Homo sapiens
ggcgcgccagtcctggctatactatgtctgctatctttggcctgtccctgtagtggggcgcgggtcactgacccagacacaaataccacaatcctgaccaattgctgccagcgtaatcaggttatctattgttctccttccacttgcctacacgagcctggttgtgtgatctgtgcggacgagtgctgcgactcggaccgatg

SEQ ID NO: 9865 - DNA, 203 bp, Homo sapiens
ggcgcgccagtcctgcgcactatcacagcacacaaattgggggaataaggatggtggacatccttaggcaaaacccaactgaggagcaagctgtggatatatgcaaagcagcaatgggtttgaggatcagttcatcctttagctttggaggcttcactttcaaaagaacaaatggatcatccgtcaagcgactcggaccgatg

SEQ ID NO: 9866 - DNA, 203 bp, Homo sapiens
ggcgcgccagtccttacctgcgtcacatagatgcccactttctgtcacagactaagcagcagggacttaacttctcgtacctaactgcctaccaagccactgtgtgcgcccgcgcgcaggctcctcccccaagttgggacgagatgtggaagtgtctcgtgcggcttaagccaacactacatggacctcgactcggaccgatg

SEQ ID NO: 9867 - DNA, 203 bp, Homo sapiens
ggcgcgccagtcctgacatcgatcacgggcgtgcgcgtgcccgtgcgcacccgtcctcctcgtccctgatctaatgcttgtgtcctcccccgcaagcgacgatgtcaaagcgcaaaatcaaggaggagatgctccaggtcgtcgccccggagatttacggacccccggcggaccagaaaccccgcaaacgactcggaccgatg

SEQ ID NO: 9868 - DNA, 203 bp, Homo sapiens
ggcgcgccagtccttgatctgttccgaggagcaccctcagggtccggcccacggagtgcggattaccatcgaagggggaatagactctcgcctgcatcgcatcttctcccagcggcccgtgctaattgaacgcgaccagggaaatacaaccatctccatctactgcatctgtaaccaccccggattgccgactcggaccgatg

SEQ ID NO: 9869 - DNA, 203 bp, Homo sapiens
ggcgcgccagtcctccctcaagtcctgaaacatatgctgtaataactggagctccgggggctgtagctgggtttgctgcattggttcaaactgtaactggtggtagtgctattgctcagttgggatatagattttttgctgactgggatcataaagtttcaacagttgggctttttcagcagccagctcgactcggaccgatg

SEQ ID NO: 9870 - DNA, 203 bp, Homo sapiens
ggcgcgccagtccttggcgccgtcgatcctctactcggtcctccagcacctcgcccccaggctacctgacggggggcacgacgggcccccgtagtcccgccatgcgccagggcgcccccgcgcgggggcgccggtggttcgtcgtatgggcgctcttggggttgacgctgggggtcctggtggcgtcgcgactcggaccgatg

SEQ ID NO: 9871 - DNA, 203 bp, Homo sapiens
ggcgcgccagtcctcggcagcgtcggaaagtgtcatgcttggtattctcattatgttcttaagtttttcctcttagtgtttggtgagaatggtgtgtttttctataagcacttgcatggtgatgtcttgcctaatgattttgcctcgaaactaccattgcaagagccatttttcccttttgaaggcaacgactcggaccgatg

SEQ ID NO: 9872 - DNA, 203 bp, Homo sapiens
ggcgcgccagtcctgttcatactcggcggcttccgtagcgggagggcgaaagatggcggcggcagtactgggacagttgggtgcgttatggatacataacctgaggagccgggggaagctggccttggggaaatctaccactgtcgaagacaaataaaatatagcaaagacaagatgtggtatttggccgactcggaccgatg

SEQ ID NO: 9873 - DNA, 203 bp, Homo sapiens
ggcgcgccagtcctgaagggaatcgggggcagaggtggaggcgactgagatgggctgcggtctggccttggaggcggatggctggcagagctcattccgcgttcgggggtgtgctcccggtggcggtcgcttgactgatttcctccgcggctggccattgtgttctcctaggcagagaaacaacagaccgactcggaccgatg

SEQ ID NO: 9874 - DNA, 203 bp, Homo sapiens
ggcgcgccagtcctggacgttctcgggggcagaggtggaggcgattgcgaagggctggggtccgacctggaaggcggatgactggcagaaccccttccgcgttcgggggtgtgctccctgtggcggtcgcttaactgatttccttcgcggctggccattgtgttctcctaggcagagaaacaacagaccgactcggaccgatg

SEQ ID NO: 9875 - DNA, 203 bp, Homo sapiens
ggcgcgccagtccttgtcaagctctataggaatgaaggaagacgcttggcgtgtggggacacggttgatggtttgcccgttgttgcgcgtctcggcgaccttgttttcgcagggttggctatgccgccagatgggtgggccattaccgcaccttttacgctgcagtgtctctctgaacgtggcacgctcgactcggaccgatg

SEQ ID NO: 9876 - DNA, 203 bp, Homo sapiens
ggcgcgccagtcctagaaagactctatatccaacactaagaaaattcagtcgcgcctccaaagaaggaagcatcatttcatataatcgtggcaacattggataaaacacgacctcaaactcccttccctgctcacagactcgctcatacaaaagttcaagattcgtcttttcaggtgaggaatccatccgactcggaccgatg

SEQ ID NO: 9877 - DNA, 203 bp, Homo sapiens
ggcgcgccagtcctatcgaggatctcaacgcctacgttgcttacgaagacccccagggcgtggtctaccaagaagtagaaccataccactggatggttgccgttgcaatggtgggcacgcgttgggactactctgccactaacaactgtactcactttgtttctaatatcactggtgttgaactcccccgactcggaccgatg

SEQ ID NO: 9878 - DNA, 203 bp, Homo sapiens
ggcgcgccagtcctactaacattctcccagtaccgctggttcggcctcaatgaagatctcactccattgaacgtcaccggtggtctgttctatcacgtctccctcaaccccgtcaacttccagcaaaactctctcctcagtgttcttggtgctttcacttacgtgtatgctaacctttccctcaacatcgactcggaccgatg

SEQ ID NO: 9879 - DNA, 203 bp, Homo sapiens
ggcgcgccagtcctatgacaactctctggcaaccttctttcacagacttcgactccttggttgatgccattgtcgggcgtctggaccggtcaacgggggtttccgacctcctggctagtctggtcaaacgacagggcttgaccattgaagcggagcctactgaactttcctaccaggatgctttagaacgactcggaccgatg

SEQ ID NO: 9880 - DNA, 203 bp, Homo sapiens
ggcgcgccagtcctacgatatgtctgcctcccactccatggggcctttgatagtcaacatgatatatttgtccttagtccagaaatcatcactcggatttattatggaaaacataccgtttgcgcctcccaagttttttatagttgtatacggaaaataaggtaattcccctggcttgtcacctctagcgactcggaccgatg

SEQ ID NO: 9881 - DNA, 203 bp, Homo sapiens
ggcgcgccagtcctgatttctatctgctgtacatggcacatggagttgaatcactttgaacttttatacaaaacaaacaaacaaaaaccaatgggagtggaggaaccggtgtacgatgccacggggagaccgttgttcggagacccgagtgaggtacacccacaatcaacactgaagctaccacatgacgactcggaccgatg

SEQ ID NO: 9882 - DNA, 203 bp, Homo sapiens
ggcgcgccagtcctatctcaattcttcaccactgcctacaacgctcatgcctacttcaattgtggctttgacgtcacagtcgtcgtgaacgcctcccagttccacggcggctcgctgattgtcttggccatggctgaaggtctaggcgacatcaccccagctgactcttccacttggttcaatttccccgactcggaccgatg

SEQ ID NO: 9883 - DNA, 203 bp, Homo sapiens
ggcgcgccagtcctcactttcctcttgctctattcaccgttacttttcttcttgcccgttctctttcttagtatgaatccagtatgcctgcctgtaattgttgcgccctacctgttttggctggcggctattgccgcctcgtgtttcacggcctcagttagtaccgttgtgaccgccaccggcttggccgactcggaccgatg

SEQ ID NO: 9884 - DNA, 203 bp, Homo sapiens
ggcgcgccagtcctgagtgacgtgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggagaattttgtacgactcggaccgatg

SEQ ID NO: 9885 - DNA, 203 bp, Homo sapiens
ggcgcgccagtcctactgtaagtgaagagataggaagaggaagtcaggccagggaatccctgccaccggatgttggatgacggtgctgtctgcgttccaaccccaggaggactgggttaacaaatctgggtgcatggaggagctaagcgttcaaaaccgtctcggagaactccctggctcacgaagtgcgactcggaccgatg

SEQ ID NO: 9886 - DNA, 203 bp, Homo sapiens
ggcgcgccagtcctctggaaggtgaattcatttttctgggtctctctgattctcagggactccagaccttcctatttatgttgttttttgtattctatggaggaatcgtgtttggaaaccttcttattgtcataacagtggtatctgactcccaccttcactctcccatgtacttcctgctagccaaccgactcggaccgatg

SEQ ID NO: 9887 - DNA, 203 bp, Homo sapiens
ggcgcgccagtcctgactctgctgaccggtttgtggaggtcacagtgtcggataaccaacacacactcgacgtgatgcaggcacacaaagacaatatcgtgggcgcgcttcttcgcgcagccacgtactatttttctgatttggaaatagcagtgacccacactgggaagctcacatgggtgcccaaccgactcggaccgatg

SEQ ID NO: 9888 - DNA, 203 bp, Homo sapiens
ggcgcgccagtccttttgagtgtgagacgacgggtgaaaaagttgctgaggctgtgattgaacctgtccttcttgctgctactggaactcccatatcttttgtcaccaacctcttcgcccaatggcgaggagaactccagctttcccttctctttactggttccgcccaacacttcgggcgtctcgctcgactcggaccgatg

SEQ ID NO: 9889 - DNA, 203 bp, Homo sapiens
ggcgcgccagtcctgacgataatgaggtggctcgtggagcgtgggtttctcaaaccaagaggcaaagttgtggacttaggctgcggcagaggaggctggagttactactgtgcaacattaaagcaggttcaggaagtgagaggttacacaaaaggagggccagggcatgaggaaccagtgatgacccacgactcggaccgatg

SEQ ID NO: 9890 - DNA, 203 bp, Homo sapiens
ggcgcgccagtcctaggatgcctgagtgagaatgtgtcagaagtcatttgttacagtccaaagtggaccaggcctatcactctagagtataacaactccatatcttggtacccctatacaatccctggtgcgaggggatgtatggttaaattcaaaaataacacatggggttgctgccgtattcgcaacgactcggaccgatg

SEQ ID NO: 9891 - DNA, 203 bp, Homo sapiens
ggcgcgccagtcctcgttaccctgataccagagatgtggaagagcgcgtccatgtaatgcgcaaaaccaagcttgcacccaccgtcgcgcacggtgtgttcaatcctgagttcgggcctgccgccttgtctaacaaggacccacgcctgaacgaaggtgttgtcctcgatgaagtcattttctccaagcgactcggaccgatg

SEQ ID NO: 9892 - DNA, 203 bp, Homo sapiens
ggcgcgccagtcctcgaaaggatgatttttccacctgttcgacaggctactatgatatgacgcttgtttcttttattttgcagactaattcaaaactaacaatgttggagcgcagcgcggtaacctattgtatttgcatcccaacggttttgaatgtttctttggaaaatttttcttttattcaatttcgactcggaccgatg

SEQ ID NO: 9893 - DNA, 203 bp, Homo sapiens
ggcgcgccagtccttgtccggttgcaactggacgcggggcgaacgctgtgatctggaagacagggacaggtccgagctcagcccattgctgctgtccaccacacagtggcaggtccttccgtgttctttcacgaccctgccagccttgtccaccggcctcatccacctccaccagaacattgtggacgcgactcggaccgatg

SEQ ID NO: 9894 - DNA, 203 bp, Homo sapiens
ggcgcgccagtccttcggcccatgccagggataaaagttcgatttttgccgtagcggctagtaatgattctggagacgtgctgtttttgagtgaactaaggatgaactctaaatcgagtgcacgagctgccattgtggatactgtggaagctgtgaagaagagaaaatatatatctatcgatgagggacgactcggaccgatg

SEQ ID NO: 9895 - DNA, 203 bp, Homo sapiens
ggcgcgccagtcctccctgccgtgccagtgctattcccaaaaataaagaatggagaggtgactgacagttacgataactataccttcctcaacgcaagaaaattaggggatgatgtacccccttacgtgtatgccacagaggatgaggacttagcggtagagctgctgggcttagactggccggaccccgactcggaccgatg

SEQ ID NO: 9896 - DNA, 203 bp, Homo sapiens
ggcgcgccagtcctttgcacggtgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatccgactcggaccgatg

SEQ ID NO: 9897 - DNA, 203 bp, Homo sapiens
ggcgcgccagtcctcgacggcatgctatgactcagggtcgcaggggcaacgtgtattgggtgcgcgactcggttagcggcctgcgcgtgcccgtgcgcacccgccccccgcgcaactagattgcaagaaaaaactacttagactcgtactgttgtatgtatccagcggcggcggcgcgcaacgaagctcgactcggaccgatg

SEQ ID NO: 9898 - DNA, 203 bp, Homo sapiens
ggcgcgccagtcctttcattaatggacggcattgcagcgtggatccacgctgcccacgtaaaggctgccgacaccaggattgagccaccatcggaatcgacatggcgtgttcaacgctctcagaatcccctaaagataagattgacccgcgggacctcctaatccccttaattctcttcctgtctctccgactcggaccgatg

SEQ ID NO: 9899 - DNA, 203 bp, Homo sapiens
ggcgcgccagtcctcaaatcggtggactctctcaagaaccaggtgacagtcaccgccagatacttcagaagggtgcctagccagtccacctgagcgcgaggatggccctgcaaactgacacacatgcctggcgggtggagatagggaccaggggactaatgttctctaactgtgtcccactccacctgcgactcggaccgatg

SEQ ID NO: 9900 - DNA, 203 bp, Homo sapiens
ggcgcgccagtccttggtggtttggatcctaggcgtaacttcatcattaaatctcagattctgctctgagtgtgacttactgcgaagaggcagacaaatgggcaactgcaacggggcatccaagtctaaccagccagactcctcaagagccacacagccagccgcagaatttaggagggtagctcacacgactcggaccgatg

SEQ ID NO: 9901 - DNA, 203 bp, Homo sapiens
ggcgcgccagtcctcagacgtgtggatgtgcgcgtggaggctttgctggaagccaccgtggaacatctcgagaaccgtgttacctttgacctggctgttattttccaccaacacagtgggggcgagaggtgccacctccgggacctgcattttgaagtgttccgagaccgtttggaataaagttaatccgactcggaccgatg

SEQ ID NO: 9902 - DNA, 203 bp, Homo sapiens
ggcgcgccagtcctggacttgatggcggtaacccgtctggatgtgttggcacttccatcatcaacaccatcatcaacaacatttgtgttctttctgctttaatccaacaccctgatttttctcctgaatccttcagaattttggcctatggtgatgatgtgatttatgggtgcgatccacccatccatcgactcggaccgatg

SEQ ID NO: 9903 - DNA, 203 bp, Homo sapiens
ggcgcgccagtcctcgtagggctggggagaactactttgacatgggagcggatttgcaatggcaacccagtcgcagggccatggaggctgcagggtgtgagcttccttacatagaagaggtggatgaagtcgaggacgaggagggcgagtacttggaagactgatggcgcgacccgtatttttgctagcgactcggaccgatg

SEQ ID NO: 9904 - DNA, 203 bp, Homo sapiens
ggcgcgccagtccttctggagctgggttcaggcgattttgtcagtatgatcactcaaggggagaagaaggaagaagaagttcctcaggtgtttgacgaaaacatgctgcgaaaaaggcaactaacagtgctggacctacatccaggttcaggaaagaccagaaaggtcctccccatgattctgaagagcgactcggaccgatg

SEQ ID NO: 9905 - DNA, 203 bp, Homo sapiens
ggcgcgccagtcctgtaagacatggtcagtaggaggtatttggcatcattgcataagaaggctttacccacttccgtgacattcgagctcctgttcgacgggaccaacccatcaactgaggaaatgggagatgacttcaggtccgggctgtgcccgtttgatacgagtcctgttgttaagggaaagtacgactcggaccgatg

SEQ ID NO: 9906 - DNA, 203 bp, Homo sapiens
ggcgcgccagtcctacacgacctggtggatacaacagacgtagccgtgactgtggtaggggaagcccccactatgactacaggggagacaccgacagtgttcaccagctcaggttcaggcctgaaaagccaacaagttttgaaactaggggtaggtgaaggccaatatccagggactaatccacagagcgactcggaccgatg

SEQ ID NO: 9907 - DNA, 203 bp, Homo sapiens
ggcgcgccagtcctcctttcactgtgctcccggtggcggtcgcttgactgatttcctccgcggctggccattgtgttctcctaggcagagaaacaacagacatggaaactcagccatcactgccaacatcgctgcaagcaccatcacacctcgcccccagcagcgacgaggaggagagcttaaccacccgactcggaccgatg

SEQ ID NO: 9908 - DNA, 203 bp, Homo sapiens
ggcgcgccagtcctgaatcctctgtgtacattgaggtattgcatttgactcaagggacctgttgggaacagatgtacactcccggcggagaagtaagaaatgatgatgttgaccagagtttgatcatcgctgccagaaacattgttaggagagcaacagtatcagcggacccactggcatcactcttgcgactcggaccgatg

SEQ ID NO: 9909 - DNA, 203 bp, Homo sapiens
ggcgcgccagtccttaaacaattgtttttctcaggtgttttccgcgttccgggtcaaagttggcgttttattattatagtcagctgacgtgtagtgtatttatacccggtgagttcctcaagaggccactcttgagtgccagcgagtagagttttctcctccgagccgctccgacaccgggactgaaacgactcggaccgatg

SEQ ID NO: 9910 - DNA, 203 bp, Homo sapiens
ggcgcgccagtcctagcccagattacaaggagaatagattcatcgagattggagtgacaaggagagaagtccacatatactatcttgaaaaggccaataaaattaaatctgagaatacacacatccacattttctcattcactggggaagaaatggccacaaaggccgactacactctcgatgaggaacgactcggaccgatg

SEQ ID NO: 9911 - DNA, 203 bp, Homo sapiens
ggcgcgccagtcctggagtagtttacactaagaccggagaggtttttccttgtgctggtttgtttccccggtgcgacatatgacgcgctggtgactttctgtgtgtgtcacgtagctcttctatgtttaacatccagtgcagcatcgttctttgggactgactctagggttagggcccatagaatgttcgactcggaccgatg

SEQ ID NO: 9912 - DNA, 203 bp, Homo sapiens
ggcgcgccagtcctctgtgaagttacatcggacaaactctgaccgaaccactctgagaacagagtatcgttctgaaacctgttctccatcacagagctggtatggcctccagtcgtgtagacaccattaatttacggatctggctggtctctataatctgtgcagccttgtcattcataaacgtcacgcgactcggaccgatg

SEQ ID NO: 9913 - DNA, 203 bp, Homo sapiens
ggcgcgccagtcctattcacccttatccaaaaatctacaagacttattttgagaaagtcgaaaggttaaaacatggaacctttggccctgtccattttagaaaccaagtcaaaatacgccgaagagttgacataaaccctggtcatgcagacctcagtgccaaggaggcacaagacgtaatcatggaacgactcggaccgatg

SEQ ID NO: 9914 - DNA, 203 bp, Homo sapiens
ggcgcgccagtcctgtcctacattccagttaatctatgggggcgtgatatattaagcaaaatgggtgtttatttatatagtccttcacccactgtgacagatttgatgttagaccaaggcttacttccaaatcaaggtttaggtaaacaacatcaaggcatcattttaccccttgatttaaaatctaacgactcggaccgatg

SEQ ID NO: 9915 - DNA, 203 bp, Homo sapiens
ggcgcgccagtcctaagtgctcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagcccgactcggaccgatg

SEQ ID NO: 9916 - DNA, 203 bp, Homo sapiens
ggcgcgccagtccttcactaaattctctgcacgtcttttggtggcttcggcctccagaacggcggagacccaggcaacctccactccaacacatggggaaccctcattctctatgttgacctcccccaaagcgatagtgtctcagtctctgcttacatctctttccgcgacttcgaagcctacgtccccgactcggaccgatg

SEQ ID NO: 9917 - DNA, 203 bp, Homo sapiens
ggcgcgccagtccttcacatccttctgaagcataaagcccaggatcgccggcagggcctccttcttgataaagttagcctcgtccacaaacaagaggtgaaatgtctgcccccggatgctctgaaagacaggataagaagcgagtcactattggggagacagaatttggacaattgctgagctgggaccgactcggaccgatg

SEQ ID NO: 9918 - DNA, 203 bp, Homo sapiens
ggcgcgccagtcctgtgagtacttcttggatcaatatttaatcgcagacgaggtttcgtggaacgttgttcccgtaatctgttttttcaggcagtggggactcaagttagatttttttaaaaagttttcggggaagaccaagcggttgtcattttcgtttatacgtgatttgttcgccaggtctcaggcgactcggaccgatg

SEQ ID NO: 9919 - DNA, 203 bp, Homo sapiens
ggcgcgccagtcctgacagaagttgaagtatcttactacctccacaagaagatcatagatgaaatagcaggagggaccaacttcatctcaagacttgtagccgctttgatcgaagtcaattgggcctttgacaacgaagaagttaggggtttgaagaagttcttcctgttgtctagtagggttaaagacgactcggaccgatg

SEQ ID NO: 9920 - DNA, 203 bp, Homo sapiens
ggcgcgccagtccttatacaccttgatcctgcgccgggcggacgcggtcagccccggccaggccctgcccccggatgggctttacctcacgtacgactctgaccggcccctaattcttctgtataagggcagggggtgggtatttaaggatctatatgcccttctctacctgcacctccaaatgagagcgactcggaccgatg

SEQ ID NO: 9921 - DNA, 203 bp, Homo sapiens
ggcgcgccagtccttcatcggattgcgcgtgcatgcgtgtgcttcagacagcccaggcagcgactgtgattgtggatattctttctgcaagttttgtcgtgaacgtgttgagaaaaagacagcttaggagaacaagagctgggaatggccgggaaggccgttctaaaaggaaagggggggggtccccccgactcggaccgatg

SEQ ID NO: 9922 - DNA, 203 bp, Homo sapiens
ggcgcgccagtccttatacgtattgtttcgattcttccaaaatcagagacagagtgctcccggtgccatgaacggagacgatgcctttgtacggagacctagggttggttctcaaataccagagaagatgcaaaagcatccctggagacaagtctgtgaccgtggaatacatttggtgaatctcagtccgactcggaccgatg

SEQ ID NO: 9923 - DNA, 203 bp, Homo sapiens
ggcgcgccagtcctgactagggtttcacctaaatttccgcgtacggtgtcaaagttctgtgtttttacgtaggtgtcagctgatcgctagggtatttaaacctgacgagttccgtcaagaggccactcttgagtgccagcgagaagagttttctcctccgcgccgcaagtcagttctgcgctttgaaacgactcggaccgatg

SEQ ID NO: 9924 - DNA, 203 bp, Homo sapiens
ggcgcgccagtcctccttatctttttttttttttttttttttctttttttctcttttccttctttcttaccttattttactttctttcctggtggctccatcttagccctagtcacggctagctgtgaaaggtccgtgagccgcatgactgcagagagtgccgtaactggtctctctgcagatcatgtcgactcggaccgatg

SEQ ID NO: 9925 - DNA, 203 bp, Homo sapiens
ggcgcgccagtccttatcggataaaaatctctagcagtggcgcccgaacagggactcgaaagcgaaagttccagagaagttctctcgacgcaggactcggcttgctgaggtgcacacagcaagaggcgagagcggcgactggtgagtacgcctaagatttttgactagcggaggctagaaggagagagcgactcggaccgatg

SEQ ID NO: 9926 - DNA, 203 bp, Homo sapiens
ggcgcgccagtcctttgcgctcaaaatctctagcagtggcgcccgaacagggacgcgaaagcgaaagtagaaccagagaagatctctcgacgcaggactcggcttgctgaagtgcacacggcaagaggcgagagcggcgactggtgagtacgccaaatttttgactagcagaggctagaaggagagagcgactcggaccgatg

SEQ ID NO: 9927 - DNA, 203 bp, Homo sapiens
ggcgcgccagtcctgacgcgtaaaaatctctagcagtggcgcccgaacagggactcgaaagcgaaagtgttccagagaagctctctcgacgcgaggactcggcttgctgaggtgcacacagcaaggggcgagagcggcgactggtgagtacgccaattttttgactagcggaggctagaaggagagagcgactcggaccgatg

SEQ ID NO: 9928 - DNA, 203 bp, Homo sapiens
ggcgcgccagtcctaccggcagaaaatctctagcagtggcgcccgaacagggacttgaaagcgaaagttccagagaagttctctcgacgcaggactcggcttgctgaggtgcacacagcaagaggcgagagcggcgactggtgagtacgcctaaagatttttgactagcggaggctagaaggagagagcgactcggaccgatg

SEQ ID NO: 9929 - DNA, 203 bp, Homo sapiens
ggcgcgccagtcctcgatgcgcaaaatctctagcagtggcgcccgaacagggacttgaaagcgacagtagaaccagaggagctctctcgacacaggactcggcttgctgaagcgcgcacggcaagaggcgaggggcggcgactggtgagtacgccaatttttgactagcggaggctagaaggagagagcgactcggaccgatg

SEQ ID NO: 9930 - DNA, 203 bp, Homo sapiens
ggcgcgccagtcctggctcctgaaatctctagcagtggcgcccgaacagggaccgagaaagcgaaagtagaaccagaggagctctctcgacgcacgactcggcttgctgagcgcgcacggcaagaggcgaggggcggcgaccggtgagtacgccaattttttgactagcggaggctagaaggagagagcgactcggaccgatg

SEQ ID NO: 9931 - DNA, 203 bp, Homo sapiens
ggcgcgccagtcctgcttcttcaaatctctagcagtggcgcccgaacagggaccggaaagcgaaagagaaaccagagaagctctctcgacgcaggactcggcttgctgaagcgcgcacggcaagaggcgaggggcggcgaacggtgagtacgccaaaattttgactagcggaggctagaaggagagagcgactcggaccgatg

SEQ ID NO: 9932 - DNA, 203 bp, Homo sapiens
ggcgcgccagtcctttgtatcgaaatctctagcagtggcgcccgaacagggacctgaaagcgaaagtaccagagaagttctctcgacgcaggactcggcttgctgaggtgcacacagcaagaggcgagagcggcgactggtgagtacgccaaagaattttttgactagcggtggctagaaggagagagcgactcggaccgatg

SEQ ID NO: 9933 - DNA, 203 bp, Homo sapiens
ggcgcgccagtcctcttgcgttaaatctctagcagtggcgcccgaacagggacgcgaaagcgaaagtagaaccagaggagaactctcgacgcaggactcggcttgctgaagtgcactcggcaagaggcgagagcggcggctggtgagtacgccattttatttgactagcggaggctagaaggagagtgcgactcggaccgatg

SEQ ID NO: 9934 - DNA, 203 bp, Homo sapiens
ggcgcgccagtcctttagttcaaaatctctagcagtggcgcccgaacagggacgcgaaagcgaaagtagaaccagaggagatctctcgacgcaggactcggcttgctgaggtgcacacagcaagaggcgagagcggcggctggtgagtacgccaatttttttgactagcggaggctagaaggagagagcgactcggaccgatg

SEQ ID NO: 9935 - DNA, 203 bp, Homo sapiens
ggcgcgccagtcctcgtcagtaaaatctctagcagtggcgcccgaacagggactcgaaagcgaaagttccagagaagttctctcgacgcaggactcggcttgctgaggtgcacacagcaagaggcgagagcggcgactggtgagtacgcctaagaattttttgactagcggaggctagaaggagagagcgactcggaccgatg

SEQ ID NO: 9936 - DNA, 203 bp, Homo sapiens
ggcgcgccagtcctttaaggagaaatctctagcagtggcgcccgaacagggactggaaaagcgaaagtaaaaccagaggagatctctcggcgcaggactcggcttgctgcagcgcgcgcggcaagaggcgaggggcggcgactggtgagtacgccaatttttgactagcggaggctagaaggagagagcgactcggaccgatg

SEQ ID NO: 9937 - DNA, 203 bp, Homo sapiens
ggcgcgccagtcctcgggtttgaaatctctagcagtggcgcccgaacagggacttgaaagcgaaagagaaaccagaggagatctctcgacgcaggactcggcttgctgaagcgcgcacagcaagaggcgaggggcggcgaccggtgagtacgccaattttttgactagcggaggctagaaggagagagcgactcggaccgatg

SEQ ID NO: 9938 - DNA, 203 bp, Homo sapiens
ggcgcgccagtcctttgggactaaatctctagcagtggcgcccgaacagggacttgaaagcgaaagagaaaccagaggagatctctcgacgcaggactcggcttgctgaagcgcgcacggcaagaggcgaggggcggcgactggtgagtacgccaaatttttgactagcggaggctagaaggagagagcgactcggaccgatg

SEQ ID NO: 9939 - DNA, 203 bp, Homo sapiens
ggcgcgccagtcctaagatcacaaatctctagcagtggcgcccgaacagggacttgaaagtgaaagtagaaccagaggagctctctcgacgcaggactcggcttgctgaagcgcgcacggcaagaggcgaggggcagcgaacggtgagtacgcaaaatttttgactagcggaggctagaaggagagagcgactcggaccgatg

SEQ ID NO: 9940 - DNA, 203 bp, Homo sapiens
ggcgcgccagtccttgaccattaacagggacccgaaagtgaaagttaatagggactcgaaagcgaaagttccagagaagttctctcgacgcaggactcggcttgctgaagtgcacacagcaagaggcgagagcggcgactggtgagtacgccaaatccttttgactagcggaggctagaaggagagagcgactcggaccgatg

SEQ ID NO: 9941 - DNA, 203 bp, Homo sapiens
ggcgcgccagtcctatatccttaacagggacctgaaaacgaaagttaatagggactcgaaagcgaaagttccagagaagttctctcgacgcaggactcggcttgctgaggtgcacacagcaagaggcgagagcggcgaactggtgagtacgccaaaaattttgactagcggaggctagaaggagagagcgactcggaccgatg

SEQ ID NO: 9942 - DNA, 203 bp, Homo sapiens
ggcgcgccagtccttcggcgtcaacagggacttgaaagagaaagttaaaagggactcgaaagcgaaagttccagagaagttctctcgacgcaggactcggcttgctgaaggtgcacacagcaagaggcgagagcggcggctggtgagtacgccaaattttttgactagcggaggctagaaggagagagcgactcggaccgatg

SEQ ID NO: 9943 - DNA, 203 bp, Homo sapiens
ggcgcgccagtcctccttcctaaacagggacttgaaagcgaaagttaacagggactcgaaagcgaaagttccagagaagttctctcgacgcaggactcggcttgctgaaggtgcacacagcaagaggcgagagcggcggctggtgagtacgccataaattttgactagcggaggctagaaggagagagcgactcggaccgatg

SEQ ID NO: 9944 - DNA, 203 bp, Homo sapiens
ggcgcgccagtcctctgtttgaaacagggacttgaaagtgaaagttaatagggactcgaaagcggaagttcccagaggagatctctcgacgcaggactcggcttgctgcagcgcgcacagcaagaggcgaggggcagcagctggtgagtacgctgaaattttgactagcggaggctagaaggagagagcgactcggaccgatg

SEQ ID NO: 9945 - DNA, 203 bp, Homo sapiens
ggcgcgccagtcctcagtacagaactagagatccctcagaccactctagaaggtgtaaaaatctctagcagtggcgcccgaacagggacccgaaagcgaaagttaatagggactcgaaagcgaaagttccagagaagttctctcgacgcaggactcggcttgctgaggtgcacacggcaagaggcgagcgactcggaccgatg

SEQ ID NO: 9946 - DNA, 203 bp, Homo sapiens
ggcgcgccagtcctcacatgtaaactagagatccctcagaccactctagacagtgtaaaaatctctagcagtggcgcccgaacagggacccgaaagtgaaagttaatagggactcgaaagcgaaagttccagagaagttctctcgacgcaggactcggcttgctgaagtgcacacagcaagaggcgagcgactcggaccgatg

SEQ ID NO: 9947 - DNA, 203 bp, Homo sapiens
ggcgcgccagtcctgttcgcgaaactagagatccctcagaccactctagacagtgtaaaaatctctagcagtggcgcccgaacagggacttgaaagcgaaagttaatagggactcgaaagcgaaagttccagagaagatctctcgacgcaggactcggcttgctgaagtgcactcggcaagaggcgagcgactcggaccgatg

SEQ ID NO: 9948 - DNA, 203 bp, Homo sapiens
ggcgcgccagtcctcccttcgtaactagagatccctcagaccactctagacagtgtaaaaatctctagcagtggcgcccgaacagggacttgaaagcgaaagttaatagggactcgaaagcgaaagttccagagaagttctctcgacgcaggactcggcttgctgaggtgcacacagcaagaggcgagcgactcggaccgatg

SEQ ID NO: 9949 - DNA, 203 bp, Homo sapiens
ggcgcgccagtccttgctcaaaaactagagatccctcagaccactctagacagtgtaaaaatctctagcagtggcgcccgaacagggacttgaaagtgaaagttaaaagggactcgaaagcggaagttccagagaagttctctcgacgcaggactcggcttgctgaggtgcacacagcaagaggcgagcgactcggaccgatg

SEQ ID NO: 9950 - DNA, 203 bp, Homo sapiens
ggcgcgccagtccttcaactggaactagagatccctcagaccactctagacggtataaaaatctctagcagtggcgcccgaacagggacccgaaagtgaaagttaatagggactcgaaagcggaagttccagagaagttctctcgacgcaggactcggcttgctgaggtgcacacagcaagaggcgagcgactcggaccgatg

SEQ ID NO: 9951 - DNA, 203 bp, Homo sapiens
ggcgcgccagtcctcgtcttgcaactagagatccctcagaccactctagactaagtaaaaatctctagcagtggcgcccgaacagggactcgaaagcgaaagttaatagggactcgaaagcgaaagttccagagaagttctctcgacgcaggactcggcttgctgaggtgcacacagcaagaggcgagcgactcggaccgatg

SEQ ID NO: 9952 - DNA, 203 bp, Homo sapiens
ggcgcgccagtcctccaaccagaactagagatccctcagaccactctagactaagtaaaaatctctagcagtggcgcccgaacagggacttgaaagcgaaagttaatagggactcgaaagcgaaagttccagagaagttctctcgacgcaggactcggcttgctgaggtgcacacagcaagaggcgagcgactcggaccgatg

SEQ ID NO: 9953 - DNA, 203 bp, Homo sapiens
ggcgcgccagtcctaggccaagaactagagatccctcagaccactctagactaagtaaaaatctctagcagtggcgcccgaacagggacttgaaagcgaaagttaatagggactcgaaagcgaaagttccagagaagttctctcgacgctggactcggcttgctgaggtacacacagcaagaggcgagcgactcggaccgatg

SEQ ID NO: 9954 - DNA, 203 bp, Homo sapiens
ggcgcgccagtcctgcgttctgaactagagatccctcagaccactctagactgagtaaaaatctctagcagtggcgcccgaacagggacttgaaagcgaaagttaatagggactcgaaagcgaaagttccagagaagttctctcgacgcaggactcggcttgctgaggtgcacacagcaagaggcgagcgactcggaccgatg

SEQ ID NO: 9955 - DNA, 203 bp, Homo sapiens
ggcgcgccagtcctgtctacttaactagagatccctcagaccactctagactgagtaaaaatctctagcagtggcgcccgaacagggacttgaaagcgaaagttaatagggactcgaaagcgaaagttccagagaagttctctcgacgcaggactcggcttgctgcggtgcacacagcaagcggcgagcgactcggaccgatg

SEQ ID NO: 9956 - DNA, 203 bp, Homo sapiens
ggcgcgccagtcctgagtacctaactagagatccctcagaccactctagactgagtaaaattctctagcagtggcgcccgaacagggacttgaaaacgaaagttaatagggactcgaaagcgaaagttccagagaagttctctcgacgcaggactcggcttgctgaggtgcacacagcaagaggcgagcgactcggaccgatg

SEQ ID NO: 9957 - DNA, 203 bp, Homo sapiens
ggcgcgccagtcctccaggctaaactagagatccctcagaccactctagactgtgtaaaaatctctagcagtggcgcccgaacagggacttgaaagtgaaagttaatagggactcgaaagcgaaagttccagagaagttctctcgacgcaggactcggcttgctgaggtgcacacagcaagaggcgagcgactcggaccgatg

SEQ ID NO: 9958 - DNA, 203 bp, Homo sapiens
ggcgcgccagtccttagcctttaactagagatccctcagaccactctagatagtgtaaaaatctctagcagtggcgcccgaacagggacttgaaaacgaaagttaatagggactcgaaagcgaaagttccagagaagttctctcgacgcaggactcggcttgctgaggtgcacacagcaagaggcgagcgactcggaccgatg

SEQ ID NO: 9959 - DNA, 203 bp, Homo sapiens
ggcgcgccagtcctggcggctcaatctatagcagtggcgcccgaacagggaccagaaagcgaaagtagaaccagaggagctctctcgacgcaggactcggcttgctgaagcgcgcacggcaagaggcgaggggcggcgactggtgagtacgccaaaaattttgactagcggaggctagaaggagagagcgactcggaccgatg

SEQ ID NO: 9960 - DNA, 203 bp, Homo sapiens
ggcgcgccagtcctcagctatcaatctctagcagtggcgcccgaacagggaccagaaagcgaaagtaaaaccagagaagttctctcgacgcaggactcggcttgctgaagtgcactcggcaagaggcgagaggggcggctggtgagtacgccatttttatttgactagcggaggctagaaggagagagcgactcggaccgatg

SEQ ID NO: 9961 - DNA, 203 bp, Homo sapiens
ggcgcgccagtcctgtaccgttaatctctagcagtggcgcccgaacagggaccagaaagcgaaagtaagaccagaggagatctctcgacgcaggactcggcttgctgaagtgcactcggcaagaggcgagagcggcgactggtgagtacgccaattttatttgactagcggaggctagaaggagagagcgactcggaccgatg

SEQ ID NO: 9962 - DNA, 203 bp, Homo sapiens
ggcgcgccagtcctaaacagtgaatctctagcagtggcgcccgaacagggaccggaaaacgaaagtaaaaccagaggagatctctcgacgcaggactcggcttgctgaagcgcgcacggcaagaggcgaggggcggcggctggtgagtacgccaaaatttttgactagcggaggctagaaggagagagcgactcggaccgatg

SEQ ID NO: 9963 - DNA, 203 bp, Homo sapiens
ggcgcgccagtcctctgctcctaatctctagcagtggcgcccgaacagggaccggaaagcgaaagagaaaccagaggagctctctcgacgcaggactcggcttgctgaagcgcgcacggcaagaggcgagaggcggcgactggtgagtacgccgaaatttttgactagcggaggctagaaggagagagcgactcggaccgatg

SEQ ID NO: 9964 - DNA, 203 bp, Homo sapiens
ggcgcgccagtcctagtgcaaaaatctctagcagtggcgcccgaacagggacctgaaagcgaaagtaaaaccagagaagatctctcgacgcaggactcggcttgctgaggcgcacggcaagaggcgaggagcggcgactggtgagtacgccgaaaaatttttgactagcggaggctagaaggagagagcgactcggaccgatg

SEQ ID NO: 9965 - DNA, 203 bp, Homo sapiens
ggcgcgccagtccttaacacgtaatctctagcagtggcgcccgaacagggacctgaaagcgaaagtaagaccagaggagatctctcgacgcaggactcggcttgctgaagtgcactcggcaagaggcgagagcggcgactggtgagtacgccaaatttatttgactagcggaggctagaaggagagagcgactcggaccgatg

SEQ ID NO: 9966 - DNA, 203 bp, Homo sapiens
ggcgcgccagtcctagcgtgttaatctctagcagtggcgcccgaacagggacctgaaagcgaaagtaagaccagaggagatctctcgacgcaggactcggcttgctgaagtgcactcggcaagaggcgagaggggcgactggtgagtacgccaattttatttgactagcggaggctagaaggagagagcgactcggaccgatg

SEQ ID NO: 9967 - DNA, 203 bp, Homo sapiens
ggcgcgccagtcctggaacgccaatctctagcagtggcgcccgaacagggacctgaaagcgaaagtagaaccagagaagatctctcgacgcaggactcggcttgctgaagcgcgcacagcaagaggcgaggggcagcgactggtgagtacgctgaaatttttgactagcggaggctagaaggagagagcgactcggaccgatg

SEQ ID NO: 9968 - DNA, 203 bp, Homo sapiens
ggcgcgccagtccttggttcaaaatctctagcagtggcgcccgaacagggacctgaaagcgaaagtagaaccagaggagatctctcgacgcaggactcggcttgctgaagcgcgcacagcaagaggcgaggggcggcgactggtgagtacgccaaaaattttgactagcggaggctagaaggagagagcgactcggaccgatg

SEQ ID NO: 9969 - DNA, 203 bp, Homo sapiens
ggcgcgccagtcctgcgaggagaatctctagcagtggcgcccgaacagggacctgaaagcgaaagtgagaccagagaagctctctcgacgcaggactcggcttgctgaagcgcgcacagcaagaggcgagagcggcgactggtgagtacgccgaaaatttttgactagcggaggctagaaggagagagcgactcggaccgatg

SEQ ID NO: 9970 - DNA, 203 bp, Homo sapiens
ggcgcgccagtcctgcacaggaaatctctagcagtggcgcccgaacagggacctgaaagcgaaagtgagaccagaggagatctctcgacgcaggactcggcttgctgaagtgcactcagcaagaggcgagagcggcgactggtgagtacgccaattttatttgactagcggaggctagaaggagagagcgactcggaccgatg

SEQ ID NO: 9971 - DNA, 203 bp, Homo sapiens
ggcgcgccagtcctgtaactgcaatctctagcagtggcgcccgaacagggactagaaagcgaaagtagaaccagagaagatctctcgacgcaggactcggcttgctgaagcgcacggcaagaggcgaggggcggcgactggtgagtacgccaacaaatttttgactagcggaggctagaaggagagagcgactcggaccgatg

SEQ ID NO: 9972 - DNA, 203 bp, Homo sapiens
ggcgcgccagtcctcaactgacaatctctagcagtggcgcccgaacagggacttgaaaacgaaagtaaactggagcagttctctcgacgcggggactcggcttgctgaagtgcacacggcaagaggcgaggggaggcgactggtgagtacgcctaacttttgactagcggtaggctagaaggagagagcgactcggaccgatg

SEQ ID NO: 9973 - DNA, 203 bp, Homo sapiens
ggcgcgccagtcctgatcgccgaatctctagcagtggcgcccgaacagggacttgaaaacgaaagtagaaccagaggagatctctcgacgcaggactcggcttgctgaagcgcgcacggcaagaggcgaggggcggcgactggtgagtacgccaaaaactttgactagcggaggctagaaggagagagcgactcggaccgatg

SEQ ID NO: 9974 - DNA, 203 bp, Homo sapiens
ggcgcgccagtcctcaatcattaatctctagcagtggcgcccgaacagggacttgaaaacgaaagtagaaccggaggagctctctcgacgcaggactcggcttgctgaagcgcgcgcggcaagaggcgaggggcggcgactggtgagtacgccaaaatttttgactagcggaggctagaaggagagagcgactcggaccgatg

SEQ ID NO: 9975 - DNA, 203 bp, Homo sapiens
ggcgcgccagtcctgtgtcgtcaatctctagcagtggcgcccgaacagggacttgaaagcgaaagtaagaccagaggagatctctcgacgcaggactcggcttgctgaagtgcactcggcaagaggcgagaggggcgactggtgagtacgccaattttatttgactagcggaggctagaaggagagagcgactcggaccgatg

SEQ ID NO: 9976 - DNA, 203 bp, Homo sapiens
ggcgcgccagtcctaccgcacaaatctctagcagtggcgcccgaacagggacttgaaagcgaaagtaagaccagaggagctctctcgacgcaggactcggcttgctgaagcgcgcacagcaagaggcgaggggcggcgactggtgagtacgccaaaacttttgactagcggaggctagaaggagagagcgactcggaccgatg

SEQ ID NO: 9977 - DNA, 203 bp, Homo sapiens
ggcgcgccagtcctgaggagttaatctctagcagtggcgcccgaacagggacttgaaagcgaaagtagaaccagagaagatctctcgacgcaggactcggcttgctgcagcgcgcacggcaagaggcgaggggcggcgaccggtgagtacgccaaaatttttgactagcggaggctagaaggagagagcgactcggaccgatg

SEQ ID NO: 9978 - DNA, 203 bp, Homo sapiens
ggcgcgccagtcctcttgacagaatctctagcagtggcgcccgaacagggacttgaaagcgaaagtagaaccagaggagatctctcgacgcaggactcggcttgctgaagcgcgcacagcaagaggcgaggggcggcgactggtgagtacgccaaaattttttactagcggaggctagaaggagagagcgactcggaccgatg

SEQ ID NO: 9979 - DNA, 203 bp, Homo sapiens
ggcgcgccagtccttacgccctaatctctagcagtggcgcccgaacagggacttgaaagcgaaagtagaaccagaggagctctctcgacgcaggactcggcttgctgaagcgcgcacagcaagaggcgaggggcagcgaacggtgagtacgctgaaatttttgactagcggaggctagaaggagagagcgactcggaccgatg

SEQ ID NO: 9980 - DNA, 203 bp, Homo sapiens
ggcgcgccagtcctgacctgaaaatctctagcagtggcgcccgaacagggacttgaaagcgaaagtagaaccagaggagctctctcgacgcaggactcggcttgctgaagcgcgcacagcaagaggcgaggggcggcgactggtgagtacgccaaaatttttgactagcggaggctagaaggagagagcgactcggaccgatg

SEQ ID NO: 9981 - DNA, 203 bp, Homo sapiens
ggcgcgccagtcctcccggaacaatctctagcagtggcgcccgaacagggacttgaaagcgaaagtagaaccagaggagctctctcgacgcaggactcggcttgctgaagcgcgcacggcaagaggcgaggggcagcgaacggtgagtacgctgaaaaatttgactagcggaggctagaaggagagagcgactcggaccgatg

SEQ ID NO: 9982 - DNA, 203 bp, Homo sapiens
ggcgcgccagtcctagcacttgaatctctagcagtggcgcccgaacagggacttgaaagcgaaagtagaaccagaggagctctctcgacgcaggactcggcttgctgaagcgcgcacggcaagaggcgaggggcggcgaacggtgagtacgccaaaatttttgactagcggaggctagaaggagagagcgactcggaccgatg

SEQ ID NO: 9983 - DNA, 203 bp, Homo sapiens
ggcgcgccagtcctaaggcatgaatctctagcagtggcgcccgaacagggacttgaaagcgaaagtagaaccggaggagctctcttgacgcaggactcggcttgctgaagcgcgcacggcaagaggcgaggggcggcgactggtgagtacgccaaaatttttgactagcggaggctagaaggagagagcgactcggaccgatg

SEQ ID NO: 9984 - DNA, 203 bp, Homo sapiens
ggcgcgccagtcctctaaggtaaatctctagcagtggcgcccgaacaggggcaagaaaaggaaaatgagacccgaggggatttcttgacgcaggactcggcttgctgaagtgcactcggcaagaggcgagaggggcgactggtgagtacgccaattttatttgactagcggaggctagaaggagagagcgactcggaccgatg

SEQ ID NO: 9985 - DNA, 203 bp, Homo sapiens
ggcgcgccagtcctccatacggaatctctagcagtggcgcctgaacagggacctgaaaacgaaagcggaaccggagcagctctctcgacgcaggactcggcttgctgaagcgcgcacagcaagaggcgaggggaggcgactggtgagtacgccaaattttttgactagcggaggctagaaggagagagcgactcggaccgatg

SEQ ID NO: 9986 - DNA, 203 bp, Homo sapiens
ggcgcgccagtcctcggtcatcaatttttagcaggggggccccaacagggacccgaaagccaaagttagaacccgagaagttctctcgacgcaggaactcggcttgctgaggtgcacacagcaagaggcgaaagcggcgaactggtgagtaccgccctttttgattaccggaggttaataggagagagcgactcggaccgatg

SEQ ID NO: 9987 - DNA, 203 bp, Homo sapiens
ggcgcgccagtcctatacatgaacagggaccagaaagtgaaagtggaaccagggaagaaaacctccgacgcaacgggctcggcttagcggagtgcacctgctaagaggcgagaggaactcacagagggtgagtaaattgctggcggtggccagacctaggggaaggacgaagtctctaggggaggaagcgactcggaccgatg

SEQ ID NO: 9988 - DNA, 203 bp, Homo sapiens
ggcgcgccagtccttcgtgcggacagggacctgaaagcgaaagttaatagggactcgaaagcgaaagttccagagaagttctctcgacgcaggactcggcttgctgaggtgcacacagcaagaggcgagagcggcgactggtgagtacgccaaaaattttttgactagcggaggctagaaggagagagcgactcggaccgatg

SEQ ID NO: 9989 - DNA, 203 bp, Homo sapiens
ggcgcgccagtcctcgtgcagtacagggaccttaaagcgaaagtaaaagggactcgaaagcggaagttccagagaagatctctcgacgcaggactcggcttgctgagtgcacacagcaagaggcgaggggcggcgactggtgagtacgccaaaaatttttttgactagcggaggctaggaggagagagcgactcggaccgatg

SEQ ID NO: 9990 - DNA, 203 bp, Homo sapiens
ggcgcgccagtccttgcgttagacagggacgcgaaagagaaagtgaaaccagggaagaaaacctccgacgcaacgggctcggcttagcggagtgcacctgctaagaggcgagaggaactcacaggggtgagtaaatttgctggcggtggccagacctaggggaagggcgaagtctctaggggaggaagcgactcggaccgatg

SEQ ID NO: 9991 - DNA, 203 bp, Homo sapiens
ggcgcgccagtccttatctcgcactagagatccctcagaccactctagacagtgtaaaaatctctagcagtggcgcccgaacagggacctgaaagcgaaagttaatagggactcgaaagcgaaagttccagagaagttctctcgacgcaggactcggctcgctgaaggtgcactcggcgagaggcgagcgactcggaccgatg

SEQ ID NO: 9992 - DNA, 203 bp, Homo sapiens
ggcgcgccagtccttttagctaactagagatccctcagaccactctagactgagtaaaaatctctaccagtggcgcccgaacagggcactcgaaagcgaaagttaatagggactcgaaagcgaaagttccagagaagttctctcgacgcaggactcggcttgctgaggtgcacacagcaagaggcgagcgactcggaccgatg

SEQ ID NO: 9993 - DNA, 203 bp, Homo sapiens
ggcgcgccagtccttgcctccaactagagatccctcagaccactctagactgagtaaaaatctctagcagtggcgcccgaacagggacttgaaagcgaaagttaatagggactcgaaagcgaaagttccagagaagttctctcgacgcaggactcggcttgctgaggtgcgcaacagcaagaggcgagcgactcggaccgatg

SEQ ID NO: 9994 - DNA, 203 bp, Homo sapiens
ggcgcgccagtcctcgcattacactagagatccctcagaccactctagatagtgtaaaaatctctagaagtggcgcccgaacagggacttgaaagcgaaagttaaacgggactcgaaagcgaaagttccagagaagttctctcgacgcaggactcggcttgctgaaggtgcacacagcaagaggcgagcgactcggaccgatg

SEQ ID NO: 9995 - DNA, 203 bp, Homo sapiens
ggcgcgccagtcctcataaataactagagatccctcagaccactctagtgagtgtaaaaatctctagcagtggcgcccgaacagggacttgaaagcgaaagttaacagggactcgaaagcgaaagttccagagaagttctctcgacgcaggactcggcttgctgaaggtgcacgcagcaagaggcgagcgactcggaccgatg

SEQ ID NO: 9996 - DNA, 203 bp, Homo sapiens
ggcgcgccagtcctgtactttgagacagattcggattggcagagagcctgttggaatcaaaagaaggttgccaaaagattcttaaagttttagaaccattagtaccaacagggtcagaaaatttaaaaagcctttttaataccgtctgcgtcatttggtgcttgcacgcagaagagaaagtgaaagatcgactcggaccgatg

SEQ ID NO: 9997 - DNA, 203 bp, Homo sapiens
ggcgcgccagtcctgaacgagcagacagatttggatcggcagaaagcctgttggaaagcaaagaaggatgtcaaagaatattagcagtactagctccattaatgccaacaggctcggaaaatttaaaaagcttgtttagtactgtctgcgtagtttggtgtctgcacgcagaaatgaaagtgaaagaccgactcggaccgatg

SEQ ID NO: 9998 - DNA, 203 bp, Homo sapiens
ggcgcgccagtccttttagacgagcagtggcgcctgaacagggacccgaaagcgaaagtaggaccagaggagatctctcgacgcaggactcggcttgctgaagtgcgcacggcaagaggcgaggggacggcggctgggtgagtacgccaaaaataaaattttgactagcggaggctagaaggagagagcgactcggaccgatg

SEQ ID NO: 9999 - DNA, 203 bp, Homo sapiens
ggcgcgccagtcctatcttagcatcaattgtgtgactctggtatctagagatccctcagacctctttagtccgggtggaaaatctctagcagtggcgcccgaacagggacgcgaaagcgaaagtagaaccggagaagatctctcgacgcaggactcggcttgctgaagcgcgcacagcaagaggcgagcgactcggaccgatg

SEQ ID NO: 10000 - DNA, 203 bp, Homo sapiens
ggcgcgccagtcctctgtgggcatccaatttgtgactctggtatctagagatccctcagatattaagtgtctgtgcggaaaatctctagcagtggcgcccgaacagggacttgaaaacgaaagtgtaaccggagaagttctctcgacgcaggactcgacttgctgagtgcgcaccagcaaggggcgagcgactcggaccgatg

SEQ ID NO: 10001 - DNA, 203 bp, Homo sapiens
ggcgcgccagtcctgcaaggttatccattcggtaactctggtacctagagatccctcagaccatctggactgagtagaaaatctctagcagtggcgcccgaacagggacttgaaaacgaaagtagaaccggaggctgaatctctcgacgcaaggactcggctcgttggtgcacacagcgagaggcgagcgactcggaccgatg

SEQ ID NO: 10002 - DNA, 203 bp, Homo sapiens
ggcgcgccagtcctggcggtgtatctctagcagtggcgcccgaacagggacccgaaagcgaaagtagaaccagagaagctctctcgacgcaggactcggcttgctgaagcgcgctcggcaagaggcgaggggcggcgactggtgagtacgcctaaaatttttgactagcggaggctagaaggagagagcgactcggaccgatg

SEQ ID NO: 10003 - DNA, 203 bp, Homo sapiens
ggcgcgccagtccttgcgtatcatctctagcagtggcgcccgaacagggacccgaaagcgaaagtgagaccagagaagatctctcgacgcaggactcggcttgctgaagtgcactcggcaagaggcgagaggggcggctggtgagtacgccaaattttatttgactagcggaggctagaaggagagagcgactcggaccgatg

SEQ ID NO: 10004 - DNA, 203 bp, Homo sapiens
ggcgcgccagtcctttgctttaatctctagcagtggcgcccgaacagggacccgaaagtgaaagtaagaccagaggaggtctctcgacgcaggactcggcttgctgaagtgcactcggcaagaggcgagagcggcgactggtgagtacgccaaattttatttgactagcggaggctagaaggagagagcgactcggaccgatg

SEQ ID NO: 10005 - DNA, 203 bp, Homo sapiens
ggcgcgccagtcctgattagatatctctagcagtggcgcccgaacagggacctgaaaagcgaaagtaaaaccagagaagctctctcgacgcaggactcggcttgctgagcgcgcacggcaagaggcgaggggcagcgactggtgagtacgctgaaattttttgactagcggaggctagaaggagagagcgactcggaccgatg

SEQ ID NO: 10006 - DNA, 203 bp, Homo sapiens
ggcgcgccagtcctaaatttagatctctagcagtggcgcccgaacagggacctgaaagcgaaagtaagaccagaggagatctctcgacgcaggactcggcttgctgaagtgcactcggcaagaggcgagagcggcggctggtgagtacgccaatttttatttgactagcggaggctagaaggagagagcgactcggaccgatg

SEQ ID NO: 10007 - DNA, 203 bp, Homo sapiens
ggcgcgccagtcctgcgttaccatctctagcagtggcgcccgaacagggacgcgaaaagcgaaaataaaaccagagaagatctctcgacgcaggactcggcttgctgaagtgcacacggcaagaggcgaggggagcggcgactggtgagtacgccaatttttgactagcggaggctagaaggagagagcgactcggaccgatg

SEQ ID NO: 10008 - DNA, 203 bp, Homo sapiens
ggcgcgccagtcctagcagcttatctctagcagtggcgcccgaacagggacgctgaaagtgaaagagaaaccagaggagctctctcgacgcaggactcggcttgctgcagcgcgcacggcaagaggcgaggggcggcgactggtgagtacgccaaaatttttgactagcggaggctagaaggagagagcgactcggaccgatg

SEQ ID NO: 10009 - DNA, 203 bp, Homo sapiens
ggcgcgccagtcctataaagttatctctagcagtggcgcccgaacagggacgtgaaagcgaaagtagaaccagagaagctctctcgacgcgaggactcggcttgctgaagcgcgcacagcaagaggcgaggggcggcgactggtgagtacgccgaattttttgactagcggaggctagaaggagagagcgactcggaccgatg

SEQ ID NO: 10010 - DNA, 203 bp, Homo sapiens
ggcgcgccagtcctaaggagcgatctctagcagtggcgcccgaacagggactagaaaacgaaagtaaggccagaggagatctctcgacgcaggactcggcttgctgaagtgcacacggcaagaggcgagagcggcggctggagagtacgccgaattttatttgactagcggaggctagaaggagagagcgactcggaccgatg

SEQ ID NO: 10011 - DNA, 203 bp, Homo sapiens
ggcgcgccagtcctctgcaataatctctagcagtggcgcccgaacagggacttgaaaacgaaagtgtaaccggagaagttctctcgacgcaggactcgacttgctgagtgcgcaccagcaaggggcgaggggccggcgactggtgagtacgcctaatttttgactagcgaaagctagaaggagagaggcgactcggaccgatg

SEQ ID NO: 10012 - DNA, 203 bp, Homo sapiens
ggcgcgccagtcctacttcgaaatctctagcagtggcgcccgaacagggacttgaaagcgaaagagaaaccagaggagctctctcgacgcaggactcggcttgctgaagcgcgcacggcaagaggcgaggggcggcgactggtgagtacgccaaaattttttgactagcggatgctagaagaaaaaagcgactcggaccgatg

SEQ ID NO: 10013 - DNA, 203 bp, Homo sapiens
ggcgcgccagtccttcttcacgatctctagcagtggcgcccgaacagggacttgaaagcgaaagggaaaccagaggagctctctcgacgcaggactcggcttgctgaagcgcgcacggcaagaggcgaggggcggcgactggtgagtacgccgaaaatttttgactagcggaggctagaaggagagagcgactcggaccgatg

SEQ ID NO: 10014 - DNA, 203 bp, Homo sapiens
ggcgcgccagtcctcaatgggtatctctagcagtggcgcccgaacagggacttgaaagcgaaagtaaaaccagaggagatctctcgacgcaggactcggcttgctgaagtgcactcggcaagaggcgagagcggcgactggtgagtacgccgaattttatttgactagcggaggctagaaggagagagcgactcggaccgatg

SEQ ID NO: 10015 - DNA, 203 bp, Homo sapiens
ggcgcgccagtcctatccttccatctctagcagtggcgcccgaacagggacttgaaagcgaaagtaaaaccagaggagatctctcgacgcaggactcggcttgctgaagtgcactcggcaagaggcgagagcggcggctggtgagtacgccaaattttatttgactagcggaggctagaaggagagagcgactcggaccgatg

SEQ ID NO: 10016 - DNA, 203 bp, Homo sapiens
ggcgcgccagtcctttcatcgcatctctagcagtggcgcccgaacagggacttgaaagcgaaagtaagaccagagaagatctctcgacgcaggactcggcttgctgaagtgcactcggcaagaggcgagagcggcgactggtgagtacgccaaattttatttgactggcggaggctagaaggagagagcgactcggaccgatg

SEQ ID NO: 10017 - DNA, 203 bp, Homo sapiens
ggcgcgccagtcctaccaactgatctctagcagtggcgcccgaacagggacttgaaagcgaaagtaagaccagagaagatctctcgacgcaggactcggcttgctgaagtgcactcggcaagaggcgagaggggcggctggtgagtacgccaatttttatttgactagcggaggctagaaggagagagcgactcggaccgatg

SEQ ID NO: 10018 - DNA, 203 bp, Homo sapiens
ggcgcgccagtcctaggtaactatctctagcagtggcgcccgaacagggacttgaaagcgaaagtaagaccagagcagatctctcgacgcaggactcggcttgctgaagtgcactcggcaagaggcgagagcggcgactggtgagtacgccgaattttatttgactagcggaggctagaaggagagagcgactcggaccgatg

SEQ ID NO: 10019 - DNA, 203 bp, Homo sapiens
ggcgcgccagtcctggaatcaaatctctagcagtggcgcccgaacagggacttgaaagcgaaagtaagaccagaggagaactctcgacgcaggactcggcttgctgaagtgcactcggcaagaggcgagagaggcggctggtggagtacgccatttttatttgactagcggaggctagaaggagagagcgactcggaccgatg

SEQ ID NO: 10020 - DNA, 203 bp, Homo sapiens
ggcgcgccagtcctaatcacttatctctagcagtggcgcccgaacagggacttgaaagcgaaagtaagaccagaggagatctctcgacgcaggactcggcttgctgaagtgcacacggcaagaggcgagagcggcggctggtgagtacgccaaattttatttgactagcggaggctagaaggagagagcgactcggaccgatg

SEQ ID NO: 10021 - DNA, 203 bp, Homo sapiens
ggcgcgccagtccttaacgataatctctagcagtggcgcccgaacagggacttgaaagcgaaagtaagaccagaggagatctctcgacgcaggactcggcttgctgaagtgcactcggcaagaggcgagagcggcgactggtgagtacgccgaattttatttgactagcggaggctagaaggagagagcgactcggaccgatg

SEQ ID NO: 10022 - DNA, 203 bp, Homo sapiens
ggcgcgccagtcctacaagcgcatctctagcagtggcgcccgaacagggacttgaaagcgaaagtaagaccagaggagatctctcgacgcaggactcggcttgctgaagtgcactcggcaagaggcgagagcggcggctggtgagtacgccaaattttatttgactagcggaggctaggaggagagagcgactcggaccgatg

SEQ ID NO: 10023 - DNA, 203 bp, Homo sapiens
ggcgcgccagtcctcttactagatctctagcagtggcgcccgaacagggacttgaaagtgaaagtaagaccagaggaaatctctcgacgcaggactcggcttgctgaagtgcactcggcaagaggcgagagcggcggctggtgagtacgccaaaatttatttgactagcggaggctagaaggagagagcgactcggaccgatg

SEQ ID NO: 10024 - DNA, 203 bp, Homo sapiens
ggcgcgccagtcctagattcgtatctctagcagtggcgcccgaacagggacttgaagcgaaagcgaaagccagagaagttctctcgacgcaggactcggcttgctgagcgcgcacagcaagaggcgaggggcggcggctggtgagtacgccaaatttcttttgactagcggaggctagaaggagagagcgactcggaccgatg

SEQ ID NO: 10025 - DNA, 203 bp, Homo sapiens
ggcgcgccagtcctccattagcatctgttcaaccctggtgtctagagatccctcagatcacttagactgaagcagaaaatctctagcagtggcgcccgaacagggacttgaagtgaaagtgaaaccagggaagaaaacctccgacgcaacgggctcggcttagcggagtgcacccgctaagaggcgagcgactcggaccgatg

SEQ ID NO: 10026 - DNA, 203 bp, Homo sapiens
ggcgcgccagtcctctatacaaatctgttcgaccctggtatctagagatccctcagatcacttagactgaagcagaaaatctctagcagtggcgcccgaacagggaccggaagagaaagtgaaaccagggaagaaaacctccgacgcgacgggctcggcttagcggagtgcacccgctaagaggcgagcgactcggaccgatg

SEQ ID NO: 10027 - DNA, 203 bp, Homo sapiens
ggcgcgccagtcctaacgcggcatctgttgtgtgactctggtaactagagatccctcaaacccttttagtcagtgtgaaaaatctctagcagtggcgcccgaacagggacccgaaagcgaaagtagaaccggaggagctctctcgacgcaggactcggcttgctgaaccgcgcacggcaaaaggcgagcgactcggaccgatg

SEQ ID NO: 10028 - DNA, 203 bp, Homo sapiens
ggcgcgccagtcctccagagaaatttgttgtgtgactctggtaactagagatccctcagaccattctagtcagtgtggaaaatctctagcagtggcgcccgaacagggacttgaaagcgaaagtagaaccagaggagatctctcgacgcaggactcggcttgctgaagcgcgcacggcaagaggcgagcgactcggaccgatg

SEQ ID NO: 10029 - DNA, 203 bp, Homo sapiens
ggcgcgccagtcctatacaaatcaggctcagaaaatttaaagagtctttataatactgtctgcgtcatttggtgcatacacgcagaaatgaaagtgaaaaatactgaggaagcaaagcagatagtgcagaaacacctagcggtagaaaatgaaactgcagaccaattgcctgccacaagtagaccaaccgactcggaccgatg

SEQ ID NO: 10030 - DNA, 203 bp, Homo sapiens
ggcgcgccagtcctatacgtctcagggacctgaaaaagaaagttaatagggactcgaaagcgaaagttccagagaagttctctcgacgcaggactcggcttactgaagtgcacacagtaagaggcgagagcggcgactggtgagtacgccaaaaaattttttgactagcggaggctagaaggagagagcgactcggaccgatg

SEQ ID NO: 10031 - DNA, 203 bp, Homo sapiens
ggcgcgccagtcctatggctcccagggacctgaaaaggaaagtgaaaccagggaagaaaacctccgacgcaacgggctcggcttagcggagtgcacctgctaagaggcgagaggactcacagaagggtgagtaaatttgctggcggtggccagacctaggggaagggcgaagtctctaggggaggaagcgactcggaccgatg

SEQ ID NO: 10032 - DNA, 203 bp, Homo sapiens
ggcgcgccagtccttgggcaaccagggacctgaaagcgaaagttaatagggactcgaaaacgaaagttccagagaagttctctcgacgcaggactcggcttgctgaggtgcacacagcaagaggcgagagcggcgaactggtgagtacgcctaagattttttgactagcggaggctagaaggagagagcgactcggaccgatg

SEQ ID NO: 10033 - DNA, 203 bp, Homo sapiens
ggcgcgccagtcctctccgtgccagggacttgaaagagaaagtgaaaccagggaagaaaacctccgacgcaacgggctcggcttagcggagtgcacccgctgagaggcgagaggaactcacagagggtgagtaaatttgctggcggtggccagacctaggggaagggcgaagtccctaggggaggaagcgactcggaccgatg

SEQ ID NO: 10034 - DNA, 203 bp, Homo sapiens
ggcgcgccagtcctaatgctatcaggttcagaaaatttaaaaagtctttttaatactgtctgcgtcatttggtgcatacacgcagaagagaaagtgaaagatactgaaggagcaaaacaaatagtgcggagacatctagtggcagaaacaggaactgcagagaaaatgccaagcacaagtagaccaaccgactcggaccgatg

SEQ ID NO: 10035 - DNA, 203 bp, Homo sapiens
ggcgcgccagtcctcccaccgacaggttcagaaaatttaaagagcctttacaatactgtctgcgtcatttggtgtttgcacgcagaagaaaaagtgaaacatactgaggaagcaaagcaagtagtgcagagacatctagtggtggaaacaggaacagcagacaacatgccgaaaacaagtaggccaaccgactcggaccgatg

SEQ ID NO: 10036 - DNA, 203 bp, Homo sapiens
ggcgcgccagtccttactctatcaggttcagaaaatttaaagagcctttataatactgtctgcgtcatttggtgcattcacgcagaagagaaagtgaaacatactgaggaagcaaaacaaatagtgcagagacatctagtggtggaaacaggaacagcagacagaatgccagtaacaagcagaccaaccgactcggaccgatg

SEQ ID NO: 10037 - DNA, 203 bp, Homo sapiens
ggcgcgccagtcctacgtcgctcaggttcagaaaatttaaagagcctttataatactgtctgcgtcatttggtgcttgcacgcagaagagaaagtgagacatactgaggaagcaaaacaagtagtgcagagacatctagtggtggaaacaggaacagcagacaacatgccgaaaacaagtaggccaaccgactcggaccgatg

SEQ ID NO: 10038 - DNA, 203 bp, Homo sapiens
ggcgcgccagtcctgattgcgtcaggttcagaaaatttaaagagcttgtacaatactgtctgcgtcatttggtgcattcacgcagaagagaaagtgaaacatactgaggaagcaagacaaatagtgcagaaacatctagtggtggaaacaggaacagcagacaccatgccaaaaacaagtagaccaaccgactcggaccgatg

SEQ ID NO: 10039 - DNA, 203 bp, Homo sapiens
ggcgcgccagtccttaaacgcgcatccattcggtaactctggtacctagagatccctcagaccatctagactgagtgaaaaatctctagcagtggcgcccgaacagggacttgaaaacgaaagtagaaccggaggctgaatctctcgacgcaggactcggctcgttggtgcacacagcgagaggcgagcgactcggaccgatg

SEQ ID NO: 10040 - DNA, 203 bp, Homo sapiens
ggcgcgccagtcctgccaagatcatctgttgtgtgactctggtaactagagatccctcagacctctttggtcagtgtagaaaatctctagcagtggcgcccgaacagggacttgaaagcgaaagtagaaccagaggagctctctcgacgcaggactcggcttgctgagcgcgcacagcaagaggcgagcgactcggaccgatg

SEQ ID NO: 10041 - DNA, 203 bp, Homo sapiens
ggcgcgccagtcctcgctgtagcattagtaccaacaggatcagaaaatttaaaaagcctttttaatactgtctgcgtcattttctgcctgcacgcagaagagaaagtgaaagatacagaggaggcaaaaaagatagcacagcgacacctagcggacgcagaaaaaatgacagctacaaataaaccaaccgactcggaccgatg

SEQ ID NO: 10042 - DNA, 203 bp, Homo sapiens
ggcgcgccagtcctaggtccatcccgaacagggaccgaaagtgaaaccagggaagaaaacctccgacgcaacgggctcggcttagcggagtgcacccgctaagaggcgagaggaactcacaagagggtgagtaattttgctggcggtggccagacctaggggaagggcgaagtctctaggggaggaagcgactcggaccgatg

SEQ ID NO: 10043 - DNA, 203 bp, Homo sapiens
ggcgcgccagtccttccaaacgcccgtctgttgtatgactctggtaactagagatccctcagaccactctagacggtgtaaaaaatctctagcagtggcgcccgaacagggacttgaaagcgaaagttccagagaagttctctcgacgcaggactcggcttgctgaggtgcacacagcaagaggcgagcgactcggaccgatg

SEQ ID NO: 10044 - DNA, 203 bp, Homo sapiens
ggcgcgccagtcctgttacaatccgaacagggacccgaaagtgaaagttaatagggactcgaaagcggaagttccagagaagttctctcgacgcaggactcggcttgctgaggtgcacacagcaagaggcgagagcggcgactggtgagtacgccaatttttgactagcagaggctagaaggagagagcgactcggaccgatg

SEQ ID NO: 10045 - DNA, 203 bp, Homo sapiens
ggcgcgccagtcctgggcatcaccgaacagggacttaaaagcgaaagttaatagggactcgaaagcgaaagttccagaaaagttctctcgacgcaggactcggcttgctgaggtgcacacagcaagaggcgagagcggcgactggtgagtacgccattttttaactagcggaggctagaaagagagagcgactcggaccgatg

SEQ ID NO: 10046 - DNA, 203 bp, Homo sapiens
ggcgcgccagtccttaccgcagccgaacagggacttgaaaagcgaaagtaacagggactcgaaagcgaaagttccagagaagttctctcgacgcaggactcggcttgctgaggtgcacacagcaagaggcgagagcggcgactggtgagtacgccattttttgactagcggaggctagaaggagagagcgactcggaccgatg

SEQ ID NO: 10047 - DNA, 203 bp, Homo sapiens
ggcgcgccagtccttaagtctaccgaacagggacttgaaagcgaaagctaatagggactcgaaagcgaaagttccagagaagttctctcgacgcaggactcggcttgctgcggtgcacacagcaagaggcgagacgggcgactggtgagtacgccaaattttgactagcggaggctagaaggagagagcgactcggaccgatg

SEQ ID NO: 10048 - DNA, 203 bp, Homo sapiens
ggcgcgccagtcctttgacgcaccgaacagggacttgaaagcgaaagtaacagggactcgaaagcgaaagttccagagaagttctctcgacgcaggactcggcttgctgggtgcacacagcaagaggcgagagcggcgactggtgagtacgccataaattttgactagcggaggctagaaggagagagcgactcggaccgatg

SEQ ID NO: 10049 - DNA, 203 bp, Homo sapiens
ggcgcgccagtcctacttgggtccgaacagggacttgaaagcgaaagttaacagggactcgaaagcgaaagttccagagaagttctctcgacgcaggactcggcttgctgaaggtgcacacagcaagaggcgagagcggctggtgagtacgccataaattttgactagcggaggctagaaggagagagcgactcggaccgatg

(The sequence listing continues in the following parts.)

What is claimed is:

1. A recombinant circular RNA molecule comprising a protein-coding nucleic acid sequence and an internal ribosome entry site (IRES) sequence region operably linked to the protein-coding nucleic acid sequence, wherein the IRES sequence region comprises:
   (i) at least one RNA secondary structure element;
   (ii) a sequence that is complementary to an 18S ribosomal RNA (rRNA); and
   wherein the IRES sequence region has a minimum free energy (MFE) of less than −18.9 kJ/mol and a melting temperature of at least 35.0° C.

2. The recombinant circular RNA molecule of claim 1, wherein the protein-coding nucleic acid sequence is operably linked to the IRES sequence region in a non-native configuration.

3. The recombinant circular RNA molecule of claim 1, wherein the RNA secondary structure element is formed from the nucleotides at about position 40 to about position 60 of the IRES, wherein the first nucleic acid at the 5' end of the IRES sequence region is considered to be position 1.

4. The recombinant circular RNA molecule of claim 1, wherein the at least one RNA secondary structure element is a stem-loop.

5. The recombinant circular RNA molecule of claim 1, wherein the at least one RNA secondary structure element is located 5' to the sequence that is complementary to an 18s RNA.

6. The recombinant circular RNA molecule of claim 1, wherein the at least one RNA secondary structure element is located 3' to the sequence that is complementary to an 18s RNA.

7. The recombinant circular RNA molecule of claim 1, wherein the at least one RNA secondary structure element is formed from the nucleotides at about position 40 to about position 60 of the IRES, relative to the 5' end thereof.

8. The recombinant circular RNA molecule of claim 1, wherein the IRES sequence region has a G-C content of at least 25%.

9. The recombinant circular RNA molecule of claim 1, wherein the IRES sequence region is between 200-800 nucleotides in length, between 150-200 nucleotides, between 160-180 nucleotides, or between 200-210 nucleotides in length.

10. The recombinant circular RNA molecule of claim 1, wherein the IRES sequence region is derived from a human IRES.

11. The recombinant circular RNA molecule of claim 1, further comprising a spacer between the IRES sequence region and a start codon of the protein-coding nucleic acid sequence region.

12. The recombinant circular RNA molecule of claim 11, wherein the length of the spacer is selected to increase translation of the protein-coding nucleic acid sequence region of the recombinant circular RNA molecule relative to translation of a recombinant circular RNA molecule having either no spacer or a spacer that differs from the selected spacer.

13. The recombinant circular RNA molecule of claim 1, wherein the protein-coding nucleic acid sequence region lacks a stop codon.

14. A method of producing a protein in a cell, the method comprising contacting a cell with the recombinant circular RNA molecule of claim 1 under conditions whereby the protein-coding nucleic acid sequence region is translated and the protein is produced in the cell.

15. The method of claim 14, wherein the cell is in vivo.

16. The method of claim 15, wherein the cell is a mammalian cell.

17. The method of claim 16, wherein the mammalian cell is derived from a human.

18. The method claim 17, wherein production of the protein is tissue-specific.

19. The method claim 14, wherein the half-life of the recombinant circular RNA in the cell is about 1 to about 7 days.

20. The method of claim 14, wherein the protein is produced in the cell for at least about 10%, at least about 20%, or at least about 30% longer than if the protein-coding nucleic acid sequence region is provided to the cell in a linear format RNA or encoded for transcription as a linear RNA.

* * * * *